United States Patent
Chang et al.

(10) Patent No.: US 11,685,924 B2
(45) Date of Patent: Jun. 27, 2023

(54) GENETIC ELEMENTS DRIVING CIRCULAR RNA TRANSLATION AND METHODS OF USE

(71) Applicant: The Board of Trustees of the Leland Stanford Junior University, Stanford, CA (US)

(72) Inventors: Howard Y. Chang, Stanford, CA (US); Chun-Kan Chen, Stanford, CA (US)

(73) Assignee: The Board of Trustees of the Leland Stanford Junior University, Stanford, CA (US)

( * ) Notice: Subject to any disclaimer, the term of this patent is extended or adjusted under 35 U.S.C. 154(b) by 0 days.

(21) Appl. No.: 17/937,617

(22) Filed: Oct. 3, 2022

(65) Prior Publication Data

US 2023/0125935 A1   Apr. 27, 2023

Related U.S. Application Data

(60) Division of application No. 17/696,606, filed on Mar. 16, 2022, now Pat. No. 11,560,567, which is a continuation of application No. PCT/US2021/039127, filed on Jun. 25, 2021.

(60) Provisional application No. 63/186,507, filed on May 10, 2021, provisional application No. 63/043,964, filed on Jun. 25, 2020.

(51) Int. Cl.
| | |
|---|---|
| C07H 21/02 | (2006.01) |
| C07H 21/04 | (2006.01) |
| C12N 15/67 | (2006.01) |
| C12N 15/113 | (2010.01) |
| C12N 15/85 | (2006.01) |

(52) U.S. Cl.
CPC ............ *C12N 15/67* (2013.01); *C12N 15/113* (2013.01); *C12N 15/85* (2013.01); *C12N 2840/203* (2013.01)

(58) Field of Classification Search
CPC .................................................. C12N 15/113
See application file for complete search history.

(56) References Cited

U.S. PATENT DOCUMENTS

| | | | |
|---|---|---|---|
| 5,766,903 A | 6/1998 | Sarnow et al. | |
| 2016/0082092 A1 | 3/2016 | Hoerr et al. | |
| 2016/0083747 A1 | 3/2016 | Kruse | |
| 2018/0044739 A1 | 2/2018 | Weinbaum et al. | |
| 2019/0345503 A1 | 11/2019 | Chang et al. | |

FOREIGN PATENT DOCUMENTS

| | | |
|---|---|---|
| WO | WO2010084371 A1 | 7/2010 |
| WO | WO2014082644 A1 | 6/2014 |
| WO | WO2016011222 A2 | 1/2016 |
| WO | WO2017081082 A2 | 5/2017 |
| WO | WO2017222911 A1 | 12/2017 |
| WO | WO2020023655 A1 | 1/2020 |
| WO | WO2020219563 A1 | 10/2020 |

OTHER PUBLICATIONS

Ahmad et al., "Breaching Self-Tolerance to Alu Duplex RNA Underlies MDA5-Mediated Inflammation." Cell. Feb. 8, 2018;172(4):797-810.e13.
Baranick et al., "Splicing mediates the activity of four putative cellular internal ribosome entry sites." Proc Natl Acad Sci U S A. Mar. 25, 2008;105(12):4733-8.
Batista et al., "m(6)A RNA modification controls cell fate transition in mammalian embryonic stem cells." Cell Stem Cell. Dec. 4, 2014;15(6):707-19.
Bert et al., "Assessing IRES activity in the HIF-1 alpha and other cellular 5' UTRs." RNA. Jun. 2006;12(6):1074-83.
Brito et al., "A cationic nanoemulsion for the delivery of next-generation RNA vaccines." Mol Ther. Dec. 2014;22(12):2118-29.
Chandry et al., "Activation of a cryptic 5' splice site in the upstream exon of the phage T4 td transcript: exon context, missplicing, and mRNA deletion in a fidelity mutant." Genes Dev. Nov. 1987;1(9):1028-37.
Chen et al., "N6-Methyladenosine Modification Controls Circular RNA Immunity". Mol Cell. Oct. 3, 2019;76(1):96-109.e9.
Chen et al., "Pervasive functional translation of noncanonical human open reading frames." Science. Mar. 6, 2020;367(6482):1140-1146.
Chen et al., "Sensing Self and Foreign Circular RNAs by Intron Identity." Mol Cell. Jul. 20, 2017;67(2):228-238.e5.
Chu et al., "Systematic discovery of Xist RNA binding proteins." Cell. Apr. 9, 2015;161(2):404-16.
Crooke et al., "RNA-Targeted Therapeutics." Cell Metab. Apr. 3, 2018;27(4):714-739.
Devarkar et al., "Structural basis for m7G recognition and 2'-O-methyl discrimination in capped RNAs by the innate immune receptor RIG-I." Proc Natl Acad Sci U S A. Jan. 19, 2016;113(3):596-601.
Dobrikova et al., "Activity of a type 1 picornavirus internal ribosomal entry site is determined by sequences within the 3' nontranslated region." Proc Natl Acad Sci U S A. Dec. 9, 2003;100(25):15125-30.
Dolinnaya et al., "Oligonucleotide circularization by template-directed chemical ligation." Nucleic Acids Res. Nov. 25, 1993;21(23):5403-7.
Dolinnaya et al., "The use of BrCN for assembling modified DNA duplexes and DNA-RNA hybrids; comparison with water-soluble carbodiimide." Nucleic Acids Res. Jun. 11, 1991;19(11):3067-72.

(Continued)

*Primary Examiner* — Amy H Bowman
(74) *Attorney, Agent, or Firm* — Casimir Jones, S.C.; Tanya A. Arenson

(57) ABSTRACT

Provided herein are recombinant circular RNA (circRNA) molecules comprising an internal ribosome entry site (IRES) operably linked to a protein-coding nucleic acid sequence. The IRES includes at least one RNA secondary structure element; and a sequence region that is complementary to an 18S ribosomal RNA (rRNA). Methods of producing a protein in a cell using the recombinant circRNA molecules are also provided.

16 Claims, 53 Drawing Sheets

Specification includes a Sequence Listing.

(56) References Cited

OTHER PUBLICATIONS

Dominissini et al., "Topology of the human and mouse m6A RNA methylomes revealed by m6A-seq." Nature. Apr. 9, 2012;485(7397):201-6.
Durbin et al., "RNAs Containing Modified Nucleotides Fail to Trigger RIG-I Conformational Changes for Innate Immune Signalingm." Bio. 2016. 7: e00833-00816. 11 pages.
Edupuganti et al., "N 6-methyladenosine (m 6 A) recruits and repels proteins to regulate mRNA homeostasis." Nat Struct Mol Biol. Oct. 2017;24(10):870-878.
European Search Report for related EP17815958.8, dated Dec. 5, 2019, 12 pages.
Fedorova et al. "Cyanogen bromide-induced chemical ligation: Mechanism and optimization of the reaction conditions." Nucleosides, Nucleotides & Nucleic Acids 15.6 (1996): 1137-1147.
Ford et al., "Synthesis of circular RNA in bacteria and yeast using RNA cyclase ribozymes derived from a group I intron of phage T4." Proc Natl Acad Sci U S A. Apr. 12, 1994;91(8):3117-21.
Garlapati et al., "Identification of a novel internal ribosome entry site in giardiavirus that extends to both sides of the initiation codon." J Biol Chem. Jan. 30, 2004;279(5):3389-97.
Glazar et al., "circBase: a database for circular RNAs." RNA. Nov. 2014;20(11):1666-70.
Gurtu et al., "IRES bicistronic expression vectors for efficient creation of stable mammalian cell lines." Biochem Biophys Res Commun. Dec. 4, 1996;229(1):295-8.
Hansen et al., "Natural RNA circles function as efficient microRNA sponges." Nature. Mar. 21, 2013;495(7441):384-8.
Haussecker et al., "Capped small RNAs and MOV10 in human hepatitis delta virus replication." Nat Struct Mol Biol. Jul. 2008;15(7):714-21.
Holdt et al., "Circular RNAs as Therapeutic Agents and Targets." Front Physiol. Oct. 9, 2018;9:1262.
Hornung et al., "5'-Triphosphate RNA is the ligand for RIG-I." Science. Nov. 10, 2006;314(5801):994-7.
International Search Report and Written Opinion for PCT/US20/47995. dated Jan. 26, 2021. 9 pages.
International Search Report and Written Opinion for PCT/US2021/039127. dated Dec. 13, 2021. 17 pages.
International Search Report of related PCT/US2017/037702, dated Oct. 27, 2017, 12 pages.
Jang et al., "Initiation of protein synthesis by internal entry of ribosomes into the 5' nontranslated region of encephalomyocarditis virus RNA in vivo." J Virol. Apr. 1989;63(4):1651-60.
Jeck et al., "Circular RNAs are abundant, conserved, and associated with ALU repeats." RNA. Feb. 2013;19(2):141-57.
Jeck et al., "Detecting and characterizing circular RNAs." Nat Biotechnol. May 2014;32(5):453-61.
Jiang et al., "A Quantitative Proteome Map of the Human Body." Cell. Oct. 1, 2020;183(1):269-283.e19.
Jiang et al., "Ubiquitin-induced oligomerization of the RNA sensors RIG-I and MDA5 activates antiviral innate immune response." Immunity. Jun. 29, 2012;36(6):959-73.
Kato et al., "Cell type-specific involvement of RIG-I in antiviral response." Immunity. Jul. 2005;23(1):19-28.
Kato et al., "Length-dependent recognition of double-stranded ribonucleic acids by retinoic acid-inducible gene-1 and melanoma differentiation-associated gene 5." J Exp Med. Jul. 7, 2008;205(7):1601-10.
Kaufman et al., "Improved vectors for stable expression of foreign genes in mammalian cells by use of the untranslated leader sequence from EMC virus." Nucleic Acids Res. Aug. 25, 1991;19(16):4485-90.
Ke et al., "A majority of m6A residues are in the last exons, allowing the potential for 3' UTR regulation." Genes Dev. Oct. 1, 2015;29(19):2037-53.
Kobayashi et al., "Improved dicistronic mRNA expression vectors for efficient selection of transfectants highly expressing foreign genes." Biotechniques. Sep. 1996;21(3):398-402.
Kos et al., "The hepatitis delta (delta) virus possesses a circular RNA." Nature. Oct. 9-15, 1986;323(6088):558-60.
Kramer et al., "Combinatorial control of *Drosophila* circular RNA expression by intronic repeats, hnRNPs, and SR proteins." Genes Dev. Oct. 15, 2015;29(20):2168-82.
Kramps et al., "Messenger RNA-based vaccines: progress, challenges, applications." Wiley Interdiscip Rev RNA. Nov.-Dec. 2013;4(6):737-49.
Krutzfeldt et al., "Silencing of microRNAs in vivo with 'antagomirs'." Nature. Dec. 1, 2005;438(7068):685-9.
Li et al., "Coordinated circRNA Biogenesis and Function with NF90/NF110 in Viral Infection." Mol Cell. Jul. 20, 2017;67(2):214-227.e7.
Liang et al., "Short intronic repeat sequences facilitate circular RNA production." Genes Dev. Oct. 15, 2014;28(20):2233-47.
Liu et al., "Structure and Degradation of Circular RNAs Regulate PKR Activation in Innate Immunity." Cell. May 2, 2019;177(4):865-880.e21.
Martin et al., "Translation of the human angiotensin II type 1 receptor mRNA is mediated by a highly efficient internal ribosome entry site." Mol Cell Endocrinol. Dec. 30, 2003;212(1-2):51-61.
Martineau et al., "Internal ribosome entry site structural motifs conserved among mammalian fibroblast growth factor 1 alternatively spliced mRNAs." Mol Cell Biol. Sep. 2004;24(17):7622-35.
Memczak et al., "Circular RNAs are a large class of animal RNAs with regulatory potency." Nature. Mar. 21, 2013;495(7441):333-8.
Meyer et al., "Comprehensive analysis of mRNA methylation reveals enrichment in 3' UTRs and near stop codons." Cell. Jun. 22, 2012;149(7):1635-46.
Mokrejš et al., "IRESite—a tool for the examination of viral and cellular internal ribosome entry sites." Nucleic Acids Res. Jan. 2010;38(Database issue):D131-6.
Molinie et al., "m(6)A-LAIC-seq reveals the census and complexity of the m(6)A epitranscriptome." Nat Methods. Aug. 2016;13(8):692-8.
Mosser et al., "Use of a dicistronic expression cassette encoding the green fluorescent protein for the screening and selection of cells expressing inducible gene products." Biotechniques. Jan. 1997;22(1):150-161.
Olexiouk et al., "An update on sORFs.org: a repository of small ORFs identified by ribosome profiling." Nucleic Acids Res. Jan. 4, 2018;46(D1):D497-D502.
Pedersen et al., "Human insulin-like growth factor II leader 2 mediates internal initiation of translation." Biochem J. Apr. 1, 2002;363(Pt 1):37-44.
Peisley et al., "RIG-I forms signaling-competent filaments in an ATP-dependent, ubiquitin-independent manner." Mol Cell. Sep. 12, 2013;51(5):573-83.
Peisley et al., "Structural basis for ubiquitin-mediated antiviral signal activation by RIG-I." Nature. May 1, 2014;509(7498):110-4.
Perriman et al., "Circular mRNA can direct translation of extremely long repeating-sequence proteins in vivo." RNA. Sep. 1998;4(9):1047-54.
Petkovic et al., "RNA circularization strategies in vivo and in vitro." Nucleic Acids Res. Feb. 27, 2015;43(4):2454-65.
Pisarev et al., "Ribosomal position and contacts of mRNA in eukaryotic translation initiation complexes." EMBO J. Jun. 4, 2008;27(11):1609-21.
Puttaraju et al., "Generation of nuclease resistant circular RNA decoys for HIV-Tat and HIV-Rev by autocatalytic splicing." Nucleic Acids Symp Ser. 1995;(33):49-51.
Qi et al., "Melting temperature highlights functionally important RNA structure and sequence elements in yeast mRNA coding regions." Nucleic Acids Res. Jun. 2, 2017;45(10):6109-6118.
Ramesh et al., "High-titer bicistronic retroviral vectors employing foot-and-mouth disease virus internal ribosome entry site." Nucleic Acids Res. Jul. 15, 1996;24(14):2697-700.
Rees et al., "Bicistronic vector for the creation of stable mammalian cell lines that predisposes all antibiotic-resistant cells to express recombinant protein." Biotechniques. Jan. 1996;20(1):102-4, 106, 108-10.
Roundtree et al., "Dynamic RNA Modifications in Gene Expression Regulation." Cell. Jun. 15, 2017;169(7):1187-1200.

(56) References Cited

OTHER PUBLICATIONS

Rybak-Wolf et al., "Circular RNAs in the Mammalian Brain are Highly Abundant, Conserved, and Dynamically Expressed." Mol Cell. Jun. 4, 2015;58(5):870-85.
Salzman et al., "Circular RNAs are the predominant transcript isoform from hundreds of human genes in diverse cell types." PLoS One. 2012;7(2):e30733. 12 pages.
Sanger et al., "Viroids are single-stranded covalently closed circular RNA molecules existing as highly base-paired rod-like structures." Proc Natl Acad Sci U S A. Nov. 1976;73(11):3852-6.
Savva et al. "Reprogramming, Circular Reasoning and Self versus Non-self: One-Stop Shopping with RNA Editing." Front Genet. Jun. 7, 2016;7:100., 8 pages.
Schlake et al. "Developing mRNA-vaccine technologies." RNA Biol. Nov. 2012;9(11):1319-30.
Schlee et al., "Recognition of 5' triphosphate by RIG-I helicase requires short blunt double-stranded RNA as contained in panhandle of negative-strand virus." Immunity. Jul. 17, 2009;31(1):25-34.
Sokolova et al., "Chemical reactions within DNA duplexes. Cyanogen bromide as an effective oligodeoxyribonucleotide coupling agent." FEBS Lett. May 9, 1988;232(1):153-5.
Spitale et al., "Structural imprints in vivo decode RNA regulatory mechanisms." Nature. Mar. 26, 2015;519(7544):486-90.
Stein et al., "Translation of vascular endothelial growth factor mRNA by internal ribosome entry: implications for translation under hypoxia." Mol Cell Biol. Jun. 1998;18(6):3112-9.
Tomari et al., "RISC assembly defects in the *Drosophila* RNAi mutant armitage." Cell. Mar. 19, 2004;116(6):831-41.
Vandivier et al., "The Conservation and Function of RNA Secondary Structure in Plants." Annu Rev Plant Biol. Apr. 29, 2016;67:463-88.
Wang et al., "N6-methyladenosine-dependent regulation of messenger RNA stability." Nature. Jan. 2, 2014;505(7481):117-20.
Warren et al., "Highly efficient reprogramming to pluripotency and directed differentiation of human cells with synthetic modified mRNA." Cell Stem Cell. Nov. 5, 2010;7(5):618-30.
Weingarten-Gabbay et al., "Comparative genetics. Systematic discovery of cap-independent translation sequences in human and viral genomes." Science. Jan. 15, 2016;351(6270):aad4939. 15 pages.
Wesselhoeft et al., "Engineering circular RNA for potent and stable translation in eukaryotic cells." Nat Commun. Jul. 6, 2018;9(1):2629. 10 pages.
Wesselhoeft et al., "RNA Circularization Diminishes Immunogenicity and Can Extend Translation Duration In Vivo." Mol Cell. May 2, 2019;74(3):508-520.e4.
Wu et al., "How RIG-I like receptors activate MAVS." Curr Opin Virol. Jun. 2015;12:91-8.
Xia et al., "CSCD: a database for cancer-specific circular RNAs." Nucleic Acids Res. Jan. 4, 2018;46(D1):D925-D929.
Yang et al., "Extensive translation of circular RNAs driven by N6-methyladenosine." Cell Res. May 2017;27(5):626-641.
Yao et al., "ZKSCAN1 gene and its related circular RNA (circZKSCAN1) both inhibit hepatocellular carcinoma cell growth, migration, and invasion but through different signaling pathways." Mol Oncol. Apr. 2017;11(4):422-437.
Ying et al., "Cancer therapy using a self-replicating RNA vaccine." Nat Med. Jul. 1999;5(7):823-7.
Zarnegar et al., "irCLIP platform for efficient characterization of protein-RNA interactions." Nat Methods. Jun. 2016;13(6):489-92.
Zeng et al., "Reconstitution of the RIG-I pathway reveals a signaling role of unanchored polyubiquitin chains in innate immunity." Cell. Apr. 16, 2010;141(2):315-30.
Zhou et al., "Genome-Wide Maps of m6A circRNAs Identify Widespread and Cell-Type-Specific Methylation Patterns that are Distinct from mRNAs." Cell Rep. Aug. 29, 2017;20(9):2262-2276.

captured eGFP(-) oligos with
eGFP below the 20th percentile
(n=1,010)

captured eGFP(+) oligos with
eGFP above the 80th percentile
(n=2,074)

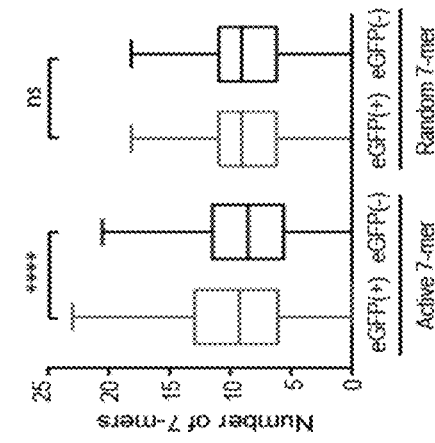
FIGURE 3A
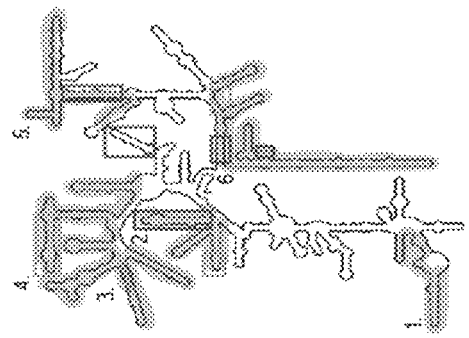
FIGURE 3B
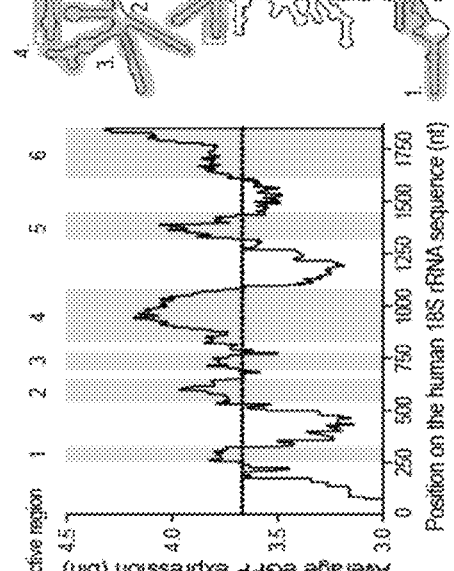
FIGURE 3C
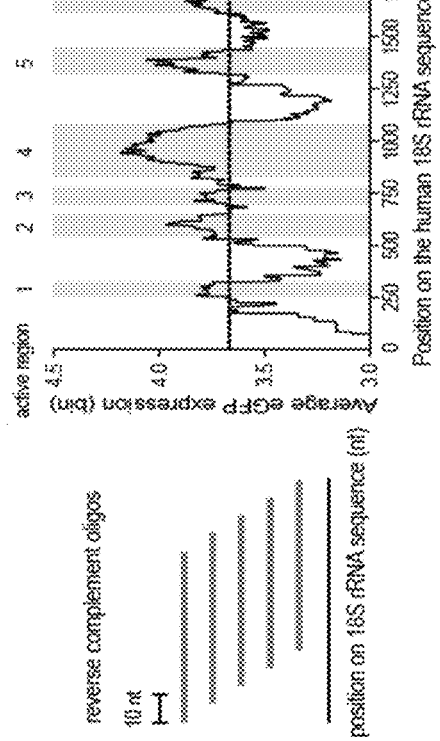
FIGURE 3D
FIGURE 3E
FIGURE 3F
FIGURE 3G
FIGURE 3H
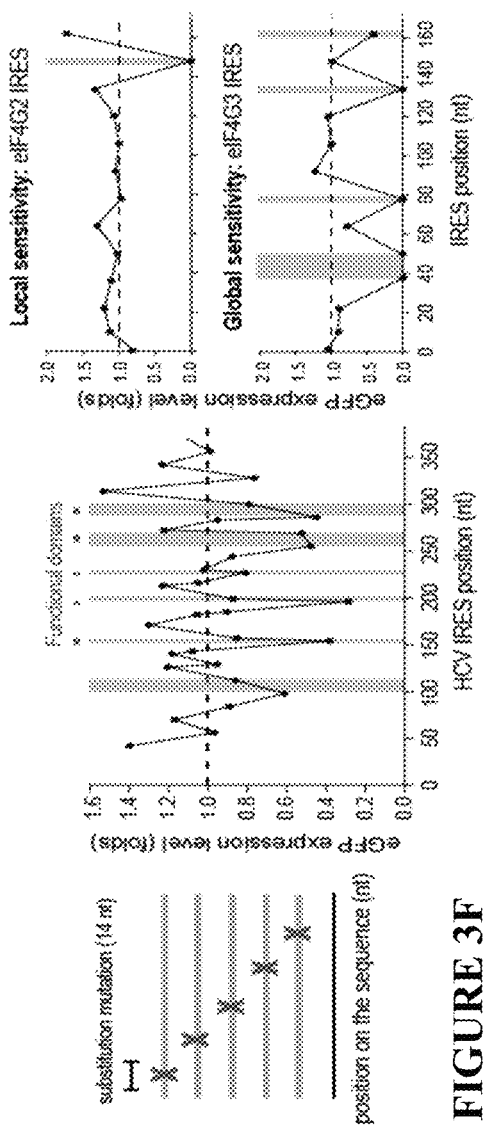

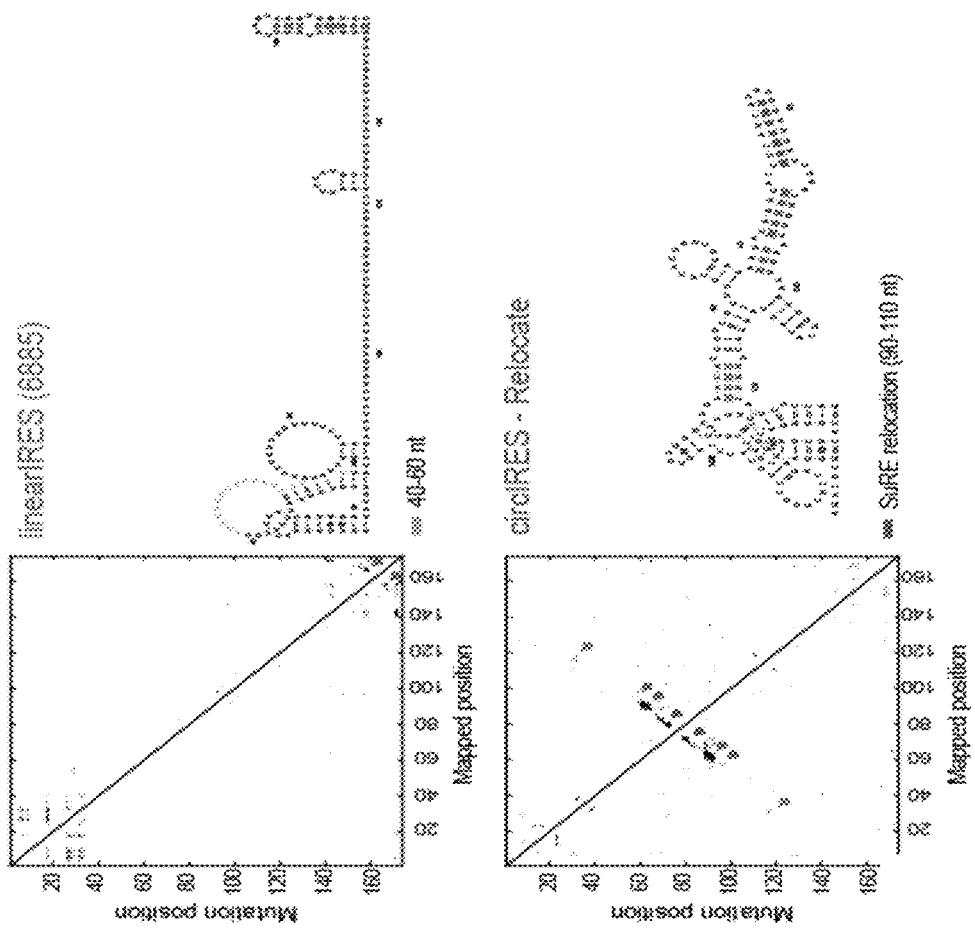
FIGURE 4B
FIGURE 4A
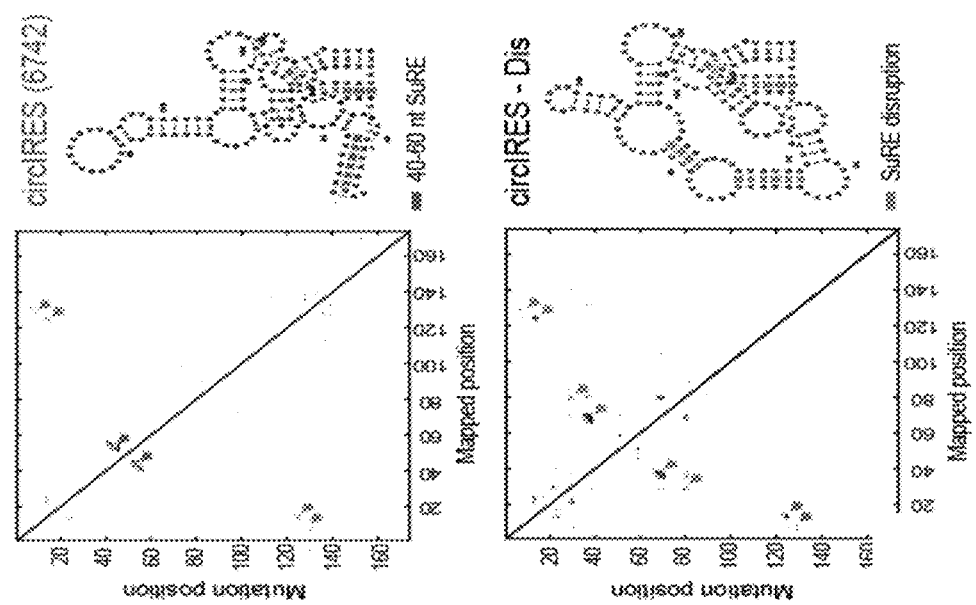
FIGURE 4D
FIGURE 4C

FIGURE 6D
FIGURE 6E
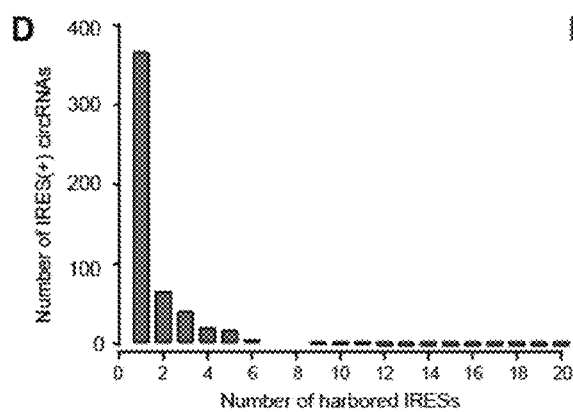
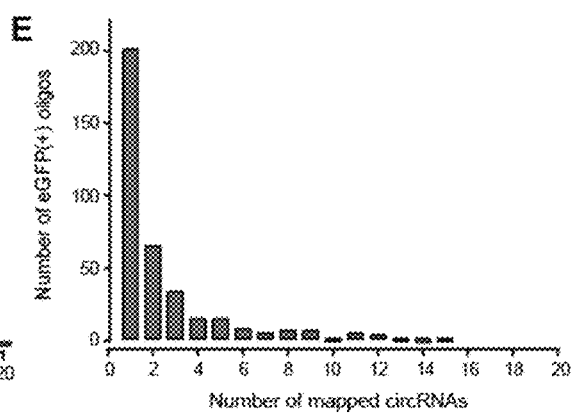
FIGURE 6F
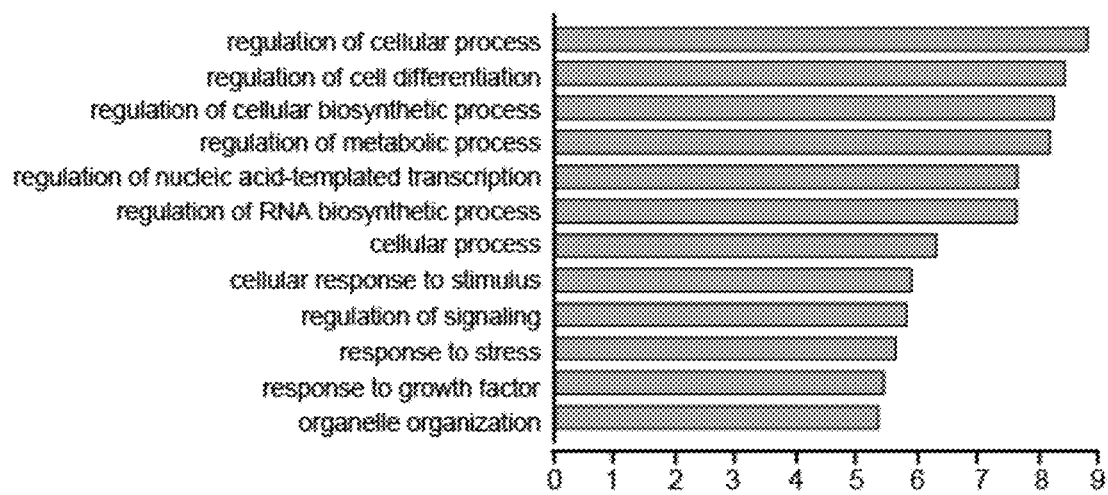

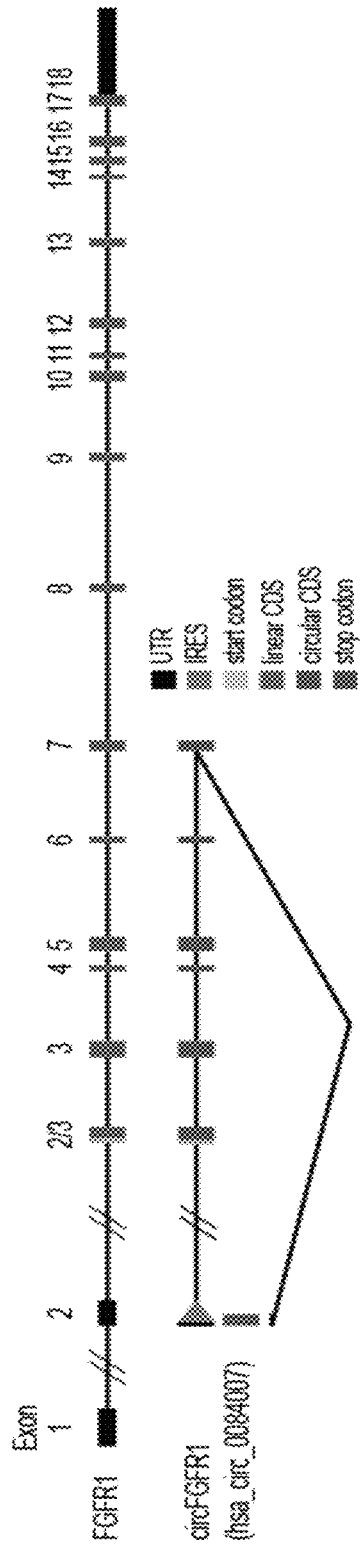
FIGURE 7A
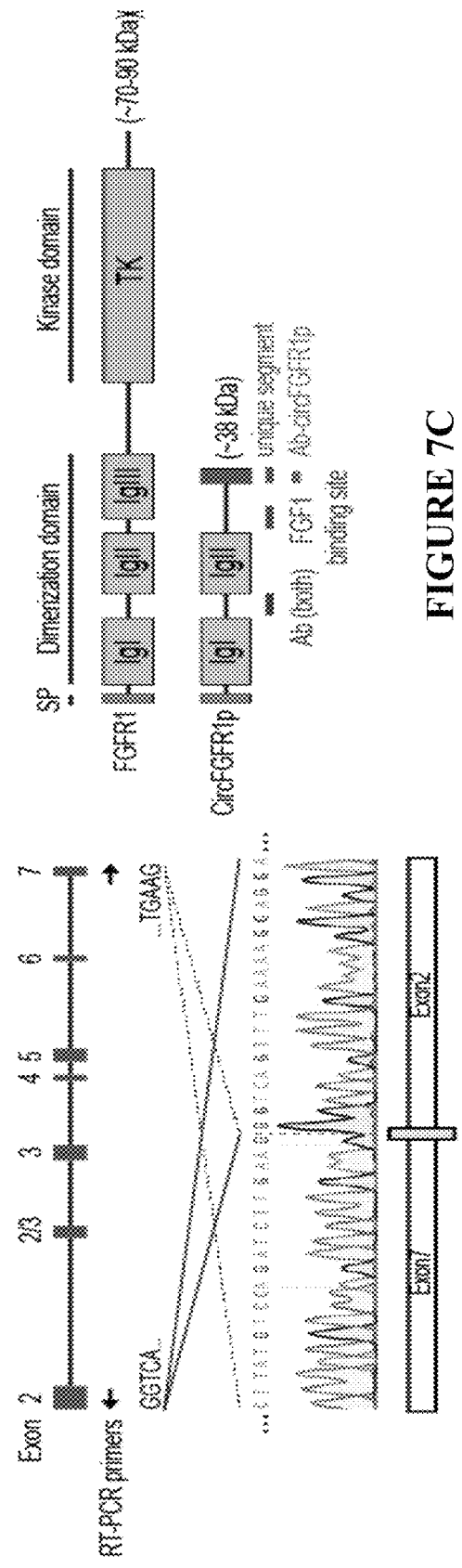
FIGURE 7B
FIGURE 7C

FIGURE 16E
FIGURE 16F
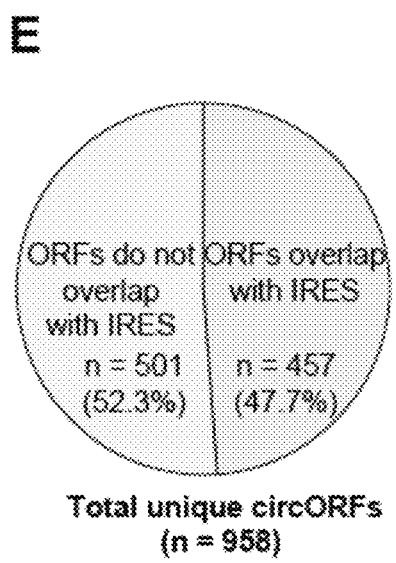
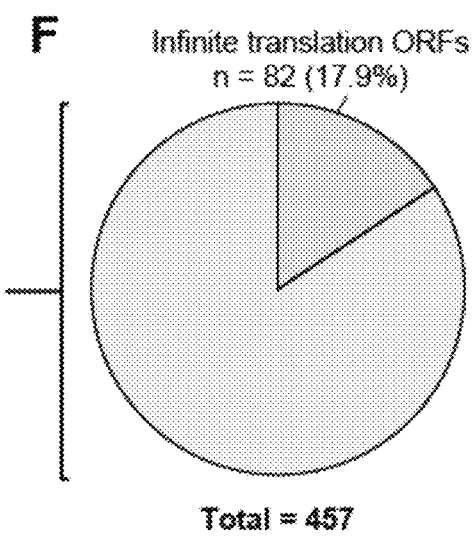

GENETIC ELEMENTS DRIVING CIRCULAR RNA TRANSLATION AND METHODS OF USE

CROSS-REFERENCE TO RELATED APPLICATIONS

This application is a divisional of U.S. application Ser. No. 17/696,606, filed Mar. 16, 2022, which is a continuation of International Application No. PCT/US2021/039127, filed Jun. 25, 2021, which claims priority to U.S. Provisional Application No. 63/186,507, filed May 10, 2021, and U.S. Provisional Application No. 63/043,964, filed Jun. 25, 2020, the contents of which are herein incorporated by reference in their entireties.

STATEMENT REGARDING FEDERALLY-SPONSORED RESEARCH

This invention was made with Government support under contract CA209919 awarded by the National Institutes of Health. The Government has certain rights in the invention.

SEQUENCE LISTING

The text of the computer readable sequence listing filed herewith, titled "STDU2-38293-404_SQL", created Dec. 14, 2022, having a file size of 34,189,873 bytes, is hereby incorporated by reference in its entirety.

FIELD

The present invention relates to recombinant circular RNA (circRNA) molecules comprising internal ribosome entry sites (IRESs) that contain an RNA secondary structure element and a nucleic acid sequence region complementary to 18S rRNA, as well as methods of use thereof.

BACKGROUND

Over the past decade, results from deep sequencing and computational analysis have suggested that circular RNAs (circRNAs) are a large class of RNAs in mammalian cells that play important roles in various biological processes. Disruption of circRNA expression has been found to be associated with human diseases, such as Alzheimer's disease, diabetes, and cancers. Furthermore, the exceptional stability and cell-specific expression patterns of circRNAs have led to the use of circRNAs as biomarkers for diseases such as cancers, and as indicators of the efficacy of certain treatments. While most of the studies demonstrate that circRNAs function as non-coding RNAs, such as sponges for miRNAs, regulators of mRNA splicing machinery, sequestration of RNA-binding proteins (RBPs), regulators of RBP interaction, and activators of immune responses, emerging evidence suggests that some circRNAs encode peptides and/or proteins and thereby function through these encoded polypeptides. Proteins known to be translated from circRNAs regulate cell proliferation, differentiation, migration, and myogenesis. Dysregulation of circRNA-encoded proteins has been associated with tumorigenesis in certain cancers. Accordingly, circRNA-encoded proteins may be an important link between the class of biologically relevant circRNA and cancer, and perhaps other diseases. Understanding the mechanism of circRNA translation, therefore, may aid in the development of therapeutic methods and/or modalities which exploit circRNA biology and their encoded proteins.

Because circRNA is generated by spliceosome-mediated head-to-tail joining of pre-mRNAs, it does not contain the 5'cap that is commonly known to be required for cap-dependent translation. Thus, circRNA translation utilizes alternate mechanisms to initiate cap-independent translation, such as the use of an internal ribosome entry site (IRES) sequence that is recognized by ribosomes. Introduction of an IRES on synthetically generated circRNAs is sufficient to initiate translation of encoded circRNA proteins, thereby suggesting that endogenous circRNAs harboring IRES sequence may have translation potential as they are exported to the cytoplasm.

Given the rapidly advancing yet nascent state of the art, there remains a need for the identification and characterization of the genetic elements, beyond the presence of an IRES, that can facilitate, initiate, direct or regulate circRNA translation. In particular, there is a need to identify novel IRES sequences that can operably facilitate expression of proteins encoded by circRNAs.

BRIEF SUMMARY OF THE INVENTION

The disclosure provides polynucleotides (e.g., DNA sequences) that encode one or more circular RNA (circRNA) molecules; wherein the circular RNA molecule comprises a payload sequence region (e.g., protein coding or non-coding sequence region) and an internal ribosome entry site (IRES) sequence region operably linked to the payload sequence region. In some embodiments, the IRES comprises: at least one sequence region having an RNA secondary structure element; and a sequence region that is complementary to an 18S ribosomal RNA (rRNA). In some embodiments, the IRES has a minimum free energy (MFE) of less than −18.9 kJ/mol and a melting temperature of at least 35.0° C. Some embodiments of the disclosure include those wherein the RNA secondary structure sequence region or element is formed from the nucleotides at about position 40 to about position 60 of the IRES, wherein the first nucleotide at the 5' end of the IRES is considered to be position 1.

The disclosure also provides polynucleotides (e.g., a DNA sequence) encoding a circular RNA molecule; wherein the circular RNA molecule comprises a protein-coding nucleic acid sequence and an internal ribosome entry site (IRES), wherein the IRES is encoded by any one of the nucleic acid sequences of SEQ ID NO: 1-228 or SEQ ID NO: 229-17201, or a nucleic acid sequence having at least 90% or at least 95% identity or homology thereto over at least 50% of the length of the nucleic acid sequence.

The disclosure also provides recombinant circular RNA molecules comprising a protein-coding nucleic acid sequence region and an internal ribosome entry site (IRES) sequence region operably linked to the protein-coding nucleic acid sequence region, wherein the IRES comprises: at least one sequence region having secondary structure element; and a sequence region that is complementary to an 18S ribosomal RNA (rRNA); wherein the IRES has a minimum free energy (MFE) of less than −18.9 kJ/mol and a melting temperature of at least 35.0° C. In some embodiments, the protein-coding nucleic acid sequence region is operably linked to the IRES in a non-native configuration.

The disclosure also provides recombinant circular RNA molecules comprising a protein-coding nucleic acid sequence region and an internal ribosome entry site (IRES)

sequence region operably linked to the protein-coding nucleic acid sequence; wherein the IRES is encoded by any one of the nucleic acid sequences listed in of SEQ ID NO: 1-228 or SEQ ID NO: 229-17201, or a nucleic acid sequence having at least 90% or at least 95% homology or identity thereto. In some embodiments, the protein-coding nucleic acid sequence region is operably linked to the IRES in a non-native configuration.

Also provided are methods of producing a protein in a cell using the aforementioned recombinant circular RNA molecules, or polynucleotides (e.g., DNA molecules) encoding the same.

Also provided are as vectors comprising the aforementioned recombinant circular RNA molecules, or DNA molecules encoding the same.

Also provided are host cells comprising the aforementioned recombinant circular RNA molecules, or DNA molecules encoding the same.

Also provided are compositions comprising (i) a DNA sequence encoding a circular RNA, and (ii) a non-coding circular RNA or a DNA sequence encoding the same.

Also provided are methods for delivering a non-coding circular RNA to a cell, the methods comprising contacting the cell with a composition comprising a DNA sequence encoding a circular RNA, and (ii) a non-coding circular RNA or a DNA sequence encoding the same, thereby delivering the non-coding circular RNA to the cell.

The disclosure further provides an oligonucleotide comprising a nucleic acid sequence region that hybridizes to an internal ribosome entry site (IRES) sequence region present on a circular RNA molecule and upon hybridization inhibits translation of the coding sequence region of the circular RNA molecule. Also provided is a method of inhibiting translation of a protein-coding nucleic acid sequence region (e.g., payload) of a circular RNA molecule using the aforementioned oligonucleotide.

These and other embodiments will be explained in further detail below, and in the appended drawings.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 1A provides a schematic overview of the high-throughput split-eGFP circRNA reporter screening assay for identifying circRNA IRES. A synthetic oligo library containing 55,000 oligos was cloned into a split-eGFP circRNA reporter. Since the full-length eGFP will only be reconstituted when back-spliced into the circRNA, the eGFP fluorescence signal can only come from the cap-independent translation activity driven by the inserted oligos on the circRNA. The eGFP(+) cells were sorted into seven expression bins by their eGFP fluorescence intensity with FACS. The number of reads for each synthetic oligo within each bin was determined by next-generation DNA sequencing. The final eGFP expression for each synthetic oligo was quantified by the mean weighted bin number according to the distribution of the number of reads across seven expression bins from two independent biological replicates. Shown in FIG. 1B is the eGFP expression distribution of 40,855 captured synthetic oligos. eGFP(+) oligos were defined as the oligos with eGFP expression higher than the background eGFP threshold (the eGFP expression of no-oligo-inserted eGFP circRNA reporter). The pie chart represents the composition of different oligo categories among eGFP(+) oligos. Shown in FIG. 1C is quantification of the percentage of captured eGFP(+) oligos among the oligos originated from the sequences of the reported IRES, viral 5' UTR, or human 5' UTR in the screening assay. Shown in FIG. 1D is identification of circular and linear RNA specific IRESs. Normalized eGFP expression (log 10) is shown for each captured oligo in the screening assay performed on the circular RNA (described herein) or the linear RNA (Weingarten-Gabbay et al., 2016)) screening system utilizing the same synthetic oligo library. Circular IRESs (green circles) or linear IRESs (blue circles) were identified by comparing the IRES activity of the oligos that were detected only in either circular or linear RNA screening system, respectively. Red dashed lines represent the normalized eGFP expression threshold.

FIG. 2A shows a schematic overview of the circRNA polysome profiling method for capturing translated circRNAs. FIG. 2B shows (poly)ribosome fractionations of cells transfected with split-eGFP circRNA reporter containing the synthetic oligo library followed by cycloheximide (CHX) treatment. Fractions 7 to 12 (shaded in blue) were determined as (poly)ribosome fractions according to the Abs254 pattern. Shown in FIG. 2C is quantification of the percentage of (poly)ribosome-enriched oligos among the captured eGFP (−) oligos with eGFP expression below the 20th percentile or the eGFP(+) oligos with eGFP expression above the 80th percentile, respectively. FIG. 2D provides sequencing reads from Ribo-seq and QTI-seq plotted on the genes showing eGFP(+) oligos harboring aTIS (top), nTIS (middle), and dTIS (bottom) with overlapped annotated circRNAs (brown segments). FIG. 2E shows quantification of the percentage of eGFP(−) or eGFP(+) oligos harboring no TIS (TIS(−)) (left) or more than one TIS (TIS(+)) (right), and the percentage of aTIS, nTIS, or dTIS oligos among eGFP(+)/TIS (+) oligos.

FIG. 3A-3J shows that the 18S rRNA complementary sequence on the IRES facilitates circRNA cap-independent translation activity. Provided in FIG. 3A is a schematic of the sliding-window design of synthetic oligos for mapping the active regions on the human 18S rRNA. FIG. 3B shows quantification of the mean eGFP expression of the synthetic oligos overlapped with the corresponding position across the human 18S rRNA. The dashed line indicates the background eGFP expression. The identified active regions on the 18S rRNA are shaded in green. FIG. 3C provides an illustration of the secondary structure of human 18S rRNA showing the identified active regions and reported RNA contact regions on the 18S rRNA. The identified active regions 1 to 6 are shaded in green. Boxes outlined the regions on the 18S rRNA that have been reported to contact with mRNA (red) or IRES RNA (orange). FIG. 3D shows quantification of the number of the 18S rRNA active 7-mers or the random 7-mers harbored by eGFP(+) or eGFP(−) oligos plotted on a Tukey box-plot (outliers not shown). Ns: not significant; ****: p-value<0.001 by an unpaired two-sample t-test. Shown in FIG. 3E is quantification of the IRES activity for the oligo with higher or lower 18S rRNA complementarity determined by FACS (MFIeGFP/ mRuby). *: p-value<0.05 relative to the wild-type (WT) oligo by an unpaired two-sample t-test (n=4-6 independent replicates). Error bar: SEM. FIG. 3F provides a schematic of the design of synthetic oligos for systematic scanning mutagenesis. FIG. 3G shows the eGFP expression of each oligo containing the random substitution mutation at the corresponding position on the HCV IRES. The black dot represents the start position of each mutation on the IRES. The identified essential elements are shaded in blue. The red lines represented the functional domains on the HCV IRES that have been reported. The eGFP expression for each oligo was normalized to the mean eGFP expression of all the oligos on the HCV IRES. In FIG. 3H, examples are provided of circRNA IRES with local and global sensitivity identified by scanning mutagenesis. The identified essential elements on the IRES are shaded in blue. In FIG. 3I, the mean eGFP expression of all the circRNA IRES oligos with global sensitivity is shown at each mutation position across the IRES. The regions harboring regulatory elements were shaded in different 10 colors (blue: 5-15 nt and 135-165 nt; red: 40-60 nt). Shown in FIG. 3J is quantification of the local MFE in a 15 nucleotide (nt) sliding window on the IRES. The regions harboring regulatory elements were shaded in different colors (blue: 5-15 nt and 135-165 nt; red: 40-60 nt).

FIG. 4A-4K shows that a distinct SuRE at 40-60 nucleotide (nt) position on the IRES can facilitate circular IRES activity. FIG. 4A-4H show the secondary structure of the mutated IRESs (SEQ ID NOs: 33925-33932) determined by M2-seq. The arrowheads indicate the high-confidence secondary structure identified by M2-net; the corresponding positions are labeled with the same color on the RNA structure panel. Red arrowheads indicate the SuRE at the 40-60 nt position on the circular IRES. CircIRES-dis: circular IRES with the SuRE disrupted by sequence substitution. CircIRES-relocate: Circular IRES with the SuRE relocated to 90-110 nt region. CircIRES-single and circIRES-comp: circular IRES with single complementary mutations and compensatory double complementary mutations, respectively. circIRES-BoxB: circular IRES with the SuRE substituted by BoxB stem-loop. linearIRES-add: linear IRES with 40-60 nt region substituted by the SuRE at the 40-60 nt position on the circular IRES. Shown in FIG. 4I is quantification of the IRES activity for each mutated IRES determined by FACS (MFIeGFP/mRuby). The activity of each permuted IRES was normalized to the linear IRES. Ns: not significant; : p-value<0.01, **: p-value<0.001 relative to the linear IRES by an unpaired two-sample t-test (n=4-6 independent replicates). Error bar: SEM. Shown in FIG. 4J is quantification of the percentage of the eGFP(+) oligos (left) and endogenous translated circRNAs (right) harboring 18S rRNA complementarity or the SuRE element. FIG. 4K provides an illustration of two key regulatory elements, complementary 18S rRNA sequence and the SuRE at 40-60 nt position on the IRES, facilitating circRNA cap-independent translation.

FIG. 5A shows a schematic of disrupting the key regulatory elements on the IRES of the oligo-split-eGFP-circRNA reporter by co-transfecting the anti-sense LNAs targeting specific regions on the IRES. LNA-18S: the LNA targeting the 18S rRNA complementary sequence on the IRES; LNA-SuRE: the LNA targeting the SuRE at the 40-60 nt position on the IRES; LNA-Rnd: the LNA targeting the random position downstream of LNA-18S or LNA-SuRE on the IRES. Shown in FIG. 5B is quantification of the normalized eGFP fluorescence signal intensity of the cells co-transfected with the corresponding LNA and the oligo-split-eGFP-circRNA reporter carrying the corresponding IRES. The number represents the index number of the oligo. Ns: not significant; *: p-value<0.05; : p-value<0.01, *: p-value<0.005 relative to the mock transfection by an unpaired two-sample t-test (n=3-5 independent replicates). Error bar: SEM. Provided in FIG. 5C is a schematic of QTI-qRT-PCR quantification of the level of translation-initiating endogenous circRNAs. FIG. 5D shows quantification of the translation-initiating RNA level of the human endogenous circRNAs containing the corresponding IRES upon disrupting the IRES by the corresponding LNA transfection. The circRNA level was normalized to the GAPDH mRNA. Ns: not significant; *: p-value<0.05; : p-value<0.01, *: p-value<0.005 relative to the mock transfection by an unpaired two-sample t-test (n=4-6 independent replicates). Error bar: SEM. Shown in FIG. 5E are images of western blots showing the level of protein produced from the endogenous circRNAs upon IRES disruption by the transfection of the corresponding LNA.

FIG. 6A-6L demonstrate the identification of putative endogenous circRNA-encoded proteins. FIG. 6A shows quantification of the percentage of IRES-mapped human endogenous circRNAs harboring one or more eGFP(+) oligo sequences (IRES(+) circRNA), or no eGFP(+) oligo sequences (IRES(−) circRNA). FIG. 6B shows quantification of the distribution of the parent genes among IRES(+) circRNAs. Each part of the pie chart represents a different gene. FIG. 6C shows quantification of the percentage of potential cancer-associated IRES(+) circRNAs from the CSCD. Provided in FIG. 6D is a histogram showing the distribution of the number of IRES harbored by each individual IRES(+) circRNA (capped at n=20). FIG. 6E is a histogram showing the distribution of the number of mapped circRNA for each individual eGFP(+) oligo (capped at n=20). FIG. 6F shows the top 12 represented biological processes from GO term analysis that are enriched in the parent genes of IRES(+) circRNAs. Provided in FIG. 6G is a schematic of generating the putative endogenous circORF list. FIG. 6H shows the top 15 represented conserved motifs from Pfam analysis that are enriched in the predicted circRNA-encoded polypeptides. FIG. 6I shows a schematic of peptidomic validation of the putative circORFs. Provided in FIG. 6J is a heat map showing the number of unique tryptic polypeptides detected in the peptidomic dataset of each MS captured circORF. Shown in FIG. 6K are the MS1 and MS2 spectra of a representative tryptic BSJ polypeptide (SEQ ID NO: 33933) captured from circORF_575. FIG. 6L shows the representative MS2 spectra and the top 3 rank PRM-MS transition ions spectra of the spike-in heavy isotope labeled polypeptide (top right (SEQ ID NO: 33934)) and the sample tryptic polypeptide (bottom right (SEQ ID NO: 33934)) from circORF_19. [V]: heavy isotope labeled valine (13C5, 15N; +6 Da).

FIG. 7A-7L show that circRNA-encoded circFGFR1p suppresses cell proliferation under stress conditions. FIG. 7A provides is a schematic of the CDS of FGFR1 and circFGFR1 transcript. Shown in FIG. 7B is a schematic of the design of junctional RT-PCR primers (black arrows) and the Sanger sequencing results detecting the back-splicing junction (yellow box) of circFGFR1 (SEQ ID NO: 33935). FIG. 7C provides is a schematic of the conserved motifs on FGFR1 and circFGFR1p. Ab (both): the antibody which can detect both FGFR1 and circFGFR1p. Ab-circFGFR1p: custom circFGFR1p antibody. The blue lines indicate the location of the antigen peptide for each antibody. FIG. 7D shows a schematic of the polypeptides captured by IP-LC-MS.MS (underline) that matched the circFGFR1p unique region (red) and the region overlapped with FGFR1 (black) using a custom antibody against the unique region of the circFGFR1p (in bold) (circFGFR1p (SEQ ID NO: 33902); circFGFR1p fragment (SEQ ID NO: 33936)). The extracted region (~30-45 kDa) on the coomassie blue stained SDS- PAGE gel is outlined in red box. Shown in FIG. 7E are the representative MS2 spectra and the top 3 rank PRM-MS transition ions spectra of the spike-in heavy isotope labeled polypeptide (top (SEQ ID NO: 33937)) and the BJ tryptic polypeptide (bottom (SEQ ID NO: 33937)) of circFGFR1p. [L]: heavy isotope labeled leucine (13C6, 15N; +7 Da). FIG. 7F provides are images of FGFR1 (red), circFGFR1p (green) and DAPI (blue) in HEK-293T cells co-transfected with plasmids expressing HA-FGFR1 and FLAG-circFGFR1p without permeabilization. Scale bars: 10 micrometers. Shown in FIG. 7G are western blots showing circFGFR1p and FGFR1 protein level (Ab-both), and the quantification of FGFR1 and circFGFR1 RNA level by qRT-PCR of cells transfected with siRNA or LNA. siCtrl: non-targeting siRNAs; siCircFGFR1: circFGFR1 specific siRNAs; circFGFR1-LNA: anti-sense LNA oligo targeting the 18S rRNA complementary sequence on the circFGFR1 IRES. P-FGFR1: phosphorylated FGFR1. Ns: not significant; **p-value<0.01 relative to the siCtrl by an unpaired two-sample t-test (n=3 independent replicates). Error bar: SEM. (FIG. 7H) Shown is quantification of cell proliferation in cells with the knockdown of circFGFR1 RNA (si-CircFGFR1) or circFGFR1p (circFGFR1-LNA) from day 1 to 4 with FGF1 addition. *p-value<0.05; p-value<0.01; *p-value<0.005 relative to the siCtrl by an unpaired two-sample t-test (n=3-5 independent replicates). Error bar: SEM. Provided in FIG. 7I are images of a western blot showing the cells with FGFR1, circFGFR1p, or FGFR1+circFGFR1p overexpression (left panel) and their corresponding cell proliferation from day 1 to 4 with FGF1 addition (right panel). Ns: not significant; *p-value<0.05, p-value<0.01, **p-value<0.001 relative to the mock transfection by an unpaired two-sample t-test (n=4-6 independent replicates). Error bar: SEM.

FIG. 7J provides images of western blots showing FGFR1 protein and circFGFR1p level with or without the heat-shock. FIG. 7K shows quantification of the Western blot of circFGFR1p protein level relative to FGFR1 (all isoforms) under normal (WT) and the heat-shock (HS) condition. Error bar: SEM from three independent blots. *p-value<0.05 relative to the WT by an unpaired two-sample t-test (n=3 independent blots). Shown in FIG. 7L is quantification of the Western blot showing the change of the protein level of FGFR1 and circFGFR1p under the heat-shock condition. Protein level is normalized to the GAPDH protein loading control of each condition. Error bar: SEM from three independent blots. Ns: not significant; *p-value<0.05 relative to 1 by a one-sample t-test (n=3 independent blots).

FIG. 8A shows images of northern blots of IRES-split-eGFP circRNA reporter transfected and mRuby (+)/eGFP(+) sorted cells using probes against the mRuby, 3'eGFP, and the eGFP back-splicing junction region on the reporter transcript with or without RNase R treatment. Shown in FIG. 8B is quantification of the RNA level of the eGFP circRNA or the mRuby linear transcript in the IRES-split-eGFP circRNA reporter transfected and mRuby(+)/eGFP(+) sorted cell total RNA with RNase R treatment relative to the RNaseR (−) samples. The level of RNA was normalized to the GAPDH mRNA level in each sample. Error bar: SEM. Ns: not significant; ****: p-value<0.001 relative to the RNase R(−) sample by an unpaired two-sample t-test (n=3 independent replicates). Error bar: SEM. FIG. 8C illustrates flow cytometry analysis of eGFP(+) cells upon transfected with corresponding reporter constructs. eGFP(+) cells were gated according to the cells with mock transfection.

FIG. 9A provides a reproducibility measurement of the eGFP expression for each captured oligo of two independent biological replicates from the screening assay. Only the oligos recovered in both replicates were included in the analysis. The R represents the Pearson's correlation coefficient. Provided in FIG. 9B is a schematic of the primers design to quantify the expression level of linear and circular transcripts of the reporter construct. The divergent circular primers spanning the back-splicing junction of circRNA should detect circular transcripts only. FIG. 9C shows quantification of circularization efficiency by qRT-PCR of seven randomly picked clones transfected oligo-split-eGFP reporter plasmid. The circularization efficiency was calculated by normalizing the expression level of the circular transcripts to the expression level of the linear transcripts. The number indicates the index of the oligo. No-IRES: no-IRES-inserted reporter plasmid. Ns: not significant relative to the empty circRNA by an unpaired two-sample t-test (n=3 independent replicates). Error bar: SEM. FIG. 9D illustrates the distribution of the fraction of reads across all 7 bins of cells transfected with IRES-split-eGFP circRNA reporter carrying no-IRES (background eGFP expression), or the oligo showing high (oligo #25674), moderate (oligo #26338) or no (oligo #26961) cap-independent translation activity. The black line represents the polynomial trend line of the distribution. FIG. 9E provides images of western blots showing the expression level of eGFP, Cre, and CD4 from the split-eGFP circRNA reporter containing no-IRES or the corresponding IRES. The number indicates the index of the oligo. Provided in FIG. 9F are images of a western blot showing eGFP expression level of the cap-dependent translated linear RNA (CMV promoter driven) and the cap-independent translated circRNA (IRES driven; oligo #8788).

FIG. 11A provides a Venn diagram representing the number of circular and linear specific IRES by comparing the results from the study (circular RNA system) with the results from the study described in Weingarten-Gabbay et al., Science 351, aad4939 (2016) (linear RNA system). Shown in FIG. 11B-11C is the composition of the captured viral and human IRES in the circular IRES (FIG. 11B), the linear IRES (FIG. 11C), and the IRES showing cap-independent translation activity in both the linear and circular RNA system (Both) (FIG. 11D).

FIG. 12A shows 40S and (poly)ribosome fractions of cells transfected with split-eGFP reporter containing the synthetic oligo library and treated with puromycin (PMY; left panel) or cycloheximide (CHX; right panel) followed by sucrose gradient fractionation. FIG. 12B shows quantification of the ratio of the eGFP circRNA level relative to the mRuby linear transcript level of the IRES-split-eGFP circRNA reporter transfected and mRuby(+)/eGFP(+) sorted cell total RNA with RNase R treatment in a time-course manner (20 U RNase R per 20 μg of RNA). Error bar: SEM. Shown in FIG. 12C is quantification of the fraction of the number of total reads of the captured oligos in 40S and (poly)ribosome fraction with PMY or CHX treatment. FIG. 12D provides the number of captured eGFP(−) and eGFP(+) oligos before and after the RNase R treatment. FIG. 12E shows the normalized number of reads of total captured oligos with RNase R treatment and captured oligos in the poly(ribosome) fraction.

FIG. 13C shows the percentage of the number of active 7-mers on each position on the oligo among all eGFP(+) oligos. FIG. 13D shows the cumulative frequency distribution of number of the RRACH motif on the eGFP(+) and eGFP(−) oligos. Ns: not significant by Kolmogorov-Smirnov cumulative distribution test.

FIG. 14B shows cumulative frequency distribution of number of canonical translation start codon (ATG) on the circular and linear IRESs. Ns: not significant by Kolmogorov-Smirnov cumulative distribution test. Shown in FIG. 14C is cumulative frequency distribution of number of m6A motif (RRACH, SEQ ID NO: 3394) on the circular and linear IRESs. Ns: not significant by Kolmogorov-Smirnov cumulative distribution test. Shown in FIG. 14D is quantification of number of Kozak sequence (ACCATGG, SEQ ID NO: 33945) on the circular and linear IRESs. Ns: not significant by an unpaired two sample t-test. Error bar: SEM. FIG. 14E shows quantification of the IRES activity of the oligo in the circular RNA reporter (left) and linear RNA reporter (right), respectively. The IRES activity was determined with FACS by normalizing the eGFP medium fluorescence intensity driven by the oligo (MFIeGFP) to the linear RNA expression level of the reporter construct determined by the mRuby medium fluorescence intensity (MFImRuby). The value was further normalized to the oligo-6472. Ns: not significant, *: p-value<0.05, *: p-value<0.005, **: p-value<0.001 relative to oligo-6742 by an unpaired two-sample t-test (n=4-6 independent replicates). Error bar: SEM. FIG. 14F-14G show the secondary structure of example circular IRESs (SEQ ID NOs: 33938-33940) and linear IRESs (SEQ ID NOs: 33941-33943) (three IRESs for each) determined by M2-seq. The arrowheads indicate the high confident secondary structure identified by M2-net; the corresponding positions are labeled with the same color on the RNA structure panel. Red arrowheads indicate the SuRE at the 40-60 nt position on the circular IRESs.

FIG. 15A shows quantification of the eGFP circRNA level relative to the mRuby linear transcript level of the cells co-transfected with the corresponding LNA and the oligo-split-eGFP-circRNA reporter carrying the corresponding IRES. Ns: not significant; *: p-value<0.05 relative to the mock transfection by an unpaired two-sample t-test (n=4-6 independent replicates). Error bar: SEM. Shown in FIG. 15B is quantification of the human endogenous circRNA level harboring the corresponding IRES upon disrupting the IRES by the corresponding LNA transfection. The circRNA level was normalized to the GAPDH mRNA. Ns: not significant relative to the mock transfection by an unpaired two-sample t-test (n=4-6 independent replicates). Error bar: SEM.

FIG. 16A-16L show identification of putative endogenous circRNA-encoded polypeptides. FIG. 16A shows quantification of the percentage of all endogenous human circRNAs harboring no oligo sequences, no eGFP(+) oligo sequences, or one or more eGFP(+) oligo sequences. Provided in FIG. 16B is a histogram showing the distribution of the number of IRESs harbored by each individual IRES(+) circRNA (capped at n=20) among the circRNAs generated from the 159 transcripts for which oligos were designed tiling across the entire transcripts. Provided in FIG. 16C is a histogram showing the distribution of the number of mapped circRNAs for each individual eGFP(+) oligo (capped at n=20) among the circRNAs generated from the 159 transcripts for which oligos were designed tiling across the entire transcripts. Shown in FIG. 16D is the distribution of the distance from the back-splicing junction to the mapped IRES on each circRNA (capped at nt=2000). The distance is calculated from the back-splicing junction to the first mapped nucleotide of the IRES. GC matched oligo: the RNA sequence on the circRNA with the same length and GC-content as the mapped IRES. The distance of GC matched oligo was determined on each IRES-mapped circRNA by taking the average distance from the back-splicing junction to all the GC matched oligos on the circRNA. FIG. 16E illustrates quantification of the percentage of circRNA-encoded polypeptide with the ORF overlapping the IRES region on the circRNA. Shown in FIG. 16F is quantification of the percentage of circRNA-encoded polypeptide with infinite recursive ORF on circRNA among IRES-overlapping ORFs. FIG. 16G shows an image of a Western blot showing infinite recursive eGFP translation of cells transfected with the split-eGFP circRNA reporter containing an in-frame IRES (oligo-2007). FIG. 16H provides a histogram showing the size distribution of predicted circRNA-encoded polypeptides. Shown in FIG. 16I is quantification of the percentage of circORFs with matched sORFs using the mapped IRES ORF analysis method or traditional ORF analysis method. Shown in FIG. 16J is quantification of the percentage of the circRNAs identified by peptidomics that contain at least one RFP fragment uniquely overlapping with the back-splicing junction. Shown in FIG. 16K is the percentage of the coverage of MS-20 identified polypeptides on each protein with different expression level in human iPSCs. The MS profiling data was obtained and mapped as described in Chen et al. (2020). FIG. 16L shows is the MS-identified polypeptide coverage on a lowly expressed EGFR protein in human iPSCs. The red boxes represent the mapped position of the MS-identified polypeptides on the protein.

FIG. 17A shows the H3K4me3 level obtained from ENCODE on the genomic region of FGFR1 and circFGFR1 showing no enrichment of the promoter signature near circFGFR1 IRES. FIG. 17B provides are images of FGFR1 (red), circFGFR1p (green) and DAPI (blue) in HEK-293T cells co-transfected with plasmids expressing FGFR1 and FLAG-circFGFR1p with permeabilization. Scale bars: 10 micrometers. Shown in FIG. 17C is quantification of the expression level of circFGFR1 in tumor samples and normal adjacent samples plotted as Tukey box-plot (outliers not shown). The data was extracted from the TCGA analysis without filtering (Nair et al., Oncotarget 7, 80967, (2016)). ERBC: estrogen receptor positive breast cancer; TNBC: triple-negative breast cancer. Shown in FIG. 17D is quantification of the expression level of circFGFR1 in non-transformed cell lines and cancer cell lines plotted as Tukey box-plot. The data was extracted from the CSCD database (Xia et al., 2018). FIG. 17E shows quantification of circFGFR1 IRES activity with or without heat-shock. Ns: not significant relative to the normal condition (WT) by an unpaired two-sample t-test (n=3 independent replicates). Error bar: SEM. Shown in FIG. 17F is quantification of the relative circularization efficiency of circFGFR1 RNA under normal or the heat-shock (HS) condition with qRT-PCR by normalizing the circFGFR1 RNA level to the linear FGFR1 RNA level using linear and circular RNA specific primers respectively. Ns: not significant relative to the normal condition by an unpaired two-sample t-test (n=3 independent replicates). Shown in FIG. 17G is quantification of the circFGFR1 RNA level by qRT-PCR with or without heat-shock (normalized to GAPDH mRNA level). Ns: not significant relative to the normal condition by an unpaired two-sample t-test (n=3 independent replicates). Provided in FIG. 17H is a schematic showing that, under normal conditions, upon FGF addition, FGFR1 undergoes dimerization and autophosphorylation, activating the downstream cell signaling pathway and facilitating cell proliferation. FIG. 17I provides is a schematic showing that, under stress conditions, the translation of FGFR1 RNA is downregulated, resulting in low FGFR1 protein level, where the cap-independent translation activity of circFGFR1 IRES remains steady. Upon FGF addition, circFGFR1p dimerizes with FGFR1. However, since circFGFR1p lacks the autophosphorylation domain, the circFGFR1p-FGFR1 dimer cannot activate the downstream cell signaling pathway, resulting in the suppression of cell proliferation.

FIG. 18A shows MFEs for all viral IRES positive oligos in DNA format and all human IRES positive oligos in DNA format. Provided in FIG. 18B is a histogram showing eGFP expression levels driven by representative viral IRESs from DNA-based IRES screen.

DETAILED DESCRIPTION OF THE INVENTION

Figure 1A:
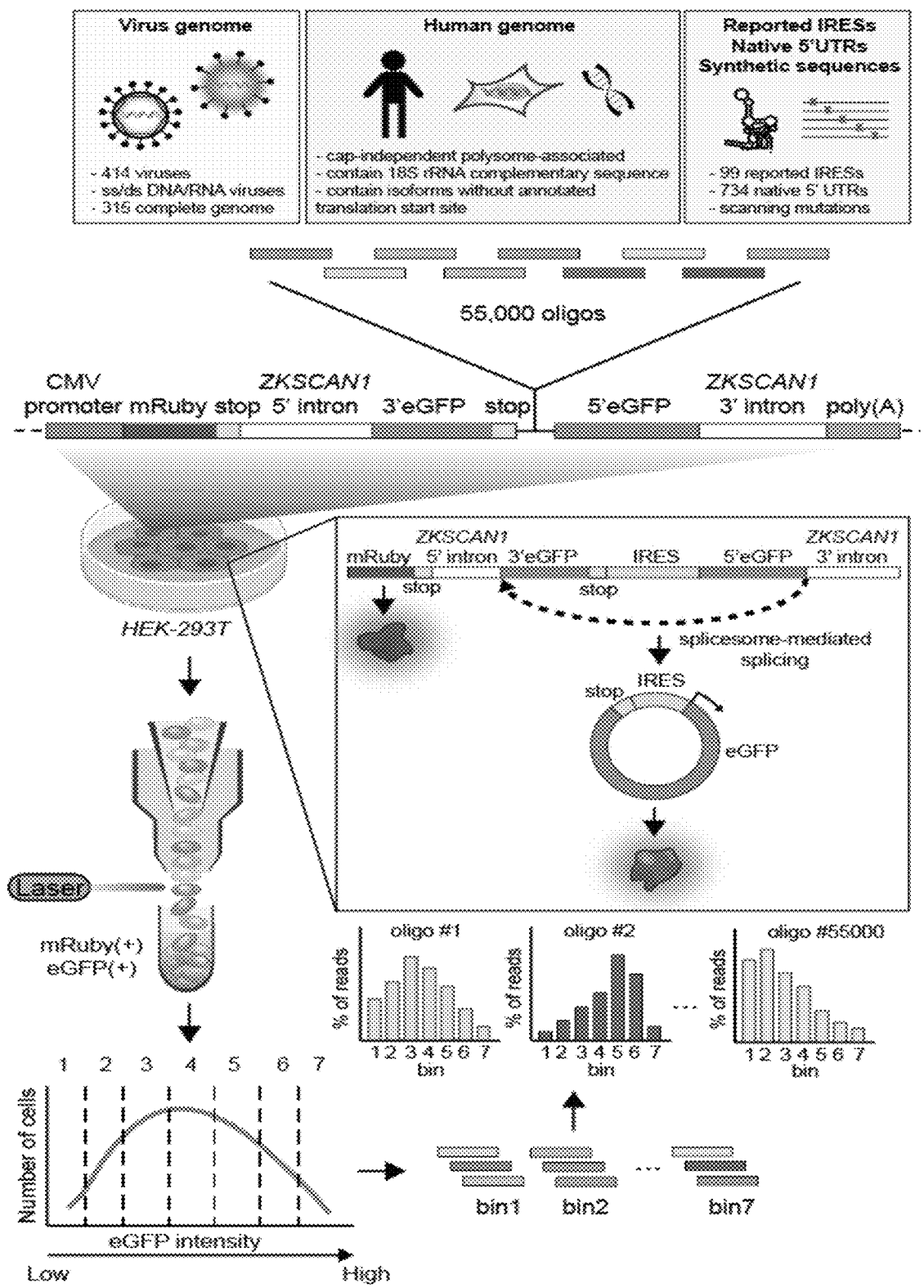
FIG. 1A-1D show high-throughput identification of RNA sequences that can facilitate cap-independent translation activity on circRNA.

The present disclosure is predicated, at least in part, on the development of a high-throughput reporter assay that can systematically screen and quantify the IRES activity of RNA sequences that can facilitate circRNA translation. This assay can identify elements in the primary and secondary structure of a circRNA IRES that are important for facilitating circRNA translation. This assay also enables the identification of potential endogenous protein-coding circRNAs, further expanding the currently-understood proteome. For example, the disclosure demonstrates the identification of a circRNA-encoded protein, circFGFR1p, that functions as a negative regulator of FGFR1 through a dominant negative mechanism to suppress cell growth under stress conditions. The embodiments described herein provide a resource to recognize and manipulate circRNA translation and reveal a new scope of the endogenous circRNA proteome, which provides insights into circRNA-associated diseases and the development of new therapeutic methods targeting circRNA-encoded proteins.

The disclosure is further based on the discovery that circFGFR1p is an endogenous circRNA-encoded protein that is a negative regulator of FGFR1 signaling and suppresses cell growth under stress conditions. While cells decrease global translation under stress conditions, many IRES can drive higher cap-independent translation activity under stress conditions, including the IRES of circZNF-609. Embodiments described herein highlight an important regulatory mechanism for how cells utilize different translation machinery to respond to stress conditions, and illustrate how circRNAs may be used to maintain protein translation under such conditions. While cells predominantly utilize cap-dependent linear mRNA translation to produce proteins, they can shift the RNA source of translation toward circRNA by upregulating the cap-independent translation activity of circRNA IRES under stress conditions. The depletion of circFGFR1 in human cancers may occur to down-regulate circFGFR1p and increase the proliferative signaling through FGF signaling. circRNA-encoded proteins may be useful for expressing individual subunits or "modules" of multi-domain proteins, allowing cells the ability to independently control translation thereof. The disclosure provides a new model of how circRNA translation is regulated by a mechanism which differs from linear mRNA translation and how cells utilize circRNA-encoded proteins to respond to a dynamic environment. The disclosure also provides recombinant circular RNAs comprising a protein-coding nucleic acid sequence and an IRES operably linked to the protein-coding nucleic acid sequence, which can be used to express one or more proteins of interest in a cell.

Definitions

To facilitate an understanding of the present technology, a number of terms and phrases are defined below. Additional definitions are set forth throughout the detailed description.

The use of the terms "a" and "an" and "the" and "at least one" and similar referents in the context of describing the invention (especially in the context of the following claims) are to be construed to cover both the singular and the plural, unless otherwise indicated herein or clearly contradicted by context. The use of the term "at least one" followed by a list of one or more items (for example, "at least one of A and B") is to be construed to mean one item selected from the listed items (A or B) or any combination of two or more of the listed items (A and B), unless otherwise indicated herein or clearly contradicted by context. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

The terms "nucleic acid sequence," "polynucleotide," and "oligonucleotide" are used interchangeably herein and refer to a polymer or oligomer of pyrimidine and/or purine bases, such as cytosine, thymine, and uracil, and adenine and guanine, respectively (See Albert L. Lehninger, *Principles of Biochemistry*, at 793-800 (Worth Pub. 1982)). The terms encompass any deoxyribonucleotide, ribonucleotide, or peptide nucleic acid component, and any chemical variants thereof, such as methylated, hydroxymethylated, or glycosylated forms of these bases. The polymers or oligomers may be heterogenous or homogenous in composition, may be isolated from naturally occurring sources, or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states. A nucleic acid or nucleic acid sequence may comprise other kinds of nucleic acid structures such as, for instance, a DNA/RNA helix, peptide nucleic acid (PNA), morpholino nucleic acid (see, e.g., Braasch and Corey, *Biochemistry*, 41(14): 4503-4510 (2002) and U.S. Pat. No. 5,034,506), locked nucleic acid (LNA; see Wahlestedt et al., *Proc. Natl. Acad. Sci. U.S.A.*, 97: 5633-5638 (2000)), cyclohexenyl nucleic acids (see Wang, *J. Am. Chem. Soc.*, 122: 8595-8602 (2000)), and/or a ribozyme. The terms "nucleic acid" and "nucleic acid sequence" may also encompass a chain comprising non-natural nucleotides, modified nucleotides, and/or non-nucleotide building blocks that can exhibit the same function as natural nucleotides (e.g., "nucleotide analogs"). The term "DNA sequence" is used herein to refer to a nucleic acid comprising a series of DNA bases.

The terms "polypeptide," and "protein" are used interchangeably herein, and refer to a polymeric form of amino acids comprising at least two or more contiguous amino acids chemically or biochemically modified or derivatized amino acids, and polypeptides having modified peptide backbones. The term "peptide" as used herein refers to a class of short polypeptides. The term peptide may refer to a polymer of amino acids (natural or non-naturally occurring) having a length of up to about 100 amino acids. For example, peptides may have a length of about 1 to about 10, about 10 to about 25, about 25 to about 50, about 50 to about 75, about 75 to about 100 amino acids. In some embodiments, the peptides are 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids in length.

Nomenclature for nucleotides, nucleic acids, nucleosides, and amino acids used herein is consistent with International Union of Pure and Applied Chemistry (IUPAC) standards (see, e.g., bioinformatics.org/sms/iupac.html).

When referring to a nucleic acid sequence or protein sequence, the term "identity" is used to denote similarity between two sequences. Sequence similarity or identity may be determined using standard techniques known in the art, including, but not limited to, the local sequence identity algorithm of Smith & Waterman, Adv. Appl. Math. 2, 482 (1981), by the sequence identity alignment algorithm of Needleman & Wunsch, J Mol. Biol. 48,443 (1970), by the search for similarity method of Pearson & Lipman, Proc. Natl. Acad. Sci. USA 85, 2444 (1988), by computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., Nucl. Acid Res. 12, 387-395 (1984), or by inspection. Another algorithm is the BLAST algorithm, described in Altschul et al., J Mol. Biol. 215, 403-410, (1990) and Karlin et al., Proc. Natl. Acad. Sci. USA 90, 5873-5787 (1993). A particularly useful BLAST program is the WU-BLAST-2 program which was obtained from Altschul et al., Methods in Enzymology, 266, 460-480 (1996); blast.wustl/edu/blast/README.html. WU-BLAST-2 uses several search parameters, which are optionally set to the default values. The parameters are dynamic values and are established by the program itself depending upon the composition of the particular sequence and composition of the particular database against which the sequence of interest is being searched; however, the values may be adjusted to increase sensitivity. Further, an additional useful algorithm is gapped BLAST as reported by Altschul et al, (1997) Nucleic Acids Res. 25, 3389-3402. Unless otherwise indicated, percent identity is determined herein using the algorithm available at the internet address: blast.ncbi.nlm.nih.gov/Blast.cgi.

The terms "internal ribosome entry site," "internal ribosome entry sequence," "IRES" and "IRES sequence region" are used interchangeably herein and refer to cis elements of viral or human cellular RNAs (e.g., messenger RNA (mRNA) and/or circRNAs) that bypass the steps of canonical eukaryotic cap-dependent translation initiation. The canonical cap-dependent mechanism used by the vast majority of eukaryotic mRNAs requires an $m^7G$ cap at the 5' end of the mRNA, initiator Met-tRNA$_{met}$, more than a dozen initiation factor proteins, directional scanning, and GTP hydrolysis to place a translationally competent ribosome at the start codon. IRESs typically are comprised of a long and highly structured 5'-UTR which mediates the translation initiation complex binding and catalyzes the formation of a functional ribosome.

The terms "coding sequence," "coding sequence region," "coding region," and "CDS" when referring to nucleic acid sequences may be used interchangeably herein to refer to the portion of a DNA or RNA sequence, for example, that is or may be translated to protein. The terms "reading frame," "open reading frame," and "ORF," may be used interchangeably herein to refer to a nucleotide sequence that begins with an initiation codon (e.g., ATG) and, in some embodiments, ends with a termination codon (e.g., TAA, TAG, or TGA). Open reading frames may contain introns and exons, and as such, all CDSs are ORFs, but not all ORF are CDSs.

The terms "complementary" and "complementarity" refers to the relationship between two nucleic acid sequences or nucleic acid monomers having the capacity to form hydrogen bond(s) with one another by either traditional Watson-Crick base-paring or other non-traditional types of pairing. The degree of complementarity between two nucleic acid sequences can be indicated by the percentage of nucleotides in a nucleic acid sequence which can form hydrogen bonds (e.g., Watson-Crick base pairing) with a second nucleic acid sequence (e.g., about 50%, about 60%, about 70%, about 80%, about 90%, and 100% complementary). Two nucleic acid sequences are "perfectly complementary" if all the contiguous nucleotides of a nucleic acid sequence will hydrogen bond with the same number of contiguous nucleotides in a second nucleic acid sequence. Two nucleic acid sequences are "substantially complementary" if the degree of complementarity between the two nucleic acid sequences is at least 60% (e.g., at least 65%, at least 70%, at least 75%, at least 80%, at least 85%, at least 90%, at least 95%, at least 97%, at least 98%, at least 99%, or 100%) over a region of at least 8 nucleotides (e.g., at least 9, at least 10, at least 11, at least 12, at least 13, at least 14, at least 15, at least 16, at least 17, at least 18, at least 19, at least 20, at least 21, at least 22, at least 23, at least 24, at least 25, at least 30, at least 35, at least 40, at least 45, at least 50, or more nucleotides), or if the two nucleic acid sequences hybridize under at least moderate, or, in some embodiments high, stringency conditions. Exemplary moderate stringency conditions include overnight incubation at 37° C. in a solution comprising 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50° C., or substantially similar conditions, e.g., the moderately stringent conditions described in Sambrook, J., *Molecular Cloning: A Laboratory Manual*, Cold Spring Harbor Laboratory Press; 4th edition (Jun. 15, 2012). High stringency conditions are conditions that use, for example (1) low ionic strength and high temperature for washing, such as 0.015 M sodium chloride/0.0015 M sodium citrate/0.1% sodium dodecyl sulfate (SDS) at 50° C., (2) employ a denaturing agent during hybridization, such as formamide, for example, 50% (v/v) formamide with 0.1% bovine serum albumin (BSA)/0.1% Ficoll/0.1% polyvinylpyrrolidone (PVP)/50 mM sodium phosphate buffer at pH 6.5 with 750 mM sodium chloride and 75 mM sodium citrate at 42° C., or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 µg/ml), 0.1% SDS, and 10% dextran sulfate at 42° C., with washes at (i) 42° C. in 0.2×SSC, (ii) 55° C. in 50% formamide, and (iii) 55° C. in 0.1×SSC (optionally in combination with EDTA). Additional details and an explanation of stringency of hybridization reactions are provided in, e.g., Sambrook, supra; and Ausubel et al., eds., *Short Protocols in Molecular Biology*, 5th ed., John Wiley & Sons, Inc., Hoboken, N.J. (2002). The term "hybridization" or "hybridized" when referring to nucleic acid sequences is the association formed between and/or among sequences having complementarity.

The term "secondary structure," or "secondary structure element" or "secondary structure sequence region" as used herein in reference to nucleic acid sequences (e.g., RNA, DNA, etc), refers to any non-linear conformation of nucleotide or ribonucleotide units. Such non-linear conformations may include base-pairing interactions within a single nucleic acid polymer or between two polymers. Single-stranded RNA typically forms complex and intricate base-pairing interactions due to its increased ability to form hydrogen bonds stemming from the extra hydroxyl group in the ribose sugar. Examples of secondary structures or secondary structure elements include but are not limited to, for example, stem-loops, hairpin structures, bulges, internal loops, multiloops, coils, random coils, helices, partial helices and pseudoknots. In some embodiments, the term "secondary structure" may refer to a SuRE element. The term "SuRE" stands for stem-loop structured RNA element (SuRE).

The term "free energy," as used herein, refers to the energy released by folding an unfolded polynucleotide (e.g., RNA or DNA, etc.) molecule, or, conversely, the amount of energy that must be added in order to unfold a folded polynucleotide (e.g., RNA or DNA, etc.) The "minimum free energy (MFE)" of a polynucleotide (e.g., DNA, RNA, etc.) describes the lowest value of free energy observed for the polynucleotide when assessed for various secondary structures thereof. The MFE of an RNA molecule may be used to predict RNA or DNA secondary structure and is affected by the number, composition, and arrangement of the RNA or RNA nucleotides. The more negative free energy a structure has, the more likely is its formation since more stored energy is released by formation of the structure.

The term "melting temperature (Tm)" refers to the temperature at which about 50% of double-stranded nucleic acid structures (e.g., DNA/DNA, DNA/RNA, or RNA/RNA duplexes) denature and dissociate to single-stranded structures.

The term "recombinant," as used herein, means that a particular nucleic acid (DNA or RNA) is the product of various combinations of cloning, restriction, polymerase chain reaction (PCR) and/or ligation steps resulting in a construct having a structural coding or non-coding sequence distinguishable from endogenous nucleic acids found in natural systems. DNA sequences encoding polypeptides can be assembled from cDNA fragments or from a series of synthetic oligonucleotides to provide a synthetic nucleic acid which is capable of being expressed from a recombinant transcriptional unit contained in a cell or in a cell-free transcription and translation system. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions and may act to modulate production of a desired product by various mechanisms. Alternatively, DNA sequences encoding RNA that is not translated may also be considered recombinant. Thus, the term "recombinant" nucleic acid also refers to a nucleic acid which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a codon encoding the same amino acid, a conservative amino acid, or a non-conservative amino acid. Alternatively, the artificial combination may be performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques. When a recombinant polynucleotide encodes a polypeptide, the sequence of the encoded polypeptide can be naturally occurring ("wild type") or can be a variant (e.g., a mutant) of the naturally occurring sequence. Thus, the term "recombinant" polypeptide does not necessarily refer to a polypeptide whose sequence does not naturally occur. Instead, a "recombinant" polypeptide is encoded by a recombinant DNA sequence, but the sequence of the polypeptide can be naturally occurring ("wild type") or non-naturally occurring (e.g., a variant, a mutant, etc.). Thus, a "recombinant" polypeptide is the result of human intervention, but may comprise a naturally occurring amino acid sequence.

The terms "operably linked" and "operatively linked," as used herein, refer to an arrangement of elements that are configured so as to perform, function or be structured in such a manner as to be suitable for an intended purpose. For example, a given promoter operably linked to a coding sequence is capable of effecting the expression of the coding sequence when the proper enzymes are present. Expression is meant to include the transcription of any one or more of a recombinant nucleic acid encoding a circular RNA, or mRNA from a DNA or RNA template and can further include translation of a protein from a recombinant circular RNA comprising an IRES sequence (e.g., a non-native IRES). Thus, for example, intervening untranslated yet transcribed sequences can be present between a promoter sequence and a coding sequence and the promoter sequence can still be considered to be "operably linked" to the coding sequence.

As used herein, the term "nonviral-like particle" may refer any protein-based particle that is not a virus or viral-like particle. For example, in some embodiments, a nonviral-like particle is a protein nanogel or protein spheres that allow encapsulation.

As used herein in reference to a lipid nanoparticle, the term "decorated" refers to a lipid nanoparticle that is coupled to one or more targeting agents (e.g., small molecules, peptides, polypeptides, carbohydrates, etc.) The targeting agent binds to one or more peptides, polypeptides, carbohydrates, cells, etc., and allows for targeting of the lipid nanoparticle specifically thereto.

Circular RNAs

Circular RNAs (circRNAs) are single-stranded RNAs that are joined head to tail and were initially discovered in pathogenic genomes such as hepatitis D virus (HDV) and plant viroids (Kos et al., *Nature*, 323: 558-560 (1986); Sanger et al., *PNAS USA*, 73: 3852-3856 (1976)). circRNAs have been recognized as a pervasive class of noncoding RNAs in eukaryotic cells (Salzman et al., *PLoS One*, 7: e30733, (2012); Memczak et al., *Nature*, 495: 333-338 (2013); Hansen et al., *Nature*, 495: 384-388, (2013)). Typically generated through back splicing, circRNAs have been postulated to function in cell-to-cell information transfer or memory due to their extraordinary stability (Jeck, W. R. & Sharpless, N. E., *Nat Biotech*, 32: 453-461, (2014)).

Although the functions of endogenous circRNAs are not known, their large number and the presence of viral circRNA genomes necessitate a system of circRNA immunity, as evidenced by the recent discoveries of human circRNA modulation of viral resistance through regulation of NF90/NF110 and autoimmunity through PKR regulation. Circular RNAs can act as potent adjuvants to induce specific T and B cell responses. In addition, circRNA can induce both innate and adaptive immune responses and have the ability to inhibit the establishment and growth of tumors.

The instant inventors have previously shown that intron identity dictates circRNA immunity. See, e.g., Chen, Y G, et. al, Mol. Cell (2019) 76(1):96-109.e9; Chen, Y G, et. al, Mol. Cell (2017) 67(2):228-238.e5. Because introns are not part of the final circRNA product, it has been hypothesized that introns may direct the deposition of one or more covalent chemical marks onto circRNA. Among the over 100 known RNA chemical modifications, m$^6$A is the most abundant modification on linear mRNAs and long noncoding RNAs, present on 0.2% to 0.6% of all adenosines in mammalian polyA-tailed transcripts (Roundtree et al., *Cell*, 169: 1187-1200 (2017)). m$^6$A has recently been detected on mammalian circRNAs (Zhou et al., *Cell Reports*, 20: 2262-2276 (2017)). Human endogenous circRNAs appear to be marked at birth by one or more covalent m$^6$A modifications, based on the introns that program their back splicing.

The instant disclosure provides a recombinant circular RNA molecule comprising a protein-coding nucleic acid sequence and a non-native an internal ribosome entry site (IRES) operably linked to the protein-coding nucleic acid sequence, and DNA sequences encoding the same. Recombinant circRNA molecules may be generated or engineered according to several methods. For example, recombinant circRNA molecules may be generated by back-splicing of linear RNAs. For example, in some embodiments, a recombinant circular RNA is produced by back-splicing of a downstream 5' splice site (splice donor) to an upstream 3' splice site (splice acceptor). The splice donor and/or splice acceptor may be found, for example, in a human intron or portion thereof that is typically used for circRNA production at endogenous loci as shown in FIG. 1A. In some embodiments, a recombinant circular RNA is produced by contacting a cell with a DNA plasmid, wherein the DNA plasmid encodes a linear RNA, and the linear RNA is back-spliced to produce a recombinant circular RNA. In some embodiments, the DNA plasmid comprises introns from the mammalian ZKSCAN1 gene.

Circular RNAs can be generated by any non-mammalian splicing method. For example, linear RNAs containing various types of introns, including self-splicing group I introns, self-splicing group II introns, spliceosomal introns, and tRNA introns can be circularized. In particular, group I and group II introns have the advantage that they can be readily used for production of circular RNAs in vitro as well as in vivo because of their ability to undergo self-splicing due to their autocatalytic ribozyme activity.

Alternatively, circular RNAs can be produced in vitro from a linear RNA by chemical or enzymatic ligation of the 5' and 3' ends of the RNA. Chemical ligation can be performed, for example, using cyanogen bromide (BrCN) or ethyl-3-(3'-dimethylaminopropyl) carbodiimide (EDC) for activation of a nucleotide phosphomonoester group to allow phosphodiester bond formation (Sokolova, *FEBS Lett*, 232: 153-155 (1988); Dolinnaya et al., *Nucleic Acids Res.*, 19: 3067-3072 (1991); Fedorova, *Nucleosides Nucleotides Nucleic Acids*, 15: 1137-1147 (1996)). Alternatively, enzymatic ligation can be used to circularize RNA. Exemplary ligases that can be used include T4 DNA ligase (T4 Dnl), T4 RNA ligase 1 (T4 Rnl 1), and T4 RNA ligase 2 (T4 Rnl 2).

In other embodiments, splint ligation may be used to generate circular RNA. Splint ligation involves the use of an oligonucleotide splint that hybridizes with the two ends of a linear RNA to bring the ends of the linear RNA together for ligation. Hybridization of the splint, which can be either a deoxyribo-oligonucleotide or a ribooligonucleotide, orients the 5'-phosphate and 3'-OH of the RNA ends for ligation. Subsequent ligation can be performed using either chemical or enzymatic techniques, as described above. Enzymatic ligation can be performed, for example, with T4 DNA ligase (DNA splint required), T4 RNA ligase 1 (RNA splint required) or T4 RNA ligase 2 (DNA or RNA splint). Chemical ligation, such as with BrCN or EDC, is more efficient in some cases than enzymatic ligation if the structure of the hybridized splint-RNA complex interferes with enzymatic activity (see, e.g., Dolinnaya et al. *Nucleic Acids Res*, 21(23): 5403-5407 (1993); Petkovic et al., *Nucleic Acids Res*, 43(4): 2454-2465 (2015)).

While circular RNAs generally are more stable than their linear counterparts, primarily due to the absence of free ends necessary for exonuclease-mediated degradation, additional modifications may be made to the recombinant circRNA described herein to further improve stability. Still other kinds of modifications may improve circularization efficiency, purification of circRNA, and/or protein expression from circRNA. For example, the recombinant circRNA may be engineered to include "homology arms" (i.e., 9-19 nucleotides in length placed at the 5' and 3' ends of a precursor RNA with the aim of bringing the 5' and 3' splice sites into proximity of one another), spacer sequences, and/or a phosphorothioate (PS) cap (Wesselhoeft et al., *Nat. Commun.*, 9: 2629 (2018)). The recombinant circRNA also may be engineered to include 2'-O-methyl-, -fluoro- or —O-methoxyethyl conjugates, phosphorothioate backbones, or 2',4'-cyclic 2'-O-ethyl modifications to increase the stability thereof (Holdt et al., *Front Physiol.*, 9: 1262 (2018); Krutzfeldt et al., *Nature*, 438(7068): 685-9 (2005); and Crooke et al., *Cell Metab.*, 27(4): 714-739 (2018)). The recombinant circRNA molecule also may comprise one or more modifications that reduce the innate immunogenicity of the circRNA molecule in a host, such as at least one N6-methyladenosine ($m^6A$).

In some embodiments, the recombinant circular RNA molecule is encoded by a nucleic acid that comprises at least two introns and at least one exon. In some embodiments, a DNA sequence encoding a circular RNA molecule comprises sequences that encode at least two introns and at least one exon. The term "exon," as used herein, refers to a nucleic acid sequence present in a gene which is represented in the mature form of an RNA molecule after excision of introns during transcription. Exons may be translated into protein (e.g., in the case of messenger RNA (mRNA)). The term "intron," as used herein, refers to a nucleic acid sequence present in a given gene which is removed by RNA splicing during maturation of the final RNA product. Introns are generally found between exons. During transcription, introns are removed from precursor messenger RNA (pre-mRNA), and exons are joined via RNA splicing. In some embodiments, the recombinant circular RNA molecule comprises a nucleic acid sequence which includes one or more exons and one or more introns.

Accordingly, circular RNAs can be generated by splicing of either an endogenous or exogenous intron, as described in WO 2017/222911. As used herein, the term "endogenous intron" means an intron sequence that is native to the host cell in which the circRNA is produced. For example, a human intron is an endogenous intron when the circRNA is expressed in a human cell. An "exogenous intron" means an intron that is heterologous to the host cell in which the circRNA is generated. For example, a bacterial intron would be an exogenous intron when the circRNA is expressed in a human cell. Numerous intron sequences from a wide variety of organisms and viruses are known and include sequences derived from genes encoding proteins, ribosomal RNA (rRNA), or transfer RNA (tRNA). Representative intron sequences are available in various databases, including the Group I Intron Sequence and Structure Database (rna.wh-u.edu.cn/gissd/), the Database for Bacterial Group II Introns (webapps2.ucalgary.ca/~groupii/index.html), the Database for Mobile Group II Introns (fp.ucalgary.ca/group2introns), the Yeast Intron DataBase (emblS16 heidelberg.de/ExternalInfo/seraphin/yidb.html), the Ares Lab Yeast Intron Database (compbio.soe.ucsc.edu/yeast_introns.html), the U12 Intron Database (genome.crg.es/cgibin/u12db/u12db.cgi), and the Exon-Intron Database (bpg.utoledo.edu/~afedorov/lab/eid.html).

In some embodiments, a DNA molecule encoding a recombinant circular RNA molecule comprises a self-splicing group I intron. Group I introns are a distinct class of RNA self-splicing introns which catalyze their own excision from mRNA, tRNA, and rRNA precursors in a wide range of organisms. All known group I introns present in eukaryote nuclei interrupt functional ribosomal RNA genes located in ribosomal DNA loci. Nuclear group I introns appear widespread among eukaryotic microorganisms, and the plasmodial slime molds (myxomycetes) contain an abundance of self-splicing introns. The self-splicing group I intron included in the circular RNA molecule may be obtained or derived from any organism, such as, for example, bacteria, bacteriophages, and eukaryotic viruses. Self-splicing group I introns also may be found in certain cellular organelles, such as mitochondria and chloroplasts, and such self-splicing introns may be incorporated into the circular RNA molecule.

In some embodiments, the recombinant circular RNA molecule is generated from a DNA molecule that comprises a self-splicing group I intron of the phage T4 thymidylate synthase (td) gene. The group I intron of phage T4 thymidylate synthase (td) gene is well characterized to circularize while the exons linearly splice together (Chandry and Belfort, *Genes Dev.*, 1: 1028-1037 (1987); Ford and Ares, *Proc. Natl. Acad. Sci. USA*, 91: 3117-3121 (1994); and Perriman and Ares, RNA, 4: 1047-1054 (1998)). When the td intron order is permuted (i.e., 5' half placed at the 3' position and vice versa) flanking any exon sequence, the exon is circularized via two autocatalytic transesterification reactions (Ford and Ares, supra; Puttaraju and Been, *Nucleic Acids Symp. Ser.*, 33: 49-51 (1995)).

In some embodiments, the recombinant circular RNA molecule is encoded by a DNA molecule that comprises a ZKSCAN1 intron. The ZKSCAN1 intron is described in, for example, Yao, Z., et al., Mol. Oncol. (2017) 11(4):422-437. In some embodiments, the recombinant circular RNA molecule is encoded by a DNA molecule that comprises a miniZKSCAN1 intron.

The recombinant circular RNA molecule may be of any length or size. For example, the recombinant circular RNA molecule may comprise between about 200 nucleotides and about 10,000 nucleotides (e.g., about 300, about 400, about 500, about 600, about 700, about 800, about 900, about 1,000, about 2,000, about 3,000, about 4,000, about 5,000, about 6,000, about 7,000, about 8,000, or about 9,000 nucleotides, or a range defined by any two of the foregoing values). In some embodiments, the recombinant circular RNA molecule comprises between about 500 and about 6,000 nucleotides (about 550, about 650, about 750, about 850, about 950, about 1,100, about 1,200, about 1,300, about 1,400, about 1,500, about 1,600, about 1,700, about 1,800, about 1,900, about 2,100, about 2,200, about 2,300, about 2,400, about 2,500, about 2,600, about 2,700, about 2,800, about 2,900, about 3,100, about 3,300, about 3,500, about 3,700, about 3,800, about 3,900, about 4,100, about 4,300, about 4,500, about 4,700, about 4,900, about 5,100, about 5,300, about 5,500, about 5,700, or about 5,900 nucleotides, or a range defined by any two of the foregoing values). In one embodiment, the recombinant circular RNA molecule comprises about 1,500 nucleotides.

In some embodiments, a recombinant circular RNA molecule comprises a protein-coding nucleic acid sequence region and an internal ribosome entry site (IRES) sequence region operably linked to the protein-coding nucleic acid sequence region, wherein the IRES comprises: at least one sequence region having secondary structure element; and a sequence region that is complementary to an 18S ribosomal RNA (rRNA); wherein the IRES has a minimum free energy (MFE) of less than −18.9 kJ/mol and a melting temperature of at least 35.0° C. In some embodiments, the IRES sequence is linked to the protein-coding nucleic acid sequence region in a non-native configuration.

The disclosure also provides a recombinant circular RNA molecule comprising a protein-coding nucleic acid sequence region and an internal ribosome entry site (IRES) sequence region operably linked to the protein-coding nucleic acid sequence; wherein the IRES is encoded by any one of the nucleic acid sequences listed in of SEQ ID NO: 1-228 or SEQ ID NO: 229-17201, or a nucleic acid sequence that has at least 90% or at least 95% identity or homology thereto. In some embodiments, the IRES sequence is linked to the protein-coding nucleic acid sequence region in a non-native configuration.

circRNA Internal Ribosome Entry Sites

The recombinant circular RNAs described herein comprise an internal ribosome entry site (IRES) operably linked to a protein-coding sequence of the circRNA in a non-native configuration. Inclusion of an IRES permits the translation of one or more open reading frames from a circular RNA. The IRES element attracts a eukaryotic ribosomal translation initiation complex and promotes translation initiation. It will be appreciated that there are two known mechanisms by which translation is initiated in eukaryotes. The first is the canonical cap-dependent mechanism that is used by the vast majority of eukaryotic mRNAs, which requires an $m^7G$ cap at the 5'end of the mRNA, initiator Met-tRNAmet, more than a dozen initiation factor proteins, directional scanning, and GTP hydrolysis to place a translationally competent ribosome at the start codon. The second mechanism is cap-independent initiation that is used by some mRNAs as well as many eukaryote-infecting viruses. This mechanism bypasses the need for the cap and often many of the protein factors, using cis-acting IRES RNA elements to recruit the ribosome and initiate protein synthesis. There is great diversity among viral IRES RNAs in terms of their sequences, proposed secondary structures, and functional requirements for protein factors, but all drive a mode of translation initiation that depends on specific RNA sequences and likely specific RNA structures in the IRES.

Accordingly, provided herein are various IRES sequences which, when present in a circRNA, may drive translation of a protein. In some embodiments, the IRES of a circRNA may be operably linked to a protein-coding nucleic acid sequence. In some embodiments, the IRES of a circRNA is operably linked to a protein-coding nucleic acid sequence in a non-native configuration. In some embodiments, the IRES is a human IRES. In some embodiments, the IRES is a viral IRES.

As used herein, the term "non-native configuration" refers to a linkage between an IRES and a protein-coding nucleic acid that does not occur in a naturally occurring circRNA molecule. For example, a viral IRES may be operably linked to a protein-coding nucleic acid sequence in a circular RNA, or an IRES that is not found in naturally occurring circRNA molecules may be operably linked to a protein-coding nucleic acid sequence in a circRNA. In some embodiments, an IRES that is found in naturally occurring circRNA molecules operably linked to a certain protein-coding nucleic acid is operably linked to a different protein-coding nucleic acid (i.e., a nucleic acid to which the IRES is not operably linked in any naturally-occurring circRNA). In some embodiments, an IRES that is found in naturally occurring linear mRNAs is operably linked to a protein coding sequence in a circular RNA.

A number of linear IRES sequences are known and may be included in a recombinant circular RNA molecule as described herein. For example, linear IRES sequences may be derived from a wide variety of viruses, such as from leader sequences of picornaviruses (e.g., encephalomyocarditis virus (EMCV) UTR) (Jang et al., *J. Virol.*, 63: 1651-1660 (1989)), the polio leader sequence, the hepatitis A virus leader, the hepatitis C virus IRES, human rhinovirus type 2 IRES (Dobrikova et al., *Proc. Natl. Acad. Sci.*, 100(25): 15125-15130 (2003)), an IRES element from the foot and mouth disease virus (Ramesh et al., *Nucl. Acid Res.*, 24: 2697-2700 (1996)), and a giardiavirus IRES (Garlapati et al., *J. Biol. Chem.*, 279(5): 3389-3397 (2004)). A variety of nonviral IRES sequences also can be included in a circular RNA molecule, including but not limited to, IRES sequences from yeast, the human angiotensin II type 1 receptor IRES (Martin et al., *Mol. Cell Endocrinol.*, 212: 51-61 (2003)), fibroblast growth factor IRESs (e.g., FGF-1 IRES and FGF-2 IRES, Martineau et al., *Mol. Cell. Biol.*, 24(17): 7622-7635 (2004)), vascular endothelial growth factor IRES (Baranick et al., *Proc. Natl. Acad. Sci. U.S.A.*, 105(12): 4733-4738 (2008); Stein et al., *Mol. Cell. Biol.*, 18(6): 3112-3119 (1998); Bert et al., *RNA*, 12(6): 1074-1083 (2006)), and insulin-like growth factor 2 IRES (Pedersen et al., *Biochem. J.*, 363(Pt 1): 37-44 (2002)).

IRES sequences and vectors encoding IRES elements are commercially available from a variety of sources, such as, for example, Clontech (Mountain View, Calif.), Invivogen (San Diego, Calif.), Addgene (Cambridge, Mass.) and GeneCopoeia (Rockville, Md.), and IRESite: The database of experimentally verified IRES structures (iresite.org). Notably, these databases focus on activity of IRES sequences in mRNA (i.e., linear RNAs), and do not focus on circRNA IRES activity profiles.

Figure 19A:
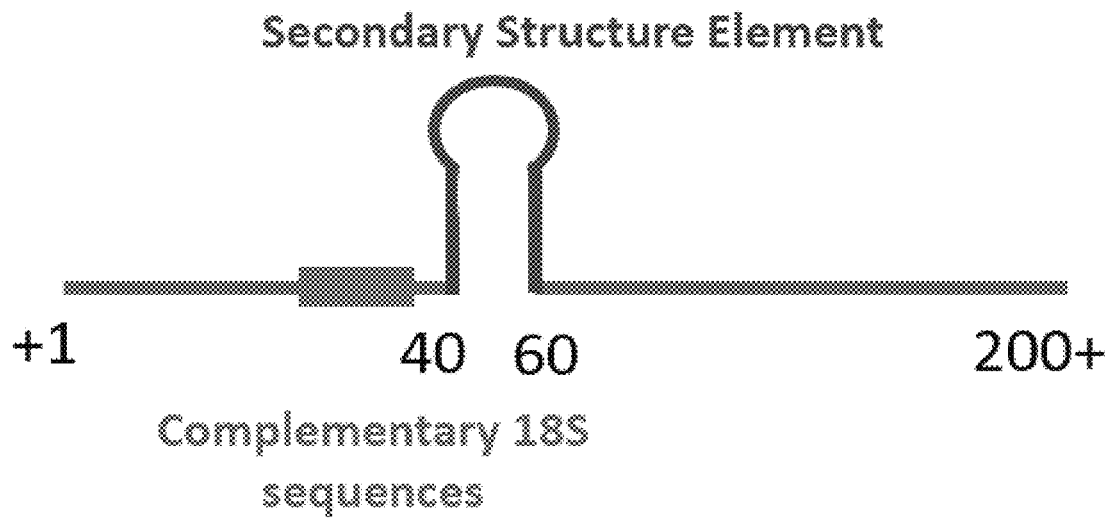
FIGS. 19A and 19B provide schematics of fixed positions of secondary structure elements as part of an IRES, wherein the secondary structure element spans from approximately nucleotide positions 40-60 bp from +1 start site of IRES sequence. The 18S complementary sequences may be positioned either 5' (FIG. 19A) or 3' (FIG. 19B) to the secondary structure element. In these figures, the secondary structure element is a hairpin; however the secondary structure element may have one or more alternative structures as described herein.
Figure 19B:
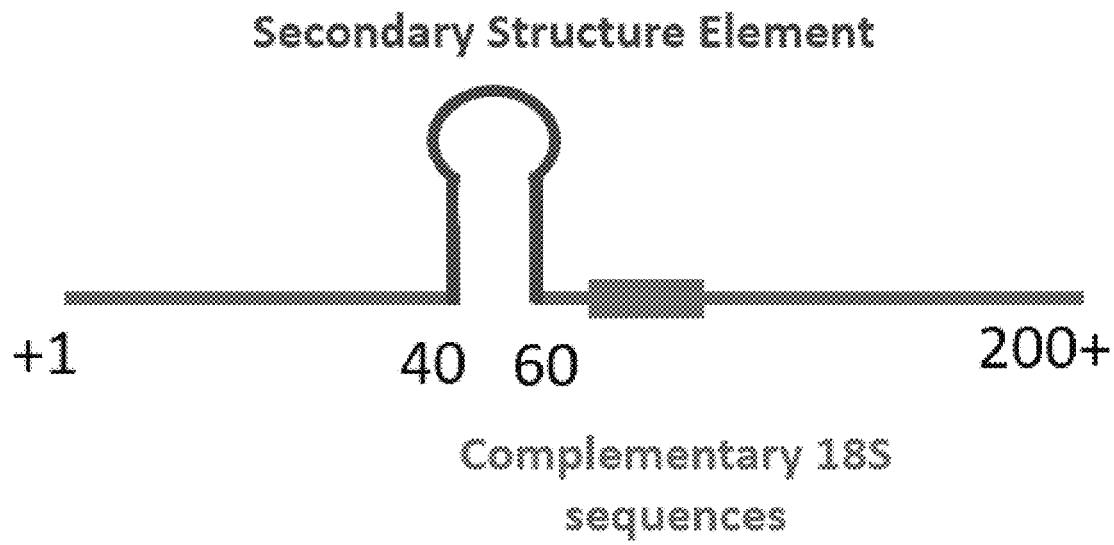

In some embodiments, the IRES comprises at least one RNA secondary structure element. Intramolecular RNA base pairing is often the basis of RNA secondary structure and in some circumstances be a critical determinant of overall macromolecular folding. In conjunction with cofactors and RNA binding proteins (RBPs), secondary structure elements can form higher order tertiary structures and thereby confer catalytic, regulatory, and scaffolding functions to RNA. Thus, the IRES may comprise any RNA secondary structure element that imparts such structural or functional determinants. In some embodiments, the RNA secondary structure may be formed from the nucleotides at about position 40 to about position 60 of the IRES, relative to the 5' end thereof. The most common RNA secondary structures are helices, loops, bulges, and junctions, with stem-loops or hairpin loops being the most common element of RNA secondary structure. A stem-loop is formed when the RNA chains fold back on themselves to form a double helical tract called the stem, with the unpaired nucleotides forming a single-stranded region called the loop. Bulges and internal loops are formed by separation of the double helical tract on either one strand (bulge) or on both strands (internal loops) by unpaired nucleotides. A tetraloop is a four-base pairs hairpin RNA structure. There are three common families of tetraloop in ribosomal RNA: UNCG, GNRA, and CUUG (N is one of the four nucleotides and R is a purine). Pseudoknots are formed when nucleotides from the hairpin loop pair with a single stranded region outside of the hairpin to form a helical segment. RNA secondary structure is further described in, e.g., Vandivier et al., Annu Rev Plant Biol., 67: 463-488 (2016); and Tinoco and Bustamante, supra). In some embodiments, the IRES of the recombinant circRNA molecule comprises at least one stem-loop structure. The at least one RNA secondary structure element may be located at any position of the IRES, so long as translation is efficiently initiated from the IRES. In some embodiments, the stem portion of the stem-loop may comprise from 3-7 base pairs, 4, 5, 6, 7, 8, 9, 10, 11 or 12 base pairs or more. The loop portion of the stem-loop may comprise from 3-12 nucleotides, including 4, 5, 6, 7, 8, 9, 10, 11, 12 or more nucleotides. The stem-loop structure may also have on either side of the stem one or more bulges (mismatches). In some embodiments, the RNA secondary structure element is formed from the nucleotides at about position 40 to about position 60 of the IRES, wherein the first nucleic acid at the 5' end of the IRES is considered to be position 1. In some embodiments, the sequence that is complementary to an 18S rRNA is located 5' to the at least one RNA secondary structure element (i.e., in the range of about position 1 to about position 40 of the IRES, See FIG. 19A). In some embodiments, the sequence that is complementary to an 18S rRNA is located 3' to the a least one RNA secondary structure element (i.e., in the range of about position 61 to the end of the IRES, See FIG. 19B). Sequences encoding exemplary secondary structure-forming RNA sequences that may be included in the IRES described herein are provided in SEQ ID NO: 17202-28976.

In some embodiments, the at least one RNA secondary structure element of the IRES is a stem-loop. In some embodiments, the at least one RNA secondary structure element is encoded by any one of the nucleic acid sequences of SEQ ID NO: 17202-28976. In some embodiments, the at least one RNA secondary structure element is encoded by a nucleic acid sequence having at least 80%, at least 85%, at least 90%, at least 91%, at least 92%, at least 93%, at least 94%, at least 95%, at least 96%, at least 97%, at least 98%, or at least 99% sequence identity relative to any one of SEQ ID NO: 17202-28976. In some embodiments, the at least one RNA secondary structure element is encoded by a nucleic acid sequence having at least 1, at least 2, at least 3, at least 4, at least 5, at least 6, at least 7, at least 8, at least 9 at least 10, or more nucleotide substitutions relative to any one of SEQ ID NO: 17202-28976.

RNA secondary structure typically can be predicted from experimental thermodynamic data coupled with chemical mapping, nuclear magnetic resonance (NMR) spectroscopy, and/or sequence comparison. In some embodiments, the RNA secondary structure is predicted by a machine-learning/deep-learning algorithm (e.g., CNN) (See, Zhao, Q., et al., "Review of Machine-Learning Methods for RNA Secondary Structure Prediction," Sep. 1, 2020 (available on the world wide web at: arxiv.org/abs/2009.08868). A variety of algorithms and software packages for RNA secondary structure prediction and analysis are known in the art and can be used in the context of the present disclosure (see, e.g., Hofacker I. L. (2014) Energy-Directed RNA Structure Prediction. In: Gorodkin J., Ruzzo W. (eds) RNA Sequence, Structure, and Function: Computational and Bioinformatic Methods. Methods in Molecular Biology (Methods and Protocols), vol 1097. Humana Press, Totowa, N.J.; Mathews et al., supra; Mathews, et al. "RNA secondary structure prediction," Current Protocols in Nucleic Acid Chemistry, Chapter 11 (2007): Unit 11.2. doi:10.1002/0471142700.nc1102s28; Lorenz et al., Methods, 103: 86-98 (2016); Mathews et al., Cold Spring Harb Perspect Biol., 2(12): a003665 (2010)).

In some embodiments, the IRES of the recombinant circRNA may comprise a nucleic acid sequence that is complementary to 18S ribosomal RNA (rRNA). Eukaryotic ribosomes, also known as "80S" ribosomes, have two unequal subunits, designated small subunit (40S) (also referred to as "SSU") and large subunit (60S) (also referred to as "LSU") according to their sedimentation coefficients. Both subunits contain dozens of ribosomal proteins arranged on a scaffold composed of ribosomal RNA (rRNA). In eukaryotes, eukaryotic 80S ribosomes contain greater than 5500 nucleotides of rRNA: 18S rRNA in the small subunit, and 5S, 5.8S, and 25S rRNA in the large subunit. The small subunit monitors the complementarity between tRNA anticodon and mRNA, while the large subunit catalyzes peptide bond formation. Ribosomes typically contain about 60% rRNA and about 40% protein. Although the primary structure of rRNA sequences can vary across organisms, base-pairing within these sequences commonly forms stem-loop configurations.

In some embodiments, the IRES of the recombinant circRNA may comprise any nucleic acid sequence that is complementary to any eukaryotic 18S rRNA sequence. In some embodiments, the nucleic acid sequence that is complementary to 18S rRNA is encoded by any one of the nucleic acid sequences set forth in Table 1. In some embodiments, the nucleic acid sequence that is complementary to 18S rRNA is encoded by a nucleic acid sequence that has at least 80%, at least 85%, at least 90%, at least 91%, at least 92%, at least 93%, at least 94%, at least 95%, at least 96%, at least 97%, at least 98%, or at least 99% identity or homology to a sequence set forth in Table 1. In some embodiments, the nucleic acid sequence that is complementary to 18S rRNA is encoded by a nucleic acid sequence that has at least 1, at least 2, at least 3, at least 4, at least 5, at least 6, at least 7, at least 8, at least 9, at least 10, or more nucleotide substitutions relative to a nucleic acid sequence set forth in Table 1.

TABLE 1

Illustrative DNA sequences that encode RNA sequences that are complementary to 18S RNA

| SEQ ID NO: | Nucleic Acid Sequence |
|---|---|
| 28977 | CACCTACGGAAACCTTGTTACGACTTTTACTTCCTCTAGATAGTCAAGTTCGACCGTCTTCT CAGCGCTCCGCCAGGGCCGTGGGCCGACCCCGGCGGGGCCGATCCGAGGGCCTCACTAAA CCATCCAATCGGTAGTAGCGACGGGCGGTGTGTACAAAGGGCAGGGACTTAATCAACGCA AGCTTATGACCCGCACTTACTGGGAATTCCTCGTTCATGGGGAATAATTGCAATCCCC |
| 28978 | GGGACGCCGACCGCTCGGGGGTCGCGTAACTAGTTAGCATGCCAGAGTCTCGTTCGTTATC GGAATTAACCAGACAAATCGCTCCACCAACTAAGAACGGCCATGCACCACCACCC |
| 28979 | GTTTATGGTCGGAACTACGACGGTATCTGATCGTCTTCGAACCTCCGACTTTCGTTCTTGAT TAATGAAAACATTCTTGGCAAATGCTTTCGCTCTGGTCCGTCTTGCGCCGGTCCAAGAATT TCACCTCTAGCGGCGCAATACGAATGCCCCCGGCCGTCCCTCTTAATCATGGCCTCAGTTC CGAAAACCAACAAAATAGAACCGCGGTCCTATTCCATTATTCCTAGCTGCGGTATCCAGGC GGCTCGGGCCTGCTTTGAACACTCTAATTTTTTCAAAGTAAACGCTTCGGG |
| 28980 | AGAGCATCGAGGGGGCGCCGAGAGGCAAGGGGCGGGGACGGGCGGTGGCTCGCCTCGCG GCGGACCGCCCGCCCGCTCCC |

TABLE 1-continued

Illustrative DNA sequences that encode RNA sequences that are complementary to 18S RNA

| SEQ ID NO: | Nucleic Acid Sequence |
|---|---|
| 28981 | TACGAGCTTT |
| 28982 | ATACGCTATTGGAGCTGGAATTACCGCGGCTGCTGGCACCAGACTTGCCCTCCAATGGATCCTCGTTAAAGGATTTAAAGTGGACTCATTCCAATTACAGGGCCTCGAAAGAGTCCTGTA |
| 28983 | GGGGGCGTGCGATCGGCCCGAGGTTATCTAGAGTCACCAAAGCCGCCGGCGCCCGCCCCCCGGCCGGGGCCGGAGAGGGG |

The most commonly used criterion for RNA secondary structure prediction is the minimum free energy (MFE), since, according to thermodynamics, the MFE structure is not only the most stable, but also the most probable one in thermodynamic equilibrium. The MFE of an RNA or DNA molecule is affected by three properties of nucleotides in the RNA/DNA sequence: number, composition, and arrangement. For example, longer sequences are on average more stable because they can form more stacking and hydrogen bond interactions, guanine-cytosine (GC)-rich RNAs are typically more stable than adenine-uracil (AU)-rich sequences, and nucleotide order influences the folding structure stability because it determines the number and the extension of loops and double-helix conformations. It has been found that mRNAs and microRNA precursors, unlike other non-coding RNAs, have greater negative MFE than expected given their nucleotide numbers and compositions. Thus, free energy also can be employed as a criterion for the identification of functional RNAs.

The IRES of the recombinant circRNA molecule may comprise a minimum free energy (MFE) of less than about −15 kJ/mol (e.g., less than about −16 kJ/mol, less than about −17 kJ/mol, less than about −18.5 kJ/mol, less than about −19 kJ/mol, less than about −18.9 kJ/mol, less than about −20 kJ/mol, less than about −30 kJ/mol). In some embodiments, the MFE is greater than about −90 kJ/mol (e.g., greater than about −85 kJ/mol, greater than about −80 kJ/mol, greater than about −70 kJ/mol, greater than about −60 kJ/mol, greater than about −50 kJ/mol, greater than about −40 kJ/mol). In some embodiments, the IRES has a has a minimum free energy (MFE) of about −18.9 kJ/mol or less. In some embodiments, the IRES has a MFE in the range of about −15.9 kJ/mol to about −79.9 kJ/mol. In some embodiments, the IRES may comprise a MFE in the range of about −12.55 kJ/mol to about −100.15 kJ/mol. In some embodiments, the IRES is a viral IRES and has a MFE in the range of about −15.9 kJ/mol to about −79.9 kJ/mol. In some embodiments, the IRES is a human IRES and has a MFE in the range of about −12.55 kJ/mol to about −100.15 kJ/mol.

In some embodiments, the at least one secondary structure element of an IRES of may comprise a minimum free energy (MFE) of less than about −0.4 kJ/mol, less than about −0.5 kJ/mol, less than about −0.6 kJ/mol, less than about −0.7 kJ/mol, less than about −0.8 kJ/mol, less than about −0.9 kJ/mol, or less than about −1.0 kJ/mol. In some embodiments, the at least one secondary structure element of the IRES may comprise a MFE of less than about −0.7 kJ/mol.

In some embodiments, the RNA sequence comprising the nucleotides at about position 40 to about position 60 of an IRES of a circRNA described herein may comprise a minimum free energy (MFE) of less than about −0.4 kJ/mol, less than about −0.5 kJ/mol, less than about −0.6 kJ/mol, less than about −0.7 kJ/mol, less than about −0.8 kJ/mol, less than about −0.9 kJ/mol, or less than about −1.0 kJ/mol. In some embodiments, the RNA sequence comprising the nucleotides at about position 40 to about position 60 of the IRES may comprise a MFE of less than about −0.7 kJ/mol.

As discussed, above, the minimum free energy of a particular RNA (e.g., an RNA produced from a DNA sequence) may be determined using a variety of computational methods and algorithms. The most commonly used software programs, employed to predict the secondary RNA or DNA structures by MFE algorithms, make use of the so-called nearest-neighbor energy model. This model uses free energy rules based on empirical thermodynamic parameters (Mathews et al., *J Mol Biol,* 288: 911-940 (1999); and Mathews et al., *Proc Natl Acad Sci USA,* 101: 7287-7292 (2004)) and computes the overall stability of an RNA or DNA structure by adding independent contributions of local free energy interactions due to adjacent base pairs and loop regions. In sequences with homogeneous nucleotide arrangements and compositions, the additive and independent nature of the local free energy contributions suggests a linear relationship between computed MFE and sequence length (Trotta, E., *PLoS One,* 9(11): el 13380 (2014)). Algorithms for determining MFE are further described in, e.g., Hajiaghayi et al., *BMC Bioinformatics,* 13: 22 (2012); Mathews, D. H., *Bioinformatics,* Volume 21, Issue 10: 2246-2253 (2005); and Doshi et al., *BMC Bioinformatics,* 5: 105 (2004) doi 10.1186/1471-2105-5-105).

One of ordinary skill in the art will appreciate that the melting temperature ($T_m$) of a particular circRNA molecule may also be indicative of stability. Indeed, RNA sequences with high $T_m$ generally contain thermo-stable functionally important RNA structures (see, e.g., *Nucleic Acids Res.,* 45(10): 6109-6118 (2017)). Thus, in some embodiments, the IRES of the recombinant circRNA molecule has a melting temperature of at least 35.0° C. In some embodiments, the IRES of the recombinant circRNA molecule has a melting temperature of at least 35.0° C., but not more than about 85° C. In some embodiments, in some embodiments, the RNA secondary structure has a melting temperature of at least 35° C., at least 36° C., at least 37° C., at least 38° C., at least 39° C., at least 40° C., at least 41° C., at least 42° C., at least 43° C., at least 44° C., at least 45° C., at least 46° C., at least 47° C., at least 48° C., at least 49° C. or greater. In some embodiments, the melting temperature is not more than about 85° C., not more than about 75° C., not more than about 70° C., not more than about 65° C., not more than about 60° C., not more than about 55° C., not more than about 50° C. or less.

The melting temperature of a particular nucleic acid molecule can be determined using thermodynamic analyses and algorithms described herein and known in the art (see, e.g., Kibbe W. A., *Nucleic Acids Res.,* 35(Web Server issue): W43-W46 (2007). doi:10.1093/nar/gkm234; and Dumousseau et al., *BMC Bioinformatics,* 13: 101 (2012). doi.org/10.1186/1471-2105-13-101).

In some embodiments, the IRES comprises at least one RNA secondary structure element; and a nucleic acid sequence that is complementary to an 18S ribosomal RNA (rRNA); wherein the IRES has a minimum free energy (MFE) of −18.9 kJ/mol or less and a melting temperature of at least 35.0° C. In some embodiments, the RNA secondary structure element of the IRES has a has a minimum free energy (MFE) of less than −18.9 kJ/mol, and is formed from the nucleotides at about position 40 to about position 60 of the IRES, wherein the first nucleic acid at the 5' end of the IRES is considered to be position 1. In some embodiments, the RNA secondary structure element has a melting temperature of at least 35.0° C., and is formed from the nucleotides at about position 40 to about position 60 of the IRES, wherein the first nucleic acid at the 5' end of the IRES is considered to be position 1.

Because circRNA molecules are often generated from linear RNAs by back-splicing of a downstream 5' splice site (splice donor) to an upstream 3' splice site (splice acceptor), the recombinant circular RNA molecule may further comprise a back-splice junction. In some embodiments, the IRES may be located within about 100 to about 200 nucleotides of the back-splice junction. In addition, it has been observed that regions of RNA with higher G-C content have more stable secondary structures than RNA strands with lower G-C content. Thus, in some embodiments, the IRES of the recombinant circRNA molecule may further comprise a minimum level of G-C base pairs. For example, the non-native IRES of the recombinant circRNA molecule may comprise a G-C content of at least 25% (e.g., at least 30%, at least 35%, at least 40%, at least 45% or more), but not more than about 75% (e.g., about 70%, about 65%, about 60%, about 55%, about 50% or less). In some embodiments, the IRES has a G-C content of at least 25%.

G-C content of a given nucleic acid sequence may be measured using any method known in the art, such as, for example chemical mapping methods (see, e.g., Cheng et al., *PNAS,* 114 (37): 9876-9881 (2017); and Tian, S. and Das, R., *Quarterly Reviews of Biophysics,* 49: e7 doi:10.1017/S0033583516000020 (2016)).

Exemplary sequences encoding IRESs for use in the circRNA molecules of the present disclosure are set forth in of SEQ ID NO: 1-228 or SEQ ID NO: 229-17201. Thus, the disclosure further provides a recombinant circular RNA molecule comprising a protein-coding nucleic acid sequence and an IRES operably linked to the protein-coding nucleic acid sequence in a non-native configuration; wherein the IRES is encoded by any one of the nucleic acid sequences listed in of SEQ ID NO: 1-228 or SEQ ID NO: 229-17201.

In some embodiments, the IRES is encoded by any one of the nucleic acid sequences set forth in any one of SEQ ID NO: 1-228. In some embodiments, the IRES is encoded by a nucleic acid sequence that has at least 80%, at least 85%, at least 90%, at least 91%, at least 92%, at least 93%, at least 94%, at least 95%, at least 96%, at least 97%, at least 98, or at least 99% identity to any one of the nucleic acid sequences of SEQ ID NO: 1-228. In some embodiments, the IRES is encoded by a nucleic acid sequence that has at least 1, at least 2, at least 3, at least 4, at least 5, at least 6, at least 7, at least 8, at least 9, at least 10 or more nucleotide substitutions relative to any one of the sequences of SEQ ID NO: 1-228.

In some embodiments, the IRES is encoded by any one of the nucleic acid sequences set forth in any one of SEQ ID NO: 229-17201. In some embodiments, the IRES is encoded by a nucleic acid sequence that has at least 80%, at least 85%, at least 90%, at least 91%, at least 92%, at least 93%, at least 94%, at least 95%, at least 96%, at least 97%, at least 98, or at least 99% identity or homology to any one of the nucleic acid sequences of SEQ ID NO: 229-17201. In some embodiments, the IRES is encoded by a nucleic acid sequence that has at least 1, at least 2, at least 3, at least 4, at least 5, at least 6, at least 7, at least 8, at least 9, at least 10 or more nucleotide substitutions relative to any one of the sequences in any one of SEQ ID NO: 229-17201.

In some embodiments, the IRES is encoded by the nucleic acid sequences denoted Index 876 (SEQ ID NO: 531), 6063 (SEQ ID NO: 2270), 7005 (SEQ ID NO: 2602), 8228 (SEQ ID NO: 3042), or 8778 (SEQ ID NO: 3244). In some embodiments, the IRES is encoded by the nucleic acid sequence of SEQ ID NO: 33948.

In some embodiments, the IRES is encoded by any one of the nucleic acid sequences set forth in Table 2. In some embodiments, the IRES is encoded by a nucleic acid sequence that has at least 80%, at least 85%, at least 90%, at least 91%, at least 92%, at least 93%, at least 94%, at least 95%, at least 96%, at least 97%, at least 98, or at least 99% identity or homology to one or the nucleic acid sequences of Table 2. In some embodiments, the IRES is encoded by a nucleic acid sequence that has at least 1, at least 2, at least 3, at least 4, at least 5, at least 6, at least 7, at least 8, at least 9, at least 10 or more nucleotide substitutions relative to any one of the sequences in Table 2.

TABLE 2

Illustrative Sequences Encoding IRES sequences

| Oligo-nucleotide Identifier | Sequence | SEQ ID NO: |
|---|---|---|
| 4173 | CATCCTCCTGCTGAAGTGACAAGCCACGCTGCTTCTGGAGCCAAAGC TGACCAAGAAGAACAAATCCACCCCAGATCTAGACTCAGGTCACCT CCTGAAGCCCTCGTTCAGGGTCGATATCCCCACATCAAGGACGGTGA GGATCTTAAAGACCACTCAACAGAAAGTAAAAAA | 33946 |
| 2125 | GCAGAAGGGAAACGTGAAGAAGGTGAAGATGGCGGTGGCCAGGGC CGGGGTCTTGGGAGTCCAGTGGCTGCAAAGGGCATCCCGGAACGTG ATGCCGCTGGGCGCACGGACAGCCTCCCACATGACCAAGGACATGT TCCCGGGGCCCTATCCTAGGACCCCAGAAGAACGGGC | 33947 |
| 6742 | AGACTCGGGAACTGCCTGAATGTGGTTTGGGACACGAGACCTCATC | 33948 |

TABLE 2-continued

Illustrative Sequences Encoding IRES sequences

| Oligo-nucleotide Identifier | Sequence | SEQ ID NO: |
|---|---|---|
|  | ATATTGATGAGCGAACAAACAAGAACATTTCCTCCCTCCCCTCCTTT GAATTGAAATGGCACATTAAGACTTGTCACGGCTTCTCACTGGGACT GGAGACCTCGTTCCTTCACCCCGCGTGTCGCCAG |  |
| 8839 | AGGTGGGCGGTGGCGGTAGGTGGGTGGCCAGCGACTGGCAACGCGG TGGCTTAGACGCGCGAGATCCGGCCAGGGTCAGAGTACTGTAAGAT TGATGTTAAAGGCATGGTGTTCACCCCACTTCATCAGCGTACATAAG TTATCTCTTCTTTTGGACCCTTATTTTATGCCATA | 33949 |
| 8279 | GGAGGCAGGTTGATGTGTTTGTGCTTCCTTCTACAGCCAATATGAAA AGGCCTAGTAAGTGGGGTCGGGAGGCGGGCGTGGAGGGACCCACGT CTGGAAGTTGCTGCAGCCACCACGACGCGTCTTCTACGGCTACGGCTT TGTCTCTGCTGAGTTAAAGAAAGCAAGTAAACGC | 33950 |
| 1637 | ATTTATAAGCAATAGTAGCTTATTTGGCTCACAGTTCTGGAGGCTGA GAAGATCGTGAGGCTGCATCTGGCAAGGGCCTTCTTGCTGCTTCATA ACATGGCAGAAGACATCATGCGGGTGTGTGTCTGGGGAAGAGACTT ACAGAAGTGGAGTTGCTGAGTCAAAGATCTAACC | 33951 |
| 27147 | TCTTTTGGTGCAGAAGGTGACGGGAAACAGGCCGCAGACCTGAACT TCCAACCGTATGTAGGCGAGAAGCCGGTGCCGATACTCCCACTATCC CACAATGTCCCACTGGGCCCCAGAGTGGAAGAGGGCGGAGGCTAAT CCAAGAGACCTTGGGGCCAGCTGGGATGTCAGGGG | 33952 |
| 7408 | ATCCACCATGAAGCAGAATCTAAAGAAAAAGGTCCAAGCATGAAGG AACCAAATCCAATTTCTCCACCAATTTTCCATGGTCTGGACACCCTA ACCGTGATGGGCATTGCGTTTGCAGCCTTTGTGATCGGAGCACTCCT GACGGGGGCCTTGTGGTACATCTATTCTCACACA | 33953 |
| 29135 | CAGATTAGAGGACGGGCGCTTTGGAGCCGGCCCCAGGCAGCGTGTG TCGGTCGCCTAGTCTGGAGAACTAGTCCTCGACTCACGTGCAAGGAT GATGCTGAAAGGAATAACAAGGCTTATCTCTAGGATCCATAAGGCC AAGCATGGGGATCAGCACGAGGGTCAGCACTACAA | 33954 |
| 7806 | CTCTCGGGGGCCAGGGGTCATCGGTTTGACCCCTGACCTATAAGCCA AGATACCCATAAACACACTCAGAAAGCAGAGAAAAAGGACAAGA GTCTGTGTTTGAGAGGGGGTCTGCCATTCCTGCTTGGGGACTGGTGG GGAAGAGGGCCAGGACATCTTCTGAGCCAGGACGT | 33955 |
| 661 | AGTCTGGCTGCGGCGGCAGAGCTGAAGTGAGCGGAGCCACCAGGAG GCCATGTCGGGTGAGGACGCTGAGGTCCGGGCAGTCTCTGAAGATG TCTCCAATGGAAGCAGTGGCTCGCCCAGCCCTGGGGACACACTGCCC TGGAACCTTGGGAAAACGCAGCGGAGCCGGCGCAG | 33956 |
| 1258 | ATCTGCCTCAGCCTCTTTGTCACTGCCTGGACCATTGTCCCTGCTGTT TCTCAGACAGCATAGAGGCTGAGGCTGGGGCCAGGACCCAGACAGA GACACACGGTCACTGCAGCTGAAGCCGCTGCCCCTGCTACAGGCAC CACCAGGACCAGCTGATCATTCCAGCCCACAGCA | 33957 |
| 6757 | CTCAGGCTGTGGCCCCACCTGCCCCCAAGCCCACCCAGGCTGGGGA AGGAACGCTGTCAGAGGCCCTGCTGCAGCTGCAGTTTGATGATGAA GACCTGGGGGCCTTGCTTGGCAACAGCACAGACCCAGCTGTGTTCAC AGACCTGGCATCCGTCGACAACTCCGAGTTTCAGC | 33958 |
| 5825 | CTCAAGGTTTTGAAGAGACAGGGGACACGCTCTATGCCCCCTATTCC ACACATTTTCAGCTGCAGAACCAGCCTCCCCAAAAGGAATTCTCCAT CCCACGGGCCCACGCTTGGCCGAGCCCTTACAAAGACTATGAAGTA AAGAAAGAGGGCAGCTAACTCTGTCCTGAAGAGT | 33959 |
| 27115 | GCTTCCGTAGAGGCCAGCTGGTTGCTACGCAGCAACAGGAAACATT CCGCGCTACCGAGTACTTTCTACTCCCGACCAGGCATTGCTCTCTCTG GAGACCCTCGGCGGTGGTTGCTGTATTTTGACTTGGAGTAAGGATGA CTTTTCGGGCCACAGATAGTGAATTTGACCTGA | 33960 |
| 3130 | CTGGAGGGCCGCACTCCCGTTCCAGCCAGGCTGAGCCTTCTGTCCCC TGCCTCTGGGGCCTGGGAACCCCCCTTCTTCTTTCTCCTGAATGGCAC CCCCGCCCTAGAATCCAGACACCGAGTTTCCCACTGTGGCTGGTTCA AGGAGCTCCCTGGTGACAGTCTGTGGCTGAGC | 33961 |
| 5065 | TAGAGTGGGGGTGGAAGATGATTCTCGCCTGTTGCTGGGGATTTAT GAACATGGCTATGGAAACTGGGAGTTAATTAAAACAGACCCAGAGC TTAAATTAACTGACAAAATTCTGCCGGTGGAGACAGATAAAAAGCC TCAGGGGAAGCAGCTACAGACCCGAGCGGATTACT | 33962 |

TABLE 2-continued

Illustrative Sequences Encoding IRES sequences

| Oligo-nucleotide Identifier | Sequence | SEQ ID NO: |
|---|---|---|
| 8066 | AGCGGCTGCAGCATCCAGCCAGCTTGGATGTCTGGCCTGTGAGCCTG GGGAAACTATTATTAATAATATTTACTGTTGATAATATTGGGGAAAA CAGCCCTTAACTCTGAGGTTTCTGCTGTGCTCCTTTCCAAAACAGACT TCCAGGACTCTGAAGAAACAGTTACAAGCAGG | 33963 |
| 1952 | AAGGGAGGAGGCGCCGAGCTGACCGGGCGACGCCGCGGGAGGTTCT GGAAACGCCGGGAGCTGCGAGTGTCCAGACACTTCCCTCTGTGACC ATGAAACTCTGGGTGTCTGCATTGCTGATGGCCTGGTTTGGTGTCCT GAGCTGTGTGCAGGCCGAATTCTTCACCTCTATTG | 33964 |
| 5020 | GCGAACTGAAGGTGGCCCAAGGGAAGGCTCTGCAAGAGAATTTGGC CCTCCTGACCCAGACCCTAGCTGAAAGAGAAGAGGAGGTGGAGACT CTGCGGGGACAAATCCAGGAACTGGAGAAGCAACGGGAAATGCAG AAGGCTGCTTTGGAATTGCTGTCTCTGGACCTGAAGA | 33965 |
| 8766 | AGGAAGCCGAGGAAGGCTGTGTTTCTGACTCACACGGGGGAGTCGG GGGAGTCGTAAACAACCCTGAAGAGAACAGCCAGGCCTGGCGCTCT GGGCTTGGTCCTGGGACACCCGTTTGACACTGTAAAGGTGAGGCTGC AGACCCAGACCACCTACCGGGGCATCGTTGATTGC | 33966 |
| 27433 | CTGCCTCCCCCCGCTCCCGCTCCCCTGAGCCCAGCCAGACCCCGCG CCGCCCGCGCCCCGCTCGACTCCGGAGGCTCCCGCAGCCCCGGCGTC CGCCCCGCTGCCCCCTCCCCCGGGGGCCATGGGGGCGCCCCCGGGCT ACCGGCCCTCAGCTTGGGTGCATCTCCTCCACC | 33967 |
| 27818 | CTCAGTGAAGCAACGAGGATGCCGGGGAGAGGGAAGGGGCTGGGC TCTGGGCGGTGCCAAGTCTGTGAGGGGGCGCGGTCACCGCCCAGGG TTCCCACGAACGCCAAGGCGGCCACGTCCTGCTCCCCCTGGTGAAGA AGCTGCCCTGGGCTTGTCGTCCTAGGGTCTCCAGAC | 33968 |
| 8861 | CTGATGTGAGCTAGTTTGTCTGGTTGAGTTGGATGTTTAAATAGAAG GCAGAACAACAACAGGTACTCCACATCAGCATTCTCAAGACTGGAG AAGTTAGGCCTCAGACATCCCAAGCCTTCTCCTTTCATTGGAAACTT GACATTTTTCCGCCAGGGTTTTTGGGAAAGCCAA | 33969 |
| 8040 | GCCACATTCCACACTAACGTGTTGGTGAATTCTTCTGGGCATTGCCA GTACCTGCCTCCAGGCATATTCAAGAGTTCCTGCTACATCGATGTAC GCTGGTTTCCCTTTGATGTGCAGCACTGCAAACTGAAGTTTGGGTCC TGGTCTTACGGAGGCTGGTCCTTGGATCTGCAG | 33970 |
| 27907 | TCCTGCCTCGGCAACCCCGGGCCCTGAGGGCAGGCCCCAACCGCGG AGGAGCAGGAGAGGGCGGAGGCCGGCGGGCCATGCCCTGGTCGTCC CGCGGCGCCCTCCTTCGGGACCTGGTCCTGGGCGTGCTGGGCACCGC CGCCTTCCTGCTCGACCTGGGCACCGACCTGTGGG | 33971 |
| 2392 | AAGTTTGAAACTGGTAACTTCGGGAGTTGAGCCACGAGCTGTTGTGC ATCCAGAGGTGGAATTGGGGCCCGGCATTCCCTCCTCGTCCCGGGCT GGCCCTTGCCCCCACCCTGCAACTCCTGGTTGAGATGGGCTCAGCCA AGAGCGTCCCAGTCACACCAGCGCGGCCTCCGC | 33972 |
| 7802 | AGCCTTCGCTGGATCTCCTTCCCGAACTCACAAATCCTGACGAGCTC CTGTCTTATCTGGACCCCCCCGACCTGCCGAGCAATAGTAACGATGA CCTCCTGTCTCTATTTGAGAACAACTGAGGGCCACCCGGTCGGGGCC ATCCCTCCACACTCTGCATCCTACCCCACCTAC | 33973 |
| 7655 | TTTTTAGAGGTTGGTTGTTGTGTTTTAGGATTCTGTCCATTTTCTTTTA AAGTTATAAACACGTACTTGTGCGAATTATTTTTTTAAAGTGATTTGC CATTTTTGAAAGCGTATTTAATGATAGAATACTATCGAGCCAACATG TACTGACATGGAAAGATGTCAAAGATATGT | 33974 |
| 981 | AGCCAGCGGACGTCCAGGAACCGGGATGCCTCCAGCAGTGAGGCGG TCAGCCTGCAGCATGGGATGGCTGTGGATCTTTGGGGCAGCCCTGGG GCAGTGTCTGGGCTACAGTTCACAGCAGCAAAGGGTGCCATTTCTTC AGCCCTCCCGGTCAAAGTCAACTGCAAGCGAGTTA | 33975 |
| 5027 | GGGACCAGGAACTGGAGGCTCTGCAGCAAGAACAGCAGCAGGCCCA GGGACAGGAGGAGAGGGTGAAGGAAAAGGCAGACGCCCTCCAGGG AGCTCTGGAGCAAGCCCATATGACACTGAAGGAGCGTCATGGAGAG CTTCAGGACCACAAGGAACAGGCACGAAGGCTGGAGG | 33976 |
| 7683 | CTACTCCGGAGCCTGAGGTGGGAGGATCGCTTGAGTCTGGGAGGCA GAGGCTGCATTGAGCTATGATCATGGCACTGCATTCCAGCCTGGGTG ACAGTGCAAGACCTTGTCTCAGAATAAATAAAGTATGTGATGAAGA TGTGCATACATTATATGCAAATACTGTTTTTTTTT | 33977 |

TABLE 2-continued

Illustrative Sequences Encoding IRES sequences

| Oligo-nucleotide Identifier | Sequence | SEQ ID NO: |
|---|---|---|
| 8650 | CACCAATTCGGCTGGCGTCTCCGAGACCGCGGACTCCCGTAGGGTCC CCGTGGCCCCGAGTTGTAGTCGGGACACCCCGGCCGCGGGTGATCGT CGGGTCTCCACGCGCCCGGGTCGCTGACGCGGATCCGGCCTCGGCGC CTTCTCAGGGCGCCCTGCAAGGCCGCAGGCAGG | 33978 |
| 6898 | CCTCCTCTCTGGCTAATCAACAGCTGCCCCCAGCCTGTGGTGCCAGG CAACTCAGCAAGCTGAAAAGGTTCCTTACTACCCTGCAGCAGTTTGG CAATGACATTTCACCCGAGATAGGAGAAAGAGTTCGCACCCTCGTTC TGGGACTAGTGAACTCCACTTTGACAATTGAAG | 33979 |
| 2042 | TTTAGTGTCACAGGAGACACGAGGGCAAAGTGCTGAGGAAACTCTA GAGCAACATCGGAATGCATGGTGAAGCATCAGATGGTGAAGGAGAA GGAGACACAGAAGTGATGCAGCAGGAGACAGTTCCAGTTCCTGTAC CTTCAGAGAAAACCAAACAGCCTAAAGAATGTTTTT | 33980 |
| 1686 | GCCACTTCTCTTCCCTTCATTCTTCGCCAGGCTCTCTGCTGACTCAAG TTCTTCAGTTCACGATCTTCTAGTTGCAGCGATGAGTGCACGAGTGA GATCAAGATCCAGAGGAAGAGGAGATGGTCAGGAGGCTCCCGATGT GGTTGCATTCGTGGCTCCCGGTGAATCTCAGCA | 33981 |
| 5902 | CTTCAACTTGGCAACAGTTGCCTGGGGTAGCTCTACACAACTCTGTC CAGCCCACAGCAATGATTCCAGAGGCCATGGGGAGTGGACAGCAGC TAGCTGACTGGAGGAATGCCCACTCTCATGGCAACCAGTACAGCACT ATCATGCAGCAGCCATCCTTGCTGACTAACCATG | 33982 |
| 3399 | CACCCTGACCCAAGCCGAGACAGGTTCCAAACCTCAACCTGCAGCC GGAAGGGGGAAGTGAAACTCGGCTGGGGGTGGGGGCTCAGAAGCC GCCCCAGAAAGCACTGAAAGCCACAGCACGTACACCCACTCCAGGG ATCTGCCAGCACCCTGTGGGGCCCAGACTACAGGCTG | 33983 |
| 6560 | GGGACGCCATTGTGATTGGGGCGGGGATCCAGGGCTGCTTCACTGC ATACCACCTGGCCAAACACAGGAAGAGGATCCTCCTGCTGGAGCAG TTCTTTCTACCACACTCCCGAGGAAGCTCCCATGGACAAAGCCGGAT AATCCGAAAGGCGTACCTGGAAGACTTTTACACCC | 33984 |
| 2890 | CACCGTAGTGCTTAGAGGCCGAAAAAGTACAGCCCCTTCCGGGCTCC GCGGTACGGGAAGACAGCTTTGGGATGTCGGAAGATCCTAGAGGTC CCAAGGTACCACGAAAGGCAGTGGTAGAAAAGCCAGCTCGGGCAGC AGAGCGAGAGGCCCGGGCCCTGCTGGAGAAGAACC | 33985 |
| 4343 | ATTGGCTGAGCCCGGCTGTCAGTCCTTTCGCGCCTCGGCGGCGCGGC ATAGCCCGGCTCGGCCTGTAAAGCAGTCTCAAGCCTGCCGCAGGGA GAAGATGGCGGTCGCCGTGAGAACTTTGCAGGAACAGCTGGAAAAG GCCAAAGAGAGTCTTAAGAACGTGGATGAGAACAT | 33986 |
| 6138 | ACAAGGAGACTGGGAGGTGTCTCAAGTGCCTGTACCACACGGAAGG GGAACACTGTCAGTTCTGCCGGTTTGGATACTATGGTGATGCCCTCC AGCAGGACTGTCGAAAGTGTGTCTGTAATTACCTGGGCACCGTGCAA GAGCACTGTAACGGCTCTGACTGCCAGTGCGACA | 33987 |
| 2241 | GAGGAAGGAGAGAGTGGAGGAGGAGGGCTTTGGGTTAGGGAGAGT GCTTTCGTTTGTTTTAAATGGGAGAAACTGGAGCATGTTGCCAAGGG CAGAGAGCCAGCAGAGAGGGGTGAATGGAAGAAGGAGCGAGAAGG GGGTTACTGACGAAGCCTTATCCTGGAGGAGAGAAGG | 33988 |
| 5715 | CAAGTGGTCCTGTCGAAGTATTTATCACTGAGACTCCGAGTCAGCCC AACTCCCACCCCATCCAGTGGAATGCACCACAGCCATCTCACATTTC CAAGTACATTCTCAGGTGGAGACCTAAAAATTCTGTAGGCCGTTGGA AGGAAGCTACCATACCAGGCCACTTAAACTCCT | 33989 |
| 3456 | CTAGACCAAAGGGTGCGGCTGCTGCAGAGGTGGCTGATGCAGGTTT CCATCCTTGGGGAATGACCACGCAACTGGGCCCAGCCCTGGTGCTGG GGGTGGCCCTGTGCCTGGGTTGTGGCCAGCCCCTACCACAGGTCCCT GAACGCCCCTTCTCTGTGCTGTGGAATGTACCCT | 33990 |
| 5260 | ATCTCCAGCCATTGCTCCTCCAACAGAGACCATGGCTCCTCCAGTCA GGGATCCTGTTCCTGGGAAACCCACGGTCACCATCCGGACTCGAGGC GCCATTATTCAAACCCCAACCCTAGGCCCCATCCAGCCTACTCGGGT GTCAGAAGCTGGCACCACAGTTCCTGGCCAGAT | 33991 |

TABLE 2-continued

Illustrative Sequences Encoding IRES sequences

| Oligo-nucleotide Identifier | Sequence | SEQ ID NO: |
|---|---|---|
| 1288 | GGAGGCAGGCGGTGCCGCGGCGCCGGGACCCGACTCATCCGGTGCTTGCGTGTGGTGGTGAGCGCAGCGCCGAGGATGAGGAGGTGCAACAGCGGCTCCGGGCCGCCGCCGTCGCTGCTGCTGCTGCTGTGGCTGCTCGCGGTTCCCGGCGCTAACGCGGCCCCGCGGTCG | 33992 |
| 8756 | CACCCCCACCGACCTCTCGGAGACAGGAATCCGCTCTGCCCCTGCATCCTCCTCTGCTCACCCTTCTCTCAGTAGTGTTTGTCAGACACCAGTCCGGACCTCAGCTCTCGATCTAGTTCCCGAGTAAGATTTAGCTCCCGGGAAAGCGTGCCTGAAACAAGCCGGAGTGAGCCT | 33993 |
| 8952 | CCTGTACCATAACCAGGAGGCTGATGGTTGCTCAGGCCTCCCTCAAACTAGCCAATGAGAAGTGCACGGGTCCTGGTCGCCTAGGAAACCGCGTGACAACAAGATGGCGGCGCTGCGGGACGGCTAGCGGCCCTGCGTGGGAGTTCCTGACAGCTGGATTCTAGAAGTAGAACT | 33994 |
| 2759 | TTCCCCGGAAGTGTTGGTTAAAGCCCCTCCAATCAGCGGCTCGGTGCGGCAAGTTTGAATTTCGTGGAGGCTCGGGTTGTGAGGGTTCCTGCTTCGGAGTCGGCGGTGGTCGTCCAGACCGAGTGTTCTTTACTTTTTGTTTGGTTGAGGTTTCACGCTAGAAGGTGGCTCAGG | 33995 |
| 1241 | CTGTCCATACACTCTCTCATCATCCTGTTCCTTGGATTGGACTTCACTAAGCAATTTATCACTCACCTTCAGACTTACATGTGGGAGTTTTCACAACAGTAGTTTTGGAATCATTAGAACTTGGATTGATTTCATCATTTAACAGAAACAAACAGCCCAAATTACTTTATCACC | 33996 |
| 28013 | GAGCTCCAGCCTCCAGGCACCCGGGATCCAGCGCCGCCGCTCATAACACCCGCGACCCCGCAGCTAAGCGCAGCTCCCGACGCAATGGACCCGGCGCTGGCAGCCCAGATGAGCGAGGCTGTGGCCGAGAAGATGCTCCAGTACCGGCGGGACACAGCAGGCTGGAAGATTTGC | 33997 |
| 4681 | TGTTGACTCATGCAAATGAGGTATCTGAACTGCAGCTTCAGTATTAGCAGAGCCACAGGCCGCCTCTGTGGCATCACCAGGGTTTCTCTGAAGAAGAGGGTCTGCATTTTCCTAAACCCAGTGCTGCTCTCCCATCTCCCATCTTCCTCTCGCAGCTTGATGAGCCCCGGTGTG | 33998 |
| 5602 | TGCCCCAGCCCTCAGGGCCGCCAGCAAGGAAGAAATTTGTGATACCCCTCGACGAGGATGAGGTCCCTCCTGGAGTGGCCAAGCCCTTATTCCGATCTACACAGAGCCTTCCCACTGTGGACACCTCGGCCCCAGGCGGCCCCTCAGACCTACGCCGAATATGCCATCTCACAGC | 33999 |
| 1945 | GAGAGGCCGGCGTCTCTCCCCCAGTTTGCCGTTCACCCGGAGCGCTCGGGACTTGCCGATAGTGGTGACGGCGGCAACATGTCTGTGGCTTTCGCGGCCCCGAGGCAGCGAGGCAAGGGGGAGATCACTCCCGCTGCGATTCAGAAGATGTTGGATGACAATAACCATCTTATT | 34000 |
| 5229 | AACCCCAACCCTAGGCCCCATCCAGCCTACTCGGGTGTCAGAAGCTGGCACCACAGTTCCTGGCCAGATTCGCCCAACGATGACCATTCCTGGCTATGTGGAGCCTACTGCAGTTGCTACCCCTCCCACAACCACCACCAAGAAGCCACGAGTATCCACACCAAAACCAGCAAC | 34001 |
| 7542 | CTGCAGCATCTTCTACGTCGGGACCACAGCCTCCGCCTCCACAAAGCCTGAACCTCCTTTCGCAGGCTCAGCTGCAGGCACAGCCTCTTGCGCCAGGCGGAACTCAAATGAAAAGAAAAGTGGCTTCCAGATAACTAGCGTTACTCCTGCTCAGATCTCCGCTAGTATCAGCT | 34002 |
| 6866 | CCAATACCTGGGATCCATTGCCTCTCCTTCTGTGCACCCAGCAACGCCCATTTCACCTGGACGTGCCAGCGGCATGACAACCCTCTCTGCAGAACTTTCCAGTCGACTCTCAACGGCACCCGACCTGACAGCGTTCAGCGACCCGCGCCAGTTCCCCGCGCTGCCCTCCATCTC | 34003 |
| 1849 | TCTCTTGCTTCAACAGTGTTTGGACGGAACAGATCCGGGGACTCTCTTCCAGCCTCCGACCGCCCTCCGATTTCCTCTCCGCTTGCAACCTCCGGGACCATCTTCTCGGCCATCTCCTGCTTCTGGGACCTGCCAGCACCGTTTTTGTGGTTAGCTCCTTCTTGCCAACCAACC | 34004 |
| 2558 | AGTTACCTCTCCCCTTTCACGTAGTTTTCATTTGTGGTGAGATTCTCTCCCAGGCCACAAGACATTTCCTGCTCGGAACCTTGTTTACTAATTTCCACTGCTTTTAAGGCCCTGCACTGAAAATGCAAGCTCAGGCGCCGGTGGTCGTTGTGACCCAACCTGGAGTCGGTCCCG | 34005 |

TABLE 2-continued

Illustrative Sequences Encoding IRES sequences

| Oligo-nucleotide Identifier | Sequence | SEQ ID NO: |
|---|---|---|
| 2109 | ATCAGCCCAAAGGTAGGCTCAGGCTCCGACGGTGGCCGGCGGGGGT CACGAGGCTTCGTAGTGGAGGAACGGGTTTGGCGTGTGGGACGCAG CTGCCTCTGTACTGGGGAGTCACGGAGTGGCCGGGCTCCAGGGACA TGGCGGCGGCCTCTGCGGTGTCGGTGCTGCTGGTGG | 34006 |
| 297 | ATCCGGAGGCAGCCTGCAGGAAGCCGTAGCGCCGGTACGTGCCCCT CTCCTGTCTGGAGGCGGGTGTAGAAGTCCGACCGCGGAAGCCAGAC TGCTGTCCAGTCGGCGAGCGCGTACCATTCAGCATCGGCTCCGCCCG AGTCCCACCTTCCTCAGGCTCTGATTGGCTGACAC | 34007 |
| 2621 | CAACAGAAGCCAAGAAGGAAGCCGTCTATCTTGTGGCGATCATGTA TAAGCTGGCCTCCTGCTGTTTGCTTTTCATAGGATTCTTAAATCCTCT CTTATCTCTTCCTCTCCTTGACTCCAGGGAAATATCCTTTCAACTCTC AGCACCTCATGAAGACGCGCGCTTAACTCCGG | 34008 |
| 6574 | TGGCTGACACATTCCTGGAGCACATGTGCCGCCTGGACATTGATTCA CCACCCATCACAGCCCGGAACACTGGCATCATCTGTACCATTGGCCC AGCTTCCCGATCAGTGGAGCTGAAGAAGGGAGCCACTCTCAAAATC ACGCTGGATAACGCCTACATGGAAAAGTGTGACG | 34009 |
| 1033 | GACATTTACATCCTGCCCAGCGACAACTCTGGACAAGTCAGTCCCCC AGAGTCTCCAACTGTGACCACTTCCTGGCAGTCTGAGAGCTTACCTG TGTCACTGTCAGCTAGCCAGAGTTGGCACACAGAAAGCCTGCCAGT GTCACTAGGCCCTGAGTCCTGGCAGCAGATTGCA | 34010 |
| 8789 | CCTCTGACTTGACCCAATGAAAGAAGCATATGGCACTTGTGAAGATA AATGTTACTCCTCCCTTTTTAATTGGAACTTCTGCTTAGGACCTGTGT ATGACGTTTCACCTGTGATCTGTTCTTTCGGTAGCCACTGACTTTGAG TTACAGGAAGGTCTCCGAAGATTTGTGTCAA | 34011 |
| 6392 | CTTCCCTGAGGAGGACGACCCCACCAACTGGCTGCGTTGCTACTACT ACGAAGACACCATCAGCACCATCAAGTCTGTGGCCTGGGAGGGAGG GGCCTGTCCAGCCTTCCTGCCATCCCTACGACCACTGCCCCTCACAT CACCTTCTCATGGGTCCCTCTCCCACTCCAAAGC | 34012 |
| 6885 | ATTTATGATTTCAACATGGATACATATTTCAGTTCTTTCTTTTTCTCAC TATCTGAAAATACATTTCCCTCCCTCTCTTCCCCCCAATATCTCCCTT TTTTTCTCTCTTCCTCTATCTTCCAAACCCCACTTTCTCCCTCCTCCTT TTCCTGTGTTCTCTTAAGCAGATAGCAC | 34013 |
| 561 | CCCTTCCGGCTGGCCCCGCTCAGTCACCCGCAGCAGGCGTGCAGTTT CCCGGCTCTCCGCGCGGCCGGGGAAGGTCAGCGCCGTAATGGCGTT CTTGGCGTCGGGACCCTACCTGACCCATCAGCAAAAGGTGTTGCGGC TTTATAAGCGGGCGCTACGCCACCTCGAGTCGTG | 34014 |
| 7556 | ATACAAATTTGCCTTTGGCACAACAGATACCACTAAGTTCTACCCAG TTCTCCGCACAATCATTAGCTCAGGCAATTGGAAGCCAAATTGAAGA TGCCAGGCGTGCAGCGGAGCCCTCCTTAGTTGGCTTACCTCAGACTA TCAGTGGTGACAGTGGGGGAATGTCAGCAGTTT | 34015 |
| 8800 | TCCGTCCTCCAGGATCTGGGGAGAAAGAGCCCCATCCCTTCTCTCTC TGCCACCATTTCGGACACCCCGCAGGGACTCGTTTTGGGATTCGCAC TGACTTCAAGGAAGGACGCGAACCCTTCTCTGACCCCAGCTCGGGCG GCCACCTGTCTTTGCCGCGGTGACCCTTCTCTC | 34016 |
| 5781 | GTTTACTTCCCCTGCCAGCATTGGGGTGCTCTCTAAGCAACAGTAGG CGGAGAGTGGTCTGGCGTATTAAAAACAAAGGATCGTCAAGTGGGC CTTCCCAGGCATTGCTTTGACTTAGTACATGTAGAGGATGTGGCAGT TCTCTCCGTCCCTGCCACTGCTGGTTTCTTTGTT | 34017 |
| 2930 | TATTTTAAGCCCAGTCTTCCCTGGGCCACCTTTAGCAGATCCTCGTGC GCCCCCGCCCCCTGGCCGTGAAACTCAGCCTCTATCCAGCAGCGACG ACAAGTAAAGTGGCCCGCCGGTTTCTGAGCCTTCTGCCCTGCGGGGA CACGGTCTGCACCCTGCCCGCGGCCACGGACC | 34018 |
| 3426 | CCAGCGGAAGTAATTCTTTCGACTGCCCCGGAACCCACCGGAGCAG GCAGCTGGGGTGGGGGGGCGGCCCTGGGATAGGGGCTGTGGCAGT ACGCGGGGACCCGGCTGCCGTGGCTGCGGGACTGACGAATGGAGAG GAGAAAACCTATGGTGGCTGTGAAGGACCTGATGCC | 34019 |

TABLE 2-continued

Illustrative Sequences Encoding IRES sequences

| Oligo-nucleotide Identifier | Sequence | SEQ ID NO: |
|---|---|---|
| 5800 | ATGGGGAAGGTGAAGGTCGGAGTCAACGGATTTGGTCGTATTGGGC GCCTGGTCACCAGGGCTGCTTTTAACTCTGGTAAAGTGGATATTGTT GCCATCAATGACCCCTTCATTGACCTCAACTACATGGTTTACATGTTC CAATATGATTCCACCCATGGCAAATTCCATGGC | 34020 |
| 27433 | CTGCCTCCCCCCCGCTCCCGCTCCCCTGAGCCCAGCCAGACCCCGCG CCGCCCGCGCCCCGCTCGACTCCGGAGGCTCCCGCAGCCCCGGCGTC CGCCCCGCTGCCCCCTCCCCCGGGGGCCATGGGGGCGCCCCCGGGCT ACCGGCCCTCAGCTTGGGTGCATCTCCTCCACC | 34021 |
| 424 | ATTTCTGGGAAGCAGTCGATATTATCTGTACGCCTAGAACAGTGCCC TCTGCAGCTGAATAACCCTTTTAACGAGTATTCCAAATTTGATGGCA AGGGTCATGTAGGTACAACAGCAACCAAGAAGATCGATGTCTACCT CCCTCTGCACTCGAGCCAGGACAGACTGCTGCCA | 34022 |
| 28259 | CTCTGGTGATACAGAAGAAAAGACAGTCTCCATTTTCAAACAGTCCC TCCTGGGAGAACACAGACAGGCAGAGGATTACAACACAAGGCAGCA AGCACTGGGAGACGAAAGTTTTGGCATCTGTTCCCTGGCTGTGCCAA GATGGGCGATTGGAGCTTCCTGGGAAATTTCCTG | 34023 |
| 6972 | GTCTACTATGTCTGAACTGTGGTTTCTTGTTTATCCTTTTTTCCTTAGT TGGACTGTAATGTATGGTCTGTCAACCTGTGAATCTTTAAAGTATGA TTCAGGTATTGTTGTATTCTTTACTGTGTAATAAAAAAGTTGAAAAA AATCTGGATCCTCTGTCTCCCTCGTCCCCGG | 34024 |
| 417 | TTTCGTGACCTTGTCCAGTAGAAGGCTATTTAATTTTCACAACTGCTT GAATTTTGACATACAAGATGAAGCAAGATGCCTCAAGAAATGCTGC CTACACTGTGGATTGTGAAGATTATGTGCATGTGGTAGAATTTAATC CCTTTGAGAATGGGGATTCAGGAAACCTAATTG | 34025 |
| 8182 | TGTCTGCACCAGCCGGCCTCCAGCCTGGCTGGACCCTGCTGCCTGTG TGGCCCGGAGCCAGAGGCCCCCACACTCCCAGCTGCTCTTCTACAGA TGCCATCAACGAGCAGGACTCTGGGTGGCTCCACTGTCTAAGGGCTC TGCGAGTGACCCGGCGGGCGAGCTCCGTGCTGC | 34026 |
| 7572 | CTTACGTAGTAATTACATTTCCTTGAAAAAACTATAGTGAATAGAAA TCCCTAGCCATTTCATTTTTTATGTTTTTAATGAAGATCTTTAAAATA CCATAGGTGGTAATCGTGGAAAATTTGAAAAATCTCATGTCAGTGTA TTAAGATGGTGGAGAAGTTTTTTTCTCCATTA | 34027 |
| 1415 | ATTCATGAAAATCCACTACTCCAGACAGACGGCTTTGGAATCCACCA GCTACATCCAGCTCCCTGAGGCAGAGTTGAGAATGGAGAGAATGTT ACCTCTCCTGGCTCTGGGGCTCTTGGCGGCTGGGTTCTGCCCTGCTGT CCTCTGCCACCCTAACAGCCCACTTGACGAGGA | 34028 |
| 7327 | GAGCTTCCAGGGATATTTGAGGCACCATCCCTGCCATTGCCGGGCAC TCGCGGCGCTGCTAACGGCCTGGTCACATGCTCTCCGGAGAGCTACG GGAGGGCGCTGGGTAACCTCTATCCGAGCCGCGGCCGCGAGGAGGA GGGAAAAGGCGAGCAAAAAGGAAGAGTGGGAGGA | 34029 |
| 705 | GCCCCCTCCCCTGACTATCAAAGCAGCGGCCGGCTGTTGGGGTCCAC CACGCCTTCCACCTGCCCCACTGCTTCTTCGCTTCTCTCTTGGAAAGT CCAGTCTCTCCTCGGCTTGCAATGGACCCCAACTGCTCCTGCGCCGC TGGTGTCTCCTGCACCTGCGCTGGTTCCTGCA | 34030 |
| 8561 | AGTCGCATAGTGGTTTTTCCGCTCGCGTCGCTGTGTGAAAGTTGGCT CGCCGCTCTTTGCACGCCCTCCCTGGAGGCCGACCCGAGACGCCAAG CTGGAGAGACCGTGCCTCCCCGAGGCCGGCCGCCCCGCGAGCACAG CCTCCGCCCCCGTTGCACTGCCGGGCTGGGCAAT | 34031 |
| 1679 | GGTGGCGGGAAGAGGAGGCGCGAGAATGGAGGTGGAGGCCGTCTG TGGTGGCGCGGGCGAGGTGGAGGCCCAGGACTCTGACCCTGCCCCT GCCTTCAGCAAGGCCCCCGGCAGCGCCGGCCACTACGAACTGCCGT GGGTTGAAAAATATAGGCCAGTAAAGCTGAATGAAAT | 34032 |
| 5635 | TATTTCCCTCTACTGAGTAAACCCTATCTGTGATTCCCCCAAACATCT GGCATGGCTCCCTTTTGTCCTTCCTGTGCCCTGCAAATATTAGCAAA GAAGCTTCATGCCAGGTTAGGAAGGCAGCATTCCATGACCAGAAAC AGGGACAAAGAAATCCCCCCTTCAGAACAGAGG | 34033 |

TABLE 2-continued

Illustrative Sequences Encoding IRES sequences

| Oligo-nucleotide Identifier | Sequence | SEQ ID NO: |
|---|---|---|
| 5583 | TGTTACTTAAGAATGCTTTCCAGGTGGAAAGTTCCTTAAGTTTGAGG CTTCAAATTCCATACAGCACATTAAAATCCCATTCATGAGTTTGAAA TACTGCTCTGTTGTCTTGGAAATACCAATCAGATTGTTGGCTGAAGT GATGTGGATAAAGAAGGGATCTTAGAAAAACTA | 34034 |
| 9027 | ACGAAGTTCCGGAAATGGAATTACCGAGTCAGATGAGAAACACAAG TCATCAATGAATTAACAAGCAACACATTGTCACATCCAGCTGTTGAA GAGTGGTTAACTCAGCTTGATCTCCGAAGACTCTTCTGCACCCCACC CCGCCCCCAACTGCTTTCCAAAGAGAAACAGAAA | 34035 |

The IRES may be of any length or size. For example, the TRES may be about 100 nucleotides to about 600 nucleotides in length (e.g., about 200, about 225, about 250, about 275, about 300, about 325, about 350, about 375, about 400, about 425, about 450, about 475, about 500, about 525, about 550, or about 575 nucleotides in length, or a range defined by any two of the foregoing values). In some embodiments, the TRES may be about 200 nucleotides to about 800 nucleotides in length (about 200, about 210, about 220, about 240, about 260, about 280, about 320, about 340, about 360, about 380, about 420, about 440, about 460, about 480, about 500, about 520, about 540, about 560, about 580, about 600, about 620, about 640, about 660, about 680, about 700, about 720, about 740, about 760, about 780, or about 800 nucleotides in length, or a range defined by any two of the foregoing values). In some embodiments, the IRES may be about 200 to about 400, about 400 to about 600, about 600 to about 700, or about 600 to about 800 nucleotides in length. In some embodiments, the IRES is about 210 nucleotides in length. In some embodiments, the IRES may be about 100 to about 3000 nucleotides in length.

In some embodiments, a circular RNA molecule comprises of an IRES sequence that consists of a sequence encoded by a DNA sequence of any one of SEQ ID NO: 1-228 or SEQ ID NO: 229-17201. In some embodiments, a circular RNA molecule comprises an IRES sequence encoded by a DNA sequence of any one of SEQ ID NO: 1-228 or SEQ ID NO: 229-17201, wherein the IRES sequence additionally comprises up to 1000 additional nucleotides. In some embodiments, the IRES sequence is encoded by a sequence of any one of SEQ ID NO: 1-228 or SEQ ID NO: 229-17201 and additionally comprises up to 1000 additional nucleotides located at the 5' end of that sequence. In some embodiments, the IRES sequence is encoded by a sequence of any one of SEQ ID NO: 1-228 or SEQ ID NO: 229-17201 and additionally comprises up to 1000 additional nucleotides located at the 3' end of that sequence. In some embodiments, the IRES sequence is encoded by a sequence of any one of SEQ ID NO: 1-228 or SEQ ID NO: 229-17201 and additionally comprises up to 1000 additional nucleotides located at the 5' end of that sequence and up to 1000 additional nucleotides located at the 5' end of that sequence.

In some embodiments, a circular RNA molecule comprises an internal ribosome entry site (IRES) sequence region, wherein the IRES sequence region comprises a sequence encoded by a DNA sequence of any one of SEQ ID NO: 1-228 or SEQ ID NO: 229-17201, and wherein the sequence encoded by a DNA sequence of any one of SEQ ID NO: 1-228 or SEQ ID NO: 229-17201 has a minimum free energy (MFE) of less than −18.9 kJ/mol and a melting temperature of at least 35.0° C.

In some embodiments, a circular RNA molecule comprises an internal ribosome entry site (IRES) sequence region, wherein the IRES sequence region comprises a sequence encoded by a DNA sequence of any one of SEQ ID NO: 1-228 or SEQ ID NO: 229-17201, and wherein the IRES sequence region has a minimum free energy (MFE) of less than −18.9 kJ/mol and a melting temperature of at least 35.0° C., over its entire length.

In some embodiments, a circular RNA molecule comprises an internal ribosome entry site (IRES) sequence region, wherein the IRES sequence region comprises a sequence encoded by a DNA sequence of any one of SEQ ID NO: 1-228 or SEQ ID NO: 229-17201, and additionally comprises up to 1000 additional nucleotides located at the 5' end of and up to 1000 additional nucleotides located at the 5' end, and wherein the IRES sequence region has a minimum free energy (MFE) of less than −18.9 kJ/mol and a melting temperature of at least 35.0° C., over its entire length.

In some embodiments, the recombinant circular RNA molecule comprises a protein-coding nucleic acid sequence operably linked to the IRES in a non-native configuration. Any protein or polypeptide of interest (e.g., a peptide, polypeptide, protein fragment, protein complex, fusion protein, recombinant protein, phosphoprotein, glycoprotein, or lipoprotein) may be encoded by the protein-coding nucleic acid sequence. In some embodiments, the protein coding-nucleic acid sequence encodes a therapeutic protein. Examples of suitable therapeutic proteins include cytokines, toxins, tumor suppressor proteins, growth factors, hormones, receptors, mitogens, immunoglobulins, neuropeptides, neurotransmitters, and enzymes. Alternatively, the protein-coding nucleic acid sequence can encode an antigen of a pathogen (e.g., a bacterium, virus, fungus, protist, or parasite), and the circRNA can be used as, or as one component of, a vaccine. Therapeutic proteins, and examples thereof, are further described in, e.g., Dimitrov, D. S., *Methods Mol Biol.*, 899: 1-26 (2012); and Lagasse et al., *F1000 Research,* 6: 113 (2017).

Ideally, the IRES is "in-frame" with respect to the protein-coding nucleic acid sequence, that is, the IRES is positioned in the circRNA molecule in the correct reading frame for the encoded protein. Examples of IRES elements that were found to be in-frame with one or more coding sequences are set forth in SEQ ID NO: 28984-32953. In some embodiments, however, the IRES may be "out of frame" with respect to the protein-coding nucleic acid sequence, such that the position of the IRES disrupts the ORF of the protein-coding nucleic acid sequence. In other embodiments, the IRES may overlap with one or more ORFs of the protein-coding nucleic acid sequence. In addition, while in some embodiments the protein-coding nucleic acid sequence comprises at least one stop codon, in other embodiments the protein-coding nucleic acid sequence may lack a stop codon. The instant inventors have found that a circRNA molecule comprising a protein-coding nucleic acid sequence having an in frame non-native IRES and lacking a stop codon can initiate a recursive (i.e., infinite loop) translation mechanism. Such recursive translation may produce a concatenated protein multimer (e.g., >200 kDa). This particular circRNA design allows for the production of repeating ORF units up to 10 times the size of the single ORF. Without being bound to any particular theory, use of the circRNAs described herein for recursive gene encoding may represent a novel "data compression" algorithm for genes, addressing the gene size limitation associated with many current gene therapy applications.

In some embodiments, the IRES comprises (i) at least one RNA secondary structure element and (ii) a sequence that is complementary to an 18S rRNA. In some embodiments, the IRES comprises (i) at least one RNA secondary structure element and (ii) a sequence that is complementary to an 18S rRNA, wherein the RNA secondary structure of the IRES is formed from the nucleotides at about position 40 to about position 60 of the IRES, wherein the first nucleic acid at the 5' end of the IRES is considered to be position 1. The relative location of the at least one RNA secondary structure and the sequence that is complementary to an 18S RNA may vary. For example, in some embodiments, the TRES comprises (i) at least one RNA secondary structure element and (ii) a sequence that is complementary to an 18S rRNA, and wherein the at least one RNA secondary structure is located 5' to the sequence that is complementary to an 18S rRNA (See FIG. 4K). In some embodiments, the IRES comprises (i) at least one RNA secondary structure element and (ii) a sequence that is complementary to an 18S rRNA, and wherein the at least one RNA secondary structure element is located 3' to the sequence that is complementary to an 18S rRNA (See FIG. 19B).

DNA Molecules, Vectors, and Cells

In some embodiments, the disclosure provides a DNA molecule comprising a nucleic acid sequence encoding any one of the recombinant circRNA molecules disclosed herein. Accordingly, described herein are DNA sequences that may be used to encode circular RNAs. In some embodiments, a DNA sequence encodes a circular RNA comprising an IRES. In some embodiments, a DNA sequence encodes a circular RNA comprising a protein-coding nucleic acid. In some embodiments, the DNA sequence encodes a circular RNA molecule; wherein the circular RNA molecule comprises a protein-coding nucleic acid sequence and an internal ribosome entry site (IRES) operably linked to the protein-coding nucleic acid sequence in a non-native configuration. In some embodiments, the DNA sequence encodes a protein coding-nucleic acid sequence, wherein the protein is a therapeutic protein.

The DNA sequences disclosed herein may, in some embodiments, comprise at least one non-coding functional sequence. For example, the non-coding functional sequence may be a microRNA (miRNA) sponge. A microRNA sponge may comprise a complementary binding site to a miRNA of interest. In some embodiments, a sponge's binding sites are specific to the miRNA seed region, which allows them to block a whole family of related miRNAs. In some embodiments, the miRNA sponge is selected from any one of the miRNA sponges shown in Table 3, below.

TABLE 3 miRNA sponges

| miRNA | Binding sites | Cell context |
|---|---|---|
| 92, empty | four bulged sites | rat cerebellar neuronal cultures |
| miR-155, empty | eight bulged sites | B cell lymphoma cell line |
| 15a, empty | two perfect sites | human prostate cell lines, xenograft |
| 113, empty | two perfect sites | mouse cardiac myocytes, heart |
| 326, empty | seven bulged sites | tail vein injection, TH cells |
| 16, 20, 21, 30-5p, CXCR4 | four to nine bulged sites | mammalian cell lines |
| 16, 20, CXCR4 | four to nine bulged sites | mammalian cell lines |
| let-7, 22, 124, 125, 132, 143, empty | five to seven bulged sties | rat hippocampal neuronal cultures |
| 183, CXCR4 | seven bulged sites | HEK293T cell line |
| A.t. 156, 319, empty | one bulged site | transgenic *Arabidopsis* plants |
| 16, CXCR4 | seven to nine bulged sites | human multiple myeloma cell lines, xenograft |
| 16, 23a, 142-3p. 221, 223, nonspecific | tour perfect or tour bulged sites | U937 cell line, mouse hematopoietic stem/progenitor cells, transplant |
| KSHV miR-K1, CXCR4, empty | nine bulged sites | BC-3 B cell lymphoma cell line |
| 21, 140-3p, 140-5p, empty | one to two perfect sites | mammalian cell lines |
| 133, empty | three perfect sites | mouse cardiac myocytes |
| 204, 211, empty | two perfect sites | ST2 cell line, osteogenic and adipogenic differentiation |
| 96/182/183, empty | four bulged sites each | mouse retina |
| let-7, 16, empty | sixto nine bulged sites | lung cancer cell line |
| D.m. 7, 8, 9a, 276a | 10 bulged sites | Transgenic fruitflies |
| 9, 10b, CXCR4 | eight bulged sites | 4T1 breast cancer cell line, xenograft |
| herpesvirus miR-K12-7, K12-8, BARTI-5p, BART4, empty | six bulged sites | human B cell lines |

TABLE 3-continued miRNA sponges

| miRNA | Binding sites | Cell context |
| --- | --- | --- |
| 144, 451, empty | tour perfect sites | mouse hematopoietic stem/progenitor cells, transplant |
| let-7, 29, 125, let-7/125, 128, empty | 16 bulged sites | neural stem cells |
| 21, empty | two perfect sites | mouse cardiocytes |
| 18a, 19b, 20a, nonspecific | one perfect site | K662 cell line |
| 145/146, empty | eight to nine bulged sites each | mouse hematopoietic stem/progenitor cells, transplant |
| 31, CXCR4 | seven bulged sites | MCF7-Ras breast cancer cell line, xenograft |

In some embodiments, the non-coding sequence may be an RNA binding protein site. RNA binding proteins and binding sites therefore are listed in numerous databases known to those of skill in the art, including RBPDB (rbpdb.ccbr.utoronto.ca). In some embodiments, the RNA binding protein comprises one or more RNA-binding domains, selected from RNA-binding domain (RBD, also known as RNP domain and RNA recognition motif, RRM), K-homology (KH) domain (type I and type II), RGG (Arg-Gly-Gly) box, Sm domain; DEAD/DEAH box (SEQ ID NOs: 34036 and 34037), zinc finger (ZnF, mostly C-x8-X-x5-X-x3-H (SEQ ID NO: 34038)), double stranded RNA-binding domain (dsRBD), cold-shock domain; Pumilio/FBF (PUF or Pum-HD) domain, and the Piwi/Argonaute/Zwille (PAZ) domain.

In some embodiments, the DNA sequence comprises an aptamer. Aptamers are short, single-stranded DNA molecules that can selectively bind to a specific target. The target may be, for example, a protein, peptide, carbohydrate, small molecule, toxin, or a live cell. Some aptamers can bind DNA, RNA, self-aptamers or other non-self aptamers. Aptamers assume a variety of shapes due to their tendency to form helices and single-stranded loops. Illustrative DNA and RNA aptamers are listed in the Aptamer database (scicrunch.org/resources/Any/record/nlx_144509-1/SCR_001781/resolver?q=*&l=).

In some embodiments, the DNA sequence encodes a circular RNA molecule that comprises between about 200 nucleotides and about 10,000 nucleotides.

In some embodiments, the DNA sequence encodes a circular RNA molecule that comprises a spacer between the IRES and a start codon of the protein-coding nucleic acid sequence. The spacer may be of any length. For example, in some embodiments, the length of the spacer is selected to optimize translation of the protein-coding nucleic acid sequence.

In some embodiments, the DNA sequence encodes a circular RNA molecule comprising an IRES that is configured to promote rolling circle translation. In some embodiments, the DNA sequence encodes a circular RNA comprising a protein-coding nucleic acid sequence that lacks a stop codon. In some embodiments, the DNA sequence encodes a circular RNA molecule comprising (i) an IRES that is configured to promote rolling circle translation, and (ii) a protein-coding nucleic acid sequence that lacks a stop codon.

The DNA sequences described herein may be comprised in one or more vectors. For example, in some embodiments, a viral vector comprises a DNA sequence encoding a circular RNA. The viral vector may be, for example, an adeno-associated virus (AAV) vector, an adenovirus vector, a retrovirus vector, a lentivirus vector, a vaccinia or a herpesvirus vector.

In some embodiments, the viral vector is an AAV. As used herein, the term "adeno-associated virus" (AAV), includes but is not limited to, AAV1, AAV2, AAV3 (including types 3 A and 3B), AAV4, AAV5, AAV6, AAV7, AAV8, AAV9, AAV10, AAV11, AAV12, avian AAV, bovine AAV, canine AAV, equine AAV, ovine AAV, and any other AAV now known or later discovered. In some embodiments, the AAV vector may be a modified form (i.e., a form comprising one or more amino acid modifications relative thereto) of one or more of AAV1, AAV2, AAV3 (including types 3 A and 3B), AAV4, AAV5, AAV6, AAV7, AAV8, AAV9, AAV10, AAV11, AAV12, avian AAV, bovine AAV, canine AAV, equine AAV, or ovine AAV. Various AAV serotypes and variants thereof are described, e.g., BERNARD N. FIELDS et al, VIROLOGY, volume 2, chapter 69 (4th ed., Lippincott-Raven Publishers). A number of relatively new AAV serotypes and clades have been identified (see, e.g., Gao et al. (2004) J Virology 78:6381-6388; Moris et al. (2004) Virology 33:375-383). The genomic sequences of various serotypes of AAV, as well as the sequences of the native terminal repeats (TRs), Rep proteins, and capsid subunits are known in the art. Such sequences may be found in the literature or in public databases such as the GenBank® Database. See, e.g., GenBank Accession Numbers NC_044927, NC_002077, NC_001401, NC_001729, NC 001863, NC 001829, NC_001862, NC_000883, NC_001701, NC_001510, NC_006152, NC_006261, AF063497, U89790, AF043303, AF028705, AF028704, J02275, JO 1901, J02275, X01457, AF288061, AH009962, AY028226, AY028223, NC 001358, NC 001540, AF513851, AF513852, AY530579; the disclosures of which are incorporated by reference herein for teaching parvovirus and AAV nucleic acid and amino acid sequences. See also, e.g., Srivistava et al. (1983) J Virology 45:555; Chiorini et al. (1998) J. Virology 71:6823; Chiorini et al (1999) J Virology 73:1309; Bantel-Schaal et al. (1999) J. Virology 73:939; Xiao et al. (1999) J. Virology 73:3994; Muramatsu et al. (1996) Virology 221: 208; Shade et al. (1986) J Virol. 58:921; Gao et al. (2002) Proc. Nat. Acad. Sci. USA 99: 1 1854; Moris et al. (2004) Virology 33:375-383; international patent publications WO 00/28061, WO 99/61601, WO 98/11244; and U.S. Pat. No. 6,156,303; the disclosures of which are incorporated by reference herein.

In some embodiments, a DNA sequence described herein is comprised in an AAV2 vector, or a variant thereof. In some embodiments, a DNA sequence described herein is comprised an AAV4 vector, or a variant thereof. In some embodiments, a DNA sequence described herein is comprised in an AAV8 vector, or a variant thereof. In some embodiments, a DNA sequence described herein is comprised in an AAV9 vector, or a variant thereof.

In some embodiments, a DNA sequence described herein is comprised in a viral-like particle (VLP). Viral like particles are molecules that closely resemble viruses, but are non-infectious because they contain little or no viral genetic material. They can be naturally occurring or synthesized through the individual expression of viral structural proteins, which can then self-assemble into a virus-lie structure. Combinations of structural capsid proteins from different viruses can be used to create VLPs. For example VLPs may be derived from the, AAVs, retrovirus, Flaviviridae, paramyoxoviridae, or bacteriophages. VLPs can be produced in multiple cell culture systems, including bacteria, mammalian cell lines, insect cell lines, yeast and plant cells.

In some embodiments, a DNA sequence described herein is comprised in a non-viral vector. The non-viral vector may be, for example, a plasmid comprises the DNA sequence. In some embodiments, the non-viral vector is a closed-ended DNA. A closed-ended DNA is a non-viral, capsid-free DNA vector with covalently closed ends (see, e.g., WO2019/169233). In some embodiments, a mini-intronic plasmid vector comprises a DNA sequence described herein. Mini-intronic plasmids are expression systems that contain a bacterial replication origin and selectable marker maintaining the juxtaposition of the 5' and the 3' ends of transgene expression cassette as in a minicircle (see, e.g., Lu, J., et al., Mol Ther (2013) 21(5) 954-963).

In some embodiments, a DNA sequence described herein is comprised in a lipid nanoparticle. Lipid nanoparticles (or LNPs) are submicron-sized lipid emulsions, and may offer one or more of the following advantages: (i) control and/or targeted drug release, (ii) high stability, (iii) biodegradability of the lipids used, (iv) avoid organic solvents, (v) easy to scale-up and sterilize, (vi) less expensive than polymeric/surfactant based carriers, (vii) easier to validate and gain regulatory approval. In some embodiments, the lipid nanoparticles range in diameter between about 10 and about 1000 nm.

In some embodiments, a DNA sequence encodes a circular RNA molecule, wherein the circular RNA molecule comprises a protein-coding nucleic acid sequence and an internal ribosome entry site (IRES) operably linked to the protein-coding nucleic acid sequence in a non-native configuration wherein the IRES comprises: at least one RNA secondary structure; and a sequence that is complementary to an 18S ribosomal RNA (rRNA).

In some embodiments, a DNA sequence encodes a circular RNA molecule, wherein the circular RNA molecule comprises a protein-coding nucleic acid sequence and an internal ribosome entry site (IRES) operably linked to the protein-coding nucleic acid sequence in a non-native configuration wherein the IRES comprises: at least one RNA secondary structure element; and a sequence that is complementary to an 18S ribosomal RNA (rRNA); wherein the IRES has a minimum free energy (MFE) of less than −18.9 kJ/mol and a melting temperature of at least 35.0° C.; and wherein the RNA secondary structure element is formed from the nucleotides at about position 40 to about position 60 of the IRES, wherein the first nucleic acid at the 5' end of the IRES is considered to be position 1.

In some embodiments, a DNA sequence comprises a nucleic acid sequence encoding a circular RNA molecule; wherein the circular RNA molecule comprises a protein-coding nucleic acid sequence and an internal ribosome entry site (IRES) operably linked to the protein-coding nucleic acid sequence in a non-native configuration; wherein the IRES is encoded by any one of the nucleic acid sequences listed of SEQ ID NO: 1-228 or SEQ ID NO: 229-17201, or a nucleic acid sequence that is at least 90% or at least 95% identical thereto.

Also provided herein are cells comprising a recombinant circRNA molecule, a DNA molecule, or a vector described herein. Any prokaryotic or eukaryotic cell that can be contacted with and stably maintain the recombinant circRNA molecule, DNA molecule encoding the recombinant circRNA molecule, or vector comprising the recombinant circRNA molecule may be used in the context of the present disclosure. Examples of prokaryotic cells include, but are not limited to, cells from the genera *Bacillus* (such as *Bacillus subtilis* and *Bacillus brevis*), *Escherichia* (such as *E. coli*), *Pseudomonas, Streptomyces, Salmonella*, and *Erwinia*. In some embodiments, the host cell is a eukaryotic cell. Suitable eukaryotic cells are known in the art and include, for example, yeast cells, insect cells, and mammalian cells. Examples of yeast cells include those from the genera *Hansenula, Kluyveromyces, Pichia, Rhinosporidium, Saccharomyces*, and *Schizosaccharomyces*. Suitable insect cells include Sf-9 and HIS cells (Invitrogen, Carlsbad, Calif.) and are described in, for example, Kitts et al., *Biotechniques,* 14: 810-817 (1993); Lucklow, *Curr. Opin. Biotechnol.,* 4: 564-572 (1993); and Lucklow et al., *J. Virol.,* 67: 4566-4579 (1993).

In some embodiments, the cell is a mammalian cell. A number of mammalian cells are known in the art, many of which are available from the American Type Culture Collection (ATCC, Manassas, Va.). Examples of mammalian cells include, but are not limited to, HeLa cells, HepG2 cells, Chinese hamster ovary cells (CHO) (e.g., ATCC No. CCL61), CHO DHFR-cells (Urlaub et al., *Proc. Natl. Acad. Sci. USA,* 97: 4216-4220 (1980)), human embryonic kidney (HEK) 293 or 293T cells (e.g., ATCC No. CRL1573), and 3T3 cells (e.g., ATCC No. CCL92). Other mammalian cell lines are the monkey COS-1 (e.g., ATCC No. CRL1650) and COS-7 cell lines (e.g., ATCC No. CRL1651), as well as the CV-1 cell line (e.g., ATCC No. CCL70). Further exemplary mammalian host cells include primate cell lines and rodent cell lines, including transformed cell lines. Normal diploid cells, cell strains derived from in vitro culture of primary tissue, as well as primary explants also are suitable. Other mammalian cell lines include, but are not limited to, mouse neuroblastoma N2A cells, HeLa, mouse L-929 cells, and BHK or HaK hamster cell lines, all of which are available from the American Type Culture Collection (ATCC; Manassas, Va.). Methods for selecting mammalian cells and methods for transformation, culture, amplification, screening, and purification of such cells are well known in the art (see, e.g., Ausubel et al., supra). In some embodiments, the mammalian cell is a human cell.

Method of Producing a Protein

The disclosure further provides a method of producing a protein in a cell, which comprises contacting a cell with the above-described recombinant circular RNA molecule, the above-described DNA molecule comprising a nucleic acid sequence encoding the recombinant circRNA molecule, or a vector comprising the recombinant circRNA molecule under conditions whereby the protein-coding nucleic acid sequence is translated and the protein is produced in the cell.

In some embodiments, a method of producing a protein in a cell comprises contacting a cell with a DNA sequence described herein, or a vector comprising the DNA sequence, under conditions whereby the protein-coding nucleic acid sequence is translated and the protein is produced in the cell. Also provided is a protein produced by the disclosed methods.

In some embodiments, production of the protein is tissue-specific. For example, the protein may be selectively produced in one or more of the following tissues: muscle, liver, kidney, brain, lung, skin, pancreas, blood, or heart.

In some embodiments, the protein is expressed recursively in the cell.

In some embodiments, the half-life of the circular RNA in the cell is about 1 to about 7 days. For example, the half-life of the circular RNA may be about 1, about 2, about 3, about 4, about 5, about 6, about 7, or more days.

In some embodiments, the protein is produced in the cell for at least about 10%, at least about 20%, or at least about 30% longer than if the protein-coding nucleic acid sequence is provided to the cell using a viral vector encoding a linear RNA or as a linear RNA.

In some embodiments, the protein is produced in the cell at a level that is at least about 10%, at least about 20%, or at least about 30% higher than if the protein-coding nucleic acid sequence is provided to the cell using a viral vector or as a linear RNA.

Use of the IRES sequences described herein to express a protein from a circular RNA may, in some embodiments, allow for continued expression of a protein from the circular RNA in a cell even under stress conditions. In response to one or more stress conditions, production of proteins from linear RNA is often suppressed. Accordingly, in some embodiments, circRNA can be used as an alternative for production of proteins from linear RNAs during stress conditions. In some embodiments, a protein expressed from a circular RNA in a cell is expressed under one or more stress conditions. In some embodiments, expression of a protein from a circular RNA in a cell is not substantially disrupted when the cell is exposed to one or more stress conditions. For example, exposure of the cell to one or more stress conditions may change expression of a protein from a circular RNA by less than 15%, less than 10%, less than 5%, less than 3%, less than 1%, or less than 0.5%. In some embodiments, a protein expressed from a circular RNA is expressed at a level under one or more stress conditions that is substantially the same as the level expressed in the same cell in the absence of the one or more stress conditions. In some embodiments, the level of expression of a protein from a circular RNA in a cell is at least about 70%, at least about 75%, at least about 80%, at least about 85%, at least about 90%, at least about 95%, or at least about 99%, relative to the level of expression in the absence of the one or more stress conditions. A non-limiting list of conditions which may cause cellular stress include changes in temperature (including exposure to extreme temperatures and/or heat shock), exposure to toxins (including viral or bacterial toxins, heavy metals, etc.), exposure to electromagnetic radiation, mechanical damage, viral infection, etc.

In some embodiments, the circRNAs described herein (including components thereof, such as the IRES sequences) facilitate cap-independent translation activity from the circRNA. Canonical translation via a cap-independent mechanism may be reduced in some human diseases. Accordingly, the use of circRNAs to express proteins may be particularly helpful for treating such diseases. In some embodiments, use of the circRNAs described herein facilitates cap-independent translation activity from the circRNA under conditions wherein cap-dependent translation is reduced or turned-off in a cell.

As discussed above, translation of the protein-coding nucleic acid sequence may occur in an infinite loop (i.e., recursively) when the IRES is in-frame with the protein-coding nucleic acid sequence and the protein-coding sequence lacks a stop codon. Thus, in some embodiments, the method of producing a protein in a cell produces a concatenated protein.

Any prokaryotic or eukaryotic host cell described herein may be contacted with the recombinant circRNA molecule or a vector comprising the circRNA molecule. The host cell may be a mammalian cell, such as a human cell. In some embodiments, the cell is in vivo. In some embodiments, the cell is in vitro. In some embodiments, the cell is ex vivo. In some embodiments, the cell is in a mammal, such as a human.

In some embodiments, regardless of cell type chosen, 5' cap-dependent translation is impaired in the cell (e.g., decreased, reduced, inhibited, or completely obliterated). In some embodiments, there is no substantial 5' cap-dependent translation in the cell.

The recombinant circular RNA molecule, a DNA molecule encoding same, or vectors comprising same, may be introduced into a cell by any method, including, for example, by transfection, transformation, or transduction. The terms "transfection," "transformation," and "transduction" are used interchangeably herein and refer to the introduction of one or more exogenous polynucleotides into a host cell by using physical or chemical methods. Many transfection techniques are known in the art and include, for example, calcium phosphate DNA co-precipitation (see, e.g., Murray E. J. (ed.), *Methods in Molecular Biology*, Vol. 7, Gene Transfer and Expression Protocols, Humana Press (1991)); DEAE-dextran; electroporation; cationic liposome-mediated transfection; tungsten particle-facilitated microparticle bombardment (Johnston, *Nature*, 346: 776-777 (1990)); strontium phosphate DNA co-precipitation (Brash et al., Mol. Cell. Biol., 7: 2031-2034 (1987); and magnetic nanoparticle-based gene delivery (Dobson, J., *Gene Ther*, 13 (4): 283-7 (2006)).

Naked RNA, DNA molecules encoding circular RNA molecules, or vectors comprising the circular RNAs or DNAs encoding circular RNAs may be administered to cells in the form of a composition. In some embodiments, the composition comprises a pharmaceutically acceptable carrier. The choice of carrier will be determined in part by the particular circular RNA molecule, DNA sequence, or vector and type of cell (or cells) into which the circular RNA molecule, DNA sequence, or vector is introduced. Accordingly, a variety of formulations of the composition are possible. For example, the composition may contain preservatives, such as, for example, methylparaben, propylparaben, sodium benzoate, and benzalkonium chloride. A mixture of two or more preservatives optionally may be used. In addition, buffering agents may be used in the composition. Suitable buffering agents include, for example, citric acid, sodium citrate, phosphoric acid, potassium phosphate, and various other acids and salts. A mixture of two or more buffering agents optionally may be used. Methods for preparing compositions for pharmaceutical use are known to those skilled in the art and are described in more detail in, for example, *Remington: The Science and Practice of Pharmacy*, Lippincott Williams & Wilkins; 21st ed. (May 1, 2005).

In some embodiments, the composition containing the recombinant circular RNA molecule, DNA sequence, or vector, can be formulated as an inclusion complex, such as cyclodextrin inclusion complex, or as a liposome. Liposomes can be used to target host cells or to increase the half-life of the circular RNA molecule. Methods for preparing liposome delivery systems are described in, for example, Szoka et al., *Ann. Rev. Biophys. Bioeng.*, 9: 467 (1980), and U.S. Pat. Nos. 4,235,871; 4,501,728; 4,837,028; and 5,019,369. The recombinant circRNA molecule may also be formulated as a nanoparticle.

A host cell can be contacted in vivo or in vitro with a recombinant circRNA molecule, a DNA sequence, or a vector, or compositions containing any of the foregoing. The term "in vivo" refers to a method that is conducted within living organisms in their normal, intact state, while an "in vitro" method is conducted using components of an organism that have been isolated from its usual biological context. When the method is conducted in vivo, in some embodiments the production of the protein is tissue-specific. By "tissue-specific" is meant that the protein is produced in only a subset of tissue types within an organism, or is produced at higher levels in a subset of tissue types relative to the baseline expression across all tissue types. The protein may be produced in any tissue type, such as, for example, tissues of muscle, liver, kidney, brain, lung, skin, pancreas, blood, or heart.

Inhibiting circRNA Translation

The disclosure also provides an oligonucleotide molecule comprising a nucleic acid sequence that hybridizes to an internal ribosome entry site (IRES) present on a circular RNA molecule and inhibits translation of the circular RNA molecule. In some embodiments, the circular RNA molecule is a naturally occurring circular RNA molecule. In some embodiments, the circular RNA molecule is a recombinant circular RNA molecule, such as the recombinant circRNA molecule described herein. In some embodiments, the recombinant circRNA molecule may comprise a protein-coding nucleic acid sequence and an IRES operably linked to the protein-coding nucleic acid sequence (optionally, in a non-native configuration), wherein the IRES comprises at least one RNA secondary structure; and a sequence that is complementary to an 18S ribosomal RNA (rRNA); and wherein the IRES has a minimum free energy (MFE) of less than −18.9 kJ/mol and a melting temperature of at least 35.0° C., as described herein. In some embodiments, the recombinant circRNA molecule may comprise a protein-coding nucleic acid sequence and an IRES operably linked to the protein-coding nucleic acid sequence (optionally, in a non-native configuration); wherein the IRES is encoded by any one of the nucleic acid sequences listed in SEQ ID NO: 1-228 or SEQ ID NO: 229-17201, or a nucleic acid sequence that is at least 90% or at least 95% identical thereto.

The oligonucleotide that hybridizes to the IRES on a recombinant circRNA molecule may be of any type and size. In some embodiments, the oligonucleotide may be about 8 to about 80 nucleotides in length, such as about 15 to about 30 nucleotides in length. In some embodiments, the oligonucleotide may be about 20, about 22, or about 24 nucleotides in length. In some embodiments, the oligonucleotide may be an antisense oligonucleotide (also referred to as "ASO"). The term "antisense oligonucleotide," as used herein, refers to a short, synthetic, single-stranded oligodeoxynucleotide or oligodeoxyribonucleotide which is complementary to a target RNA sequence and can reduce, restore, or modify protein expression through several distinct mechanisms (Rinaldi, C., Wood, M., *Nat Rev Neurol*, 14: 9-21 (2018); Crooke, S. T., *Nucleic Acid Ther.*, 27: 70-77 (2017); and Chan et al., *Clin. Exp. Pharmacol. Physiol.* 33: 533-540 (2006)). In some embodiments, the antisense oligonucleotide may be a locked nucleic acid oligonucleotide (LNA). The term "locked nucleic acid (LNA)" refers to oligonucleotides that contain one or more nucleotide building blocks in which an extra methylene bridge fixes the ribose moiety either in the C3'-endo (beta-D-LNA) or C2'-endo (alpha-L-LNA) conformation (Grünweller A, Hartmann R K, *BioDrugs*, 21(4): 235-243 (2007)). In some embodiments, the oligonucleotide is a small interfering RNA (siRNA), small hairpin RNA (shRNA), CRISPR (sgRNA), or micro RNA (miRNA).

The oligonucleotide may comprise one or more modifications that enhance hybridization of the oligonucleotide to the IRES of the circRNA molecule and/or inhibition of translation of the circRNA molecule. The modification may be at the 5' or at the 3' end of the oligonucleotide. Suitable modifications include, but are not limited to, a modified internucleoside linkage, a modified sugar, or a modified nucleobase. In some embodiments, the oligonucleotide may be conjugated to a fluorophore (e.g., Cy3, FAM, Alexa 488, etc.) or to another molecule (e.g., biotin, alkaline phosphatase, antibody, nucleic acid aptamer, peptide, etc.). In some embodiments, the oligonucleotide may be labeled with a peptide or protein, for example using CLICK chemistry. It will be appreciated that the naturally occurring internucleoside linkage of RNA and DNA is a 3' to 5' phosphodiester linkage. Oligonucleotides having one or more modified, i.e. non-naturally occurring, internucleoside linkages are known to exhibit desirable properties such as, for example, enhanced cellular uptake, enhanced affinity for target nucleic acids, and increased stability in the presence of nucleases. Modified internucleoside linkages include, for example, internucleoside linkages that retain a phosphorus atom as well as internucleoside linkages that do not have a phosphorus atom. Representative phosphorus-containing internucleoside linkages include, but are not limited to, phosphodiesters, phosphotriesters, methylphosphonates, phosphoramidate, and phosphorothioates. Methods of preparing phosphorous-containing and non-phosphorous-containing linkages are well known.

In some embodiments, the oligonucleotide molecule may comprise a modified backbone. Oligonucleotides having modified backbones include those that retain a phosphorus atom in the backbone and those that do not have a phosphorus atom in the backbone. Modified oligonucleotides that do not have a phosphorus atom in their internucleoside backbone may be referred to as "oligonucleosides." Examples of modified oligonucleotide backbones include, but are not limited to, phosphorothioates, chiral phosphorothioates, phosphorodithioates, phosphotriesters, aminoalkylphosphotri-esters, methyl and other alkyl phosphonates including 3'-alkylene phosphonates, 5'-alkylene phosphonates and chiral phosphonates, phosphinates, phosphoramidates including 3'-amino phosphoramidate and aminoalkylphosphoramidates, thiono-phosphoramidates, thionoalkylphosphonates, thionoalkylphospho-triesters, selenophosphates and boranophosphates having normal 3'-5' linkages, 2'-5' linked analogs of these, and those having inverted polarity wherein one or more internucleotide linkages is a 3' to 3', 5' to 5', or 2' to 2' linkage.

The oligonucleotide molecule may further comprise one or more nucleotides having modified sugar moieties. Sugar modifications may impart nuclease stability, binding affinity or some other beneficial biological property to the oligonucleotide. The furanosyl sugar ring of a nucleoside can be modified in a number of ways including, but not limited to, addition of a substituent group, particularly at the 2' position; bridging of two non-geminal ring atoms to form a bicyclic nucleic acid (BNA); and substitution of an atom or group such as —S—, —N(R)— or —C(R$^1$)(R$^2$) for the ring oxygen at the 4'-position. Modified sugars include, but are not limited to: substituted sugars, especially 2'-substituted sugars having a 2'-F, 2'-OCH$_2$ (2'-OMe) or a 2'-O(CH$_2$)2-OCH$_3$ (2'-O-methoxyethyl or 2'-MOE) substituent group; and bicyclic modified sugars (BNAs), having a 4'-(CH$_2$)n-O-2' bridge, where n=1 or n=2. Methods for the preparation of modified sugars are well known to those skilled in the art.

In some embodiments, the oligonucleotide may be chemically modified at its 5' and/or its 3' end. In other words, one or more moieties may be chemically (e.g., covalently) linked to the 5' and/or 3' end of the oligonucleotide molecule. Such modifications include, for example, chemical linkage of protein or sugar moieties to the 5' and/or 3' end of the oligonucleotide molecule. Other modifications that enhance oligonucleotide affinity for target nucleic acids and/or increase oligonucleotide stability are known in the art (see, e.g., U.S. Patent Application Publication US 2019/0323013) and may be employed in the context of the present disclosure.

The disclosure also provides a method of inhibiting translation of a protein-coding nucleic acid sequence present on a circular RNA molecule, which method comprises contacting the circular RNA molecule with the above-described oligonucleotide molecule, whereby the oligonucleotide molecule hybridizes to the RNA secondary structure and/or the nucleic acid sequence complementary to 18S rRNA present on the IRES of the circular RNA molecule and inhibits translation of the circular RNA molecule.

In some embodiments, the oligonucleotide can hybridize to either the RNA secondary structure element or the nucleic acid sequence that is complementary to 18S rRNA present on the IRES. In other embodiments, the oligonucleotide can hybridize to both the RNA secondary structure element and the nucleic acid sequence that is complementary to 18S rRNA. For example, a first oligonucleotide may hybridize to the RNA secondary structure element and a second oligonucleotide may hybridize to the nucleic acid sequence that is complementary to 18S rRNA. Alternatively, a single oligonucleotide may hybridize to both the RNA secondary structure element and the nucleic acid sequence that is complementary to 18S rRNA present on the IRES. Appropriate hybridization stringency conditions are described herein.

Also provided is a composition comprising (i) a DNA sequence disclosed herein and a (ii) non-coding circular RNA, or a DNA sequence encoding the same. The DNA sequence may encode a circRNA. In some embodiments, the non-coding circular RNA may comprise one or more of a binding site for an RNA binding protein, an aptamer, or a miRNA sponge. In some embodiments, the non-coding circular RNA may have one or more functions, such as sponging miRNAs, regulating mRNA splicing machinery, sequestering RNA-binding proteins (RBPs), regulating RBP interaction, or activating immune responses.

Also provided is a method of delivering a non-coding circular RNA to a cell, the method comprising contacting the cell with a composition comprising (i) a DNA sequence disclosed herein and a (ii) non-coding circular RNA, or a DNA sequence encoding the same, thereby delivering the non-coding circular RNA to the cell.

The following examples further illustrate the invention but, of course, should not be construed as in any way limiting its scope.

EXAMPLES

The following examples describe the development of a high-throughput screen to systematically identify and quantify RNA sequences that can direct circRNA translation. Over 17,000 circRNA internal ribosome entry sites (IRES) were identified and validated, and it was shown that 18S rRNA complementarity and a structured RNA element on the IRES are important for facilitating circRNA cap-independent translation. With genomic and peptidomic analyses of the IRES, nearly 1,000 putative endogenous protein-coding circRNAs were identified, along with hundreds of translational units encoded by these circRNAs. circFGFR1p, a protein encoded by circFGFR1, was also characterized. This protein functions as a negative regulator of FGFR1 to suppress cell growth under stress conditions.

Example 1

This example describes the systematic identification of RNA sequences that facilitate cap-independent circRNA translation. Canonical translation via a cap-independent mechanism may be reduced in numerous human diseases. Accordingly, the use of circRNAs to express proteins may be particularly helpful for treating such diseases.

To systematically identify the RNA sequence that can facilitate cap-independent translation on circRNAs, an oligo-split-eGFP-circRNA reporter construct was developed that allows for screening and quantifying the cap-independent translation activity of synthetic oligonucleotide inserts ("oligos" hereafter) on circRNA in a high-throughput manner (FIG. 1A). Specifically, the construct contains a bicistronic mRuby reporter followed by a permuted split-eGFP reporter flanked by human ZKSCAN1 introns, where during transcription, the pre-mRNA of the construct will undergo spliceosome-mediated back-splicing and reconstitute full-length eGFP on the circRNA. Because full-length eGFP is only reconstituted upon back-splicing, the eGFP fluorescence signal can only come from the circRNA through cap-independent translation. A synthetic oligonucleotide library was then cloned into the construct to drive the expression of eGFP reporter (FIG. 1A). The library contained 55,000 oligos of sequences from the reported IRESs in the IRESite database (including human and non-human IRES; see Mokrejš et al., Nucleic acids research 38, D131-D136 (2009)), the native 5' untranslated region (5' UTR) of viral and human genes, and the native and synthetic sequences from viral and human transcripts (FIG. 1A). Library design is detailed in Weingarten-Gabbay et al., Science 351, aad4939 (2016). For the viral and human transcripts, genes were selected that have been reported to remain associated with polysomes when the cap-dependent translation was suppressed and the genes with alternative isoforms that differ in their translation start site (FIG. 1A).

Figures 8A, 8B:
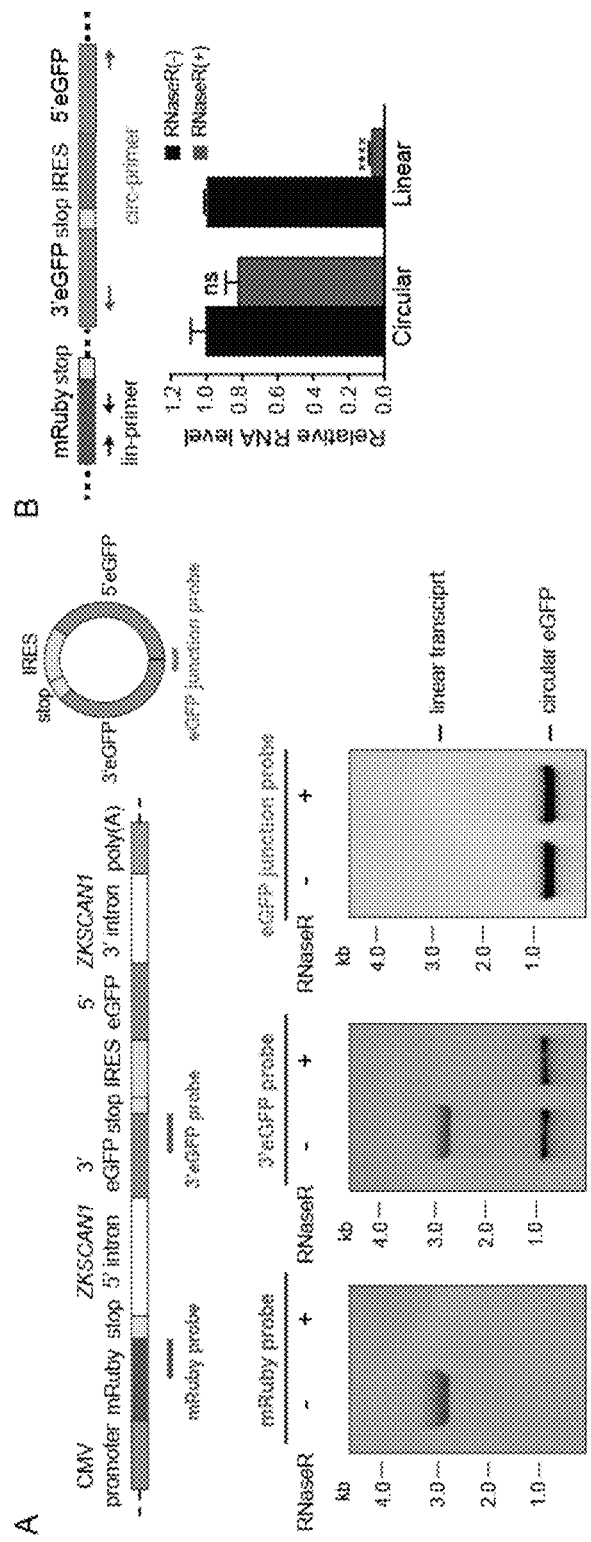
FIG. 8A-8C show that the oligo-split-eGFP-circRNA reporter construct does not generate eGFP signal from trans-splicing.
Figure 8C:
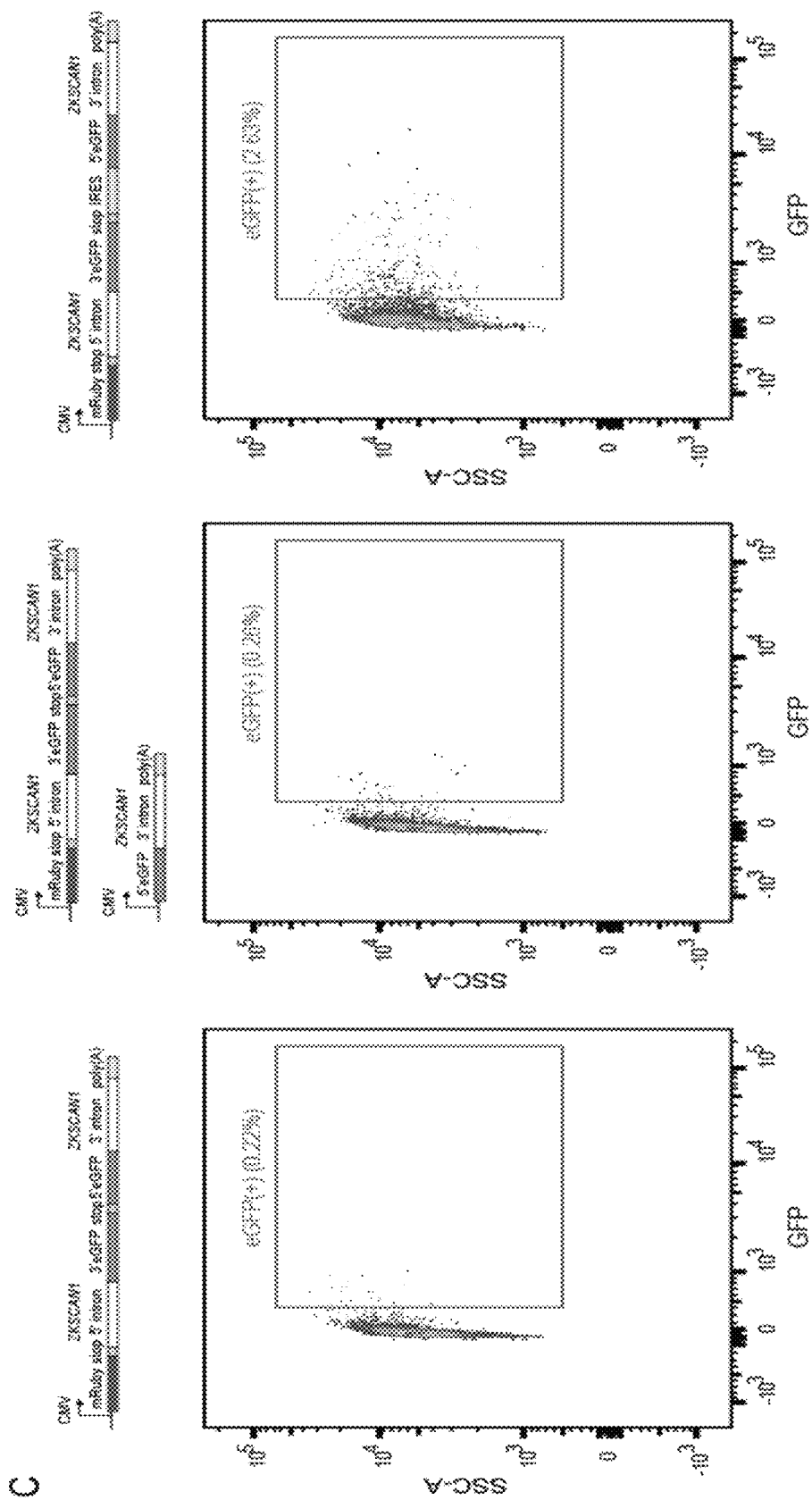

Two well-known concerns for bicistronic IRES screens are cryptic promoters or splice sites that activate transcription or readthrough of the downstream open reading frame (ORF), respectively. The design used herein obviates both concerns because ectopic transcription of only the 5' fragment of the split-eGFP cannot produce fluorescence signal. Northern blots, quantitative reverse transcription polymerase chain reaction (qRT-PCR), RNase R treatment, and reporter gene experiments confirmed that the eGFP signal detected did not come from trans-splicing or the nicking of the eGFP circRNA (FIG. 8A-8C). The reporter produces a ~3000 nucleotide (nt) primary linear transcript and a ~900 nt eGFP circRNA; RNase R exonuclease treatment can efficiently remove the linear transcript but not the circRNA (FIG. 8A). The mRuby gene allowed for normalization for transduction efficiency by translation of a regular linear mRNA. Following transfection into human embryonic kidney (HEK) 293T cells, the transfected cells were sorted by the ratio of eGFP to mRuby fluorescence into seven bins, and deconvoluted the frequencies of oligo sequences in each pool by deep sequencing (FIG. 1A). With this system, it is possible quantify the cap-independent translation activity on circRNA for each oligo in the library in a high-throughput manner.

Figure 1B:
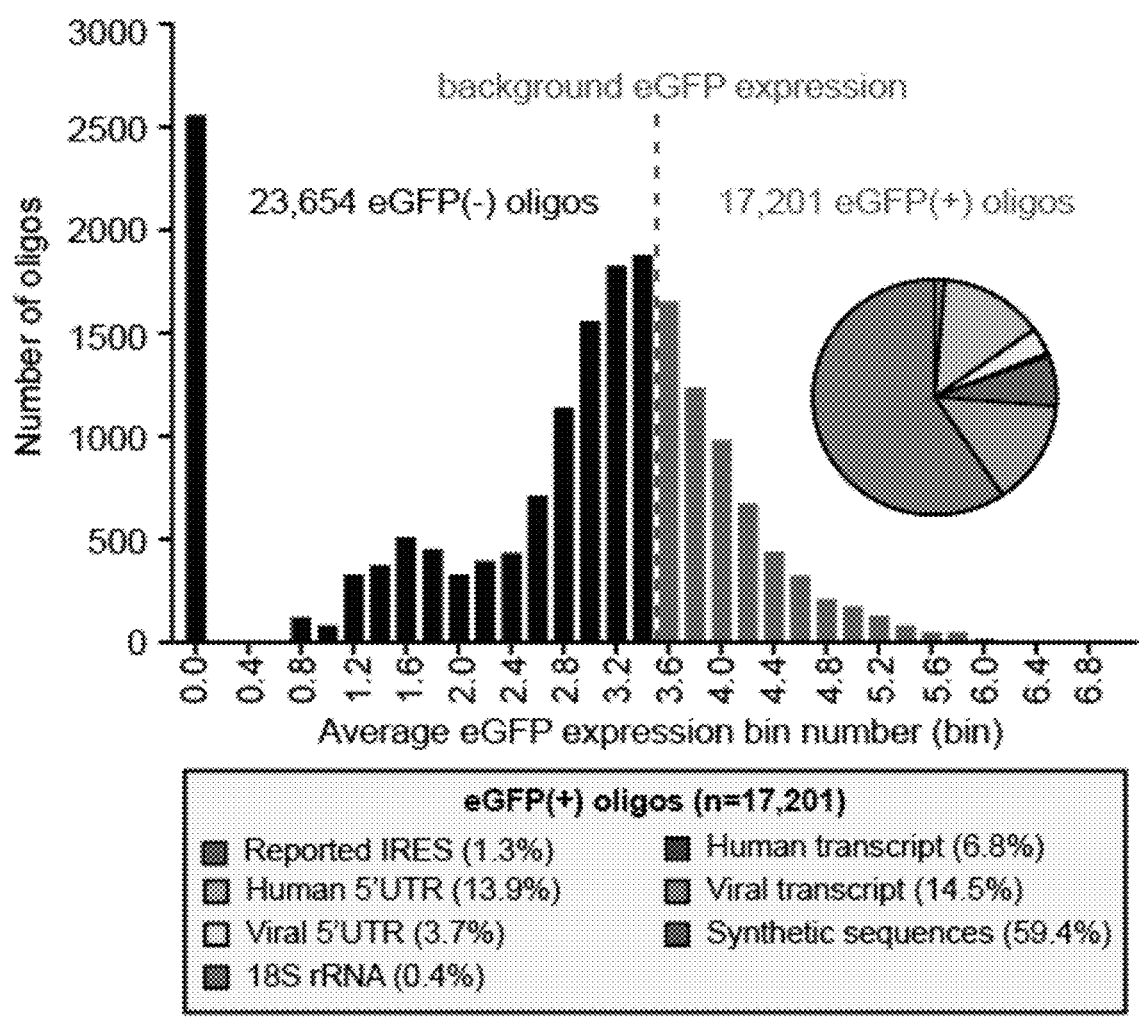
Figure 1C:
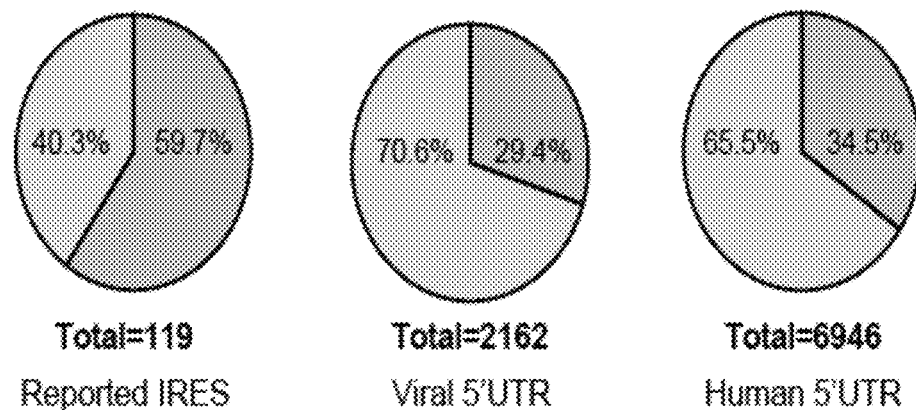
Figure 9A:
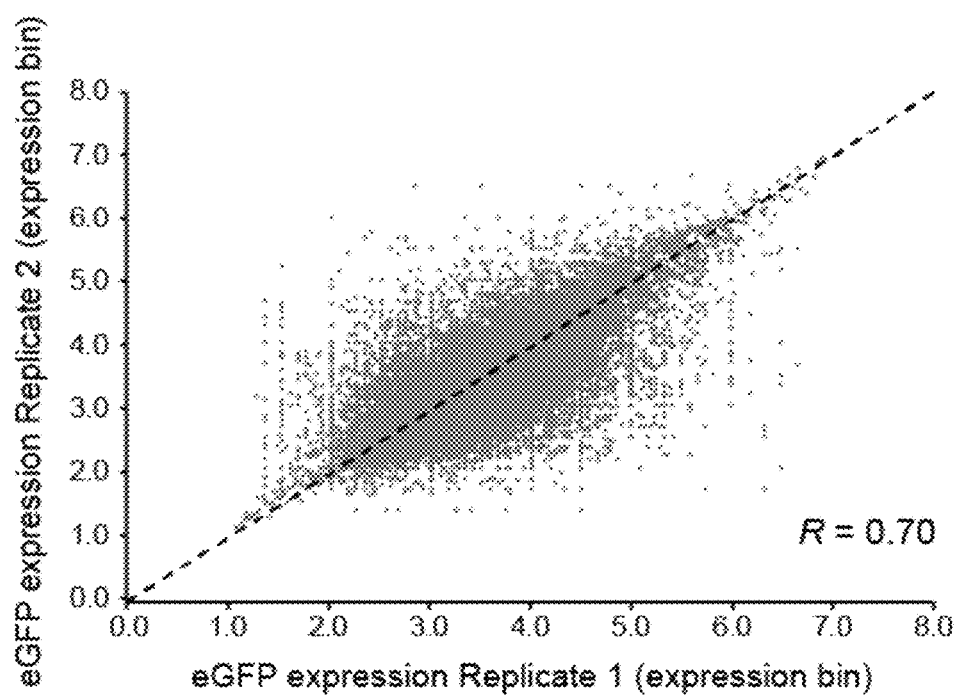
FIG. 9A-9F show high-throughput identification of IRES sequences that can facilitate cap-independent translation activity on circRNAs.
Figure 9B:
Figure 9C:
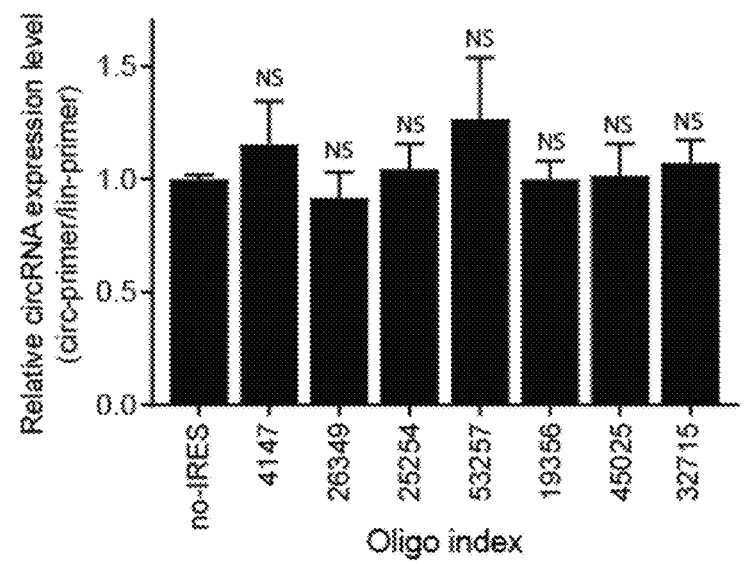
Figure 9D:
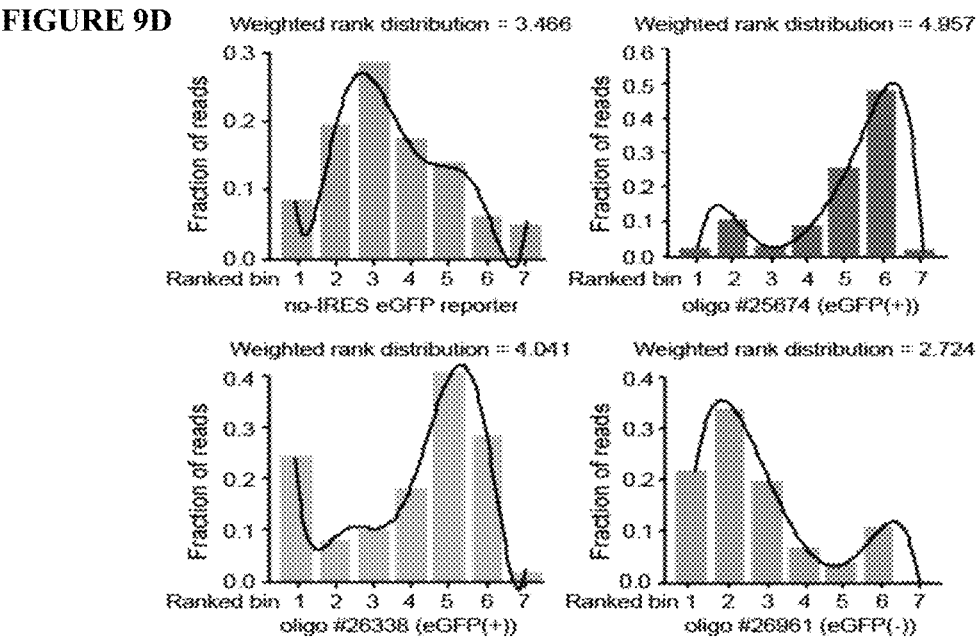
Figure 9E:
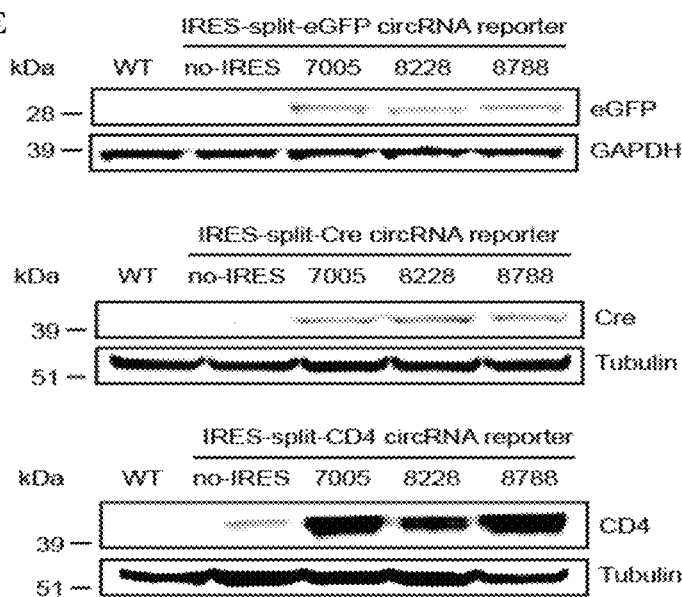
Figure 9F:
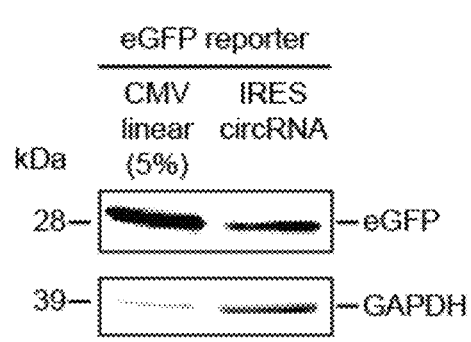
Figure 10A:
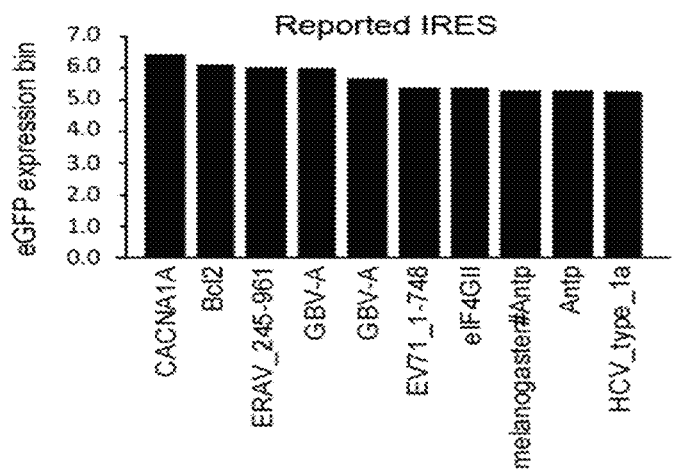
FIG. 10A-10C show the high-throughput IRES screening assay can capture IRES from viral and human 5' UTRs. These figures show examples of IRESs captured in the screening assay with top 10 eGFP expression among the reported IRESs (i.e., linear IRESs) (FIG. 10A), viral 5' UTRs (FIG. 10B), and human 5' UTRs (FIG. 10C).
Figure 10B:
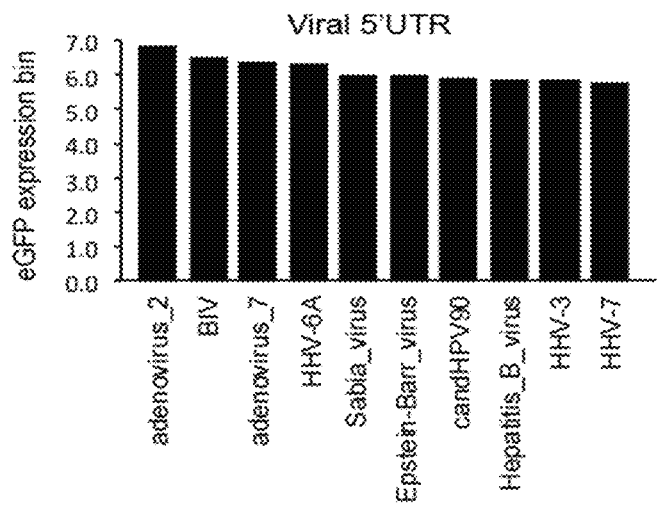
Figure 10C:
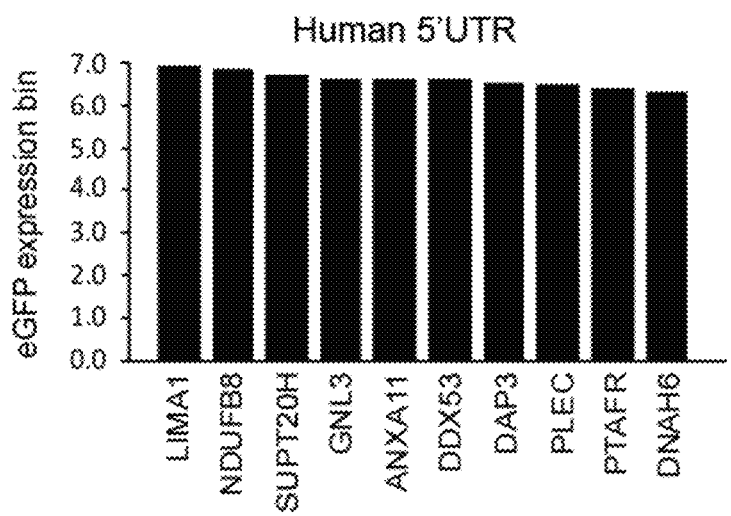

40,855 out of 55,000 oligos were captured from the library (~74.3%). To quantify the eGFP expression level of each oligo, the mean weighted rank distribution of the reads across the bins was calculated. The weight of each bin is the fraction of the number of reads in this bin of its total reads in all seven bins. The rank is the bin number from the bin with the lowest eGFP intensity (bin #1) to the bin with the highest eGFP intensity (bin #7). (FIG. 1B). It was found that the quantification of translation activity was highly reproducible between two independent biological replicates (Pearson's correlation coefficient R=0.70) (FIG. 9A). It was further confirmed that the results were not confounded by the change of circRNA back-splicing efficiency due to different oligo inserts (FIGS. 9B and 9C). This screening assay revealed three groups of oligos according to their eGFP expression level—a group (~2,500) of oligos which showed no eGFP expression (eGFP expression (bin)=0.0), and two groups of oligos showing a bimodal distribution of eGFP expression (eGFP expression (bin)=0.8-2.2 and 2.4-7.0, respectively). To determine the oligos with cap-independent translation activity (eGFP(+) oligos), the weighted rank distribution of the eGFP intensity of the cells transfected with no-IRES-inserted reporter plasmid (empty eGFP circRNA) was calculated as the background eGFP expression. The oligos were defined as eGFP(+) oligos were the oligos with eGFP expression higher than the background eGFP expression (eGFP expression (bin)=3.466387) (FIG. 1B). The background eGFP expression was calculated based on the distribution of the reads across the bins rather than a simple cut off value, which is a more conservative approach to avoid possible false positive events because the empty circRNA eGFP reporter could have weak translation activity (FIG. 9D). With this approach, 17,201 eGFP(+) oligos were identified from the screening assay (FIG. 1B, SEQ ID NO: 1-17201). Further, it was verified that the screening result was not eGFP reporter specific because the eGFP(+) oligos identified were able to initiate circRNA translation of reporters with different coding sequences (CDSs) (FIG. 9E). Although circRNA translation is reproducibly detected, substantially weaker cap-independent translation activity was observed for the circRNA driven by the eGFP(+) oligos compared to the linear RNA translation driven by the cap-dependent translation (FIG. 9F).

Figure 1D:
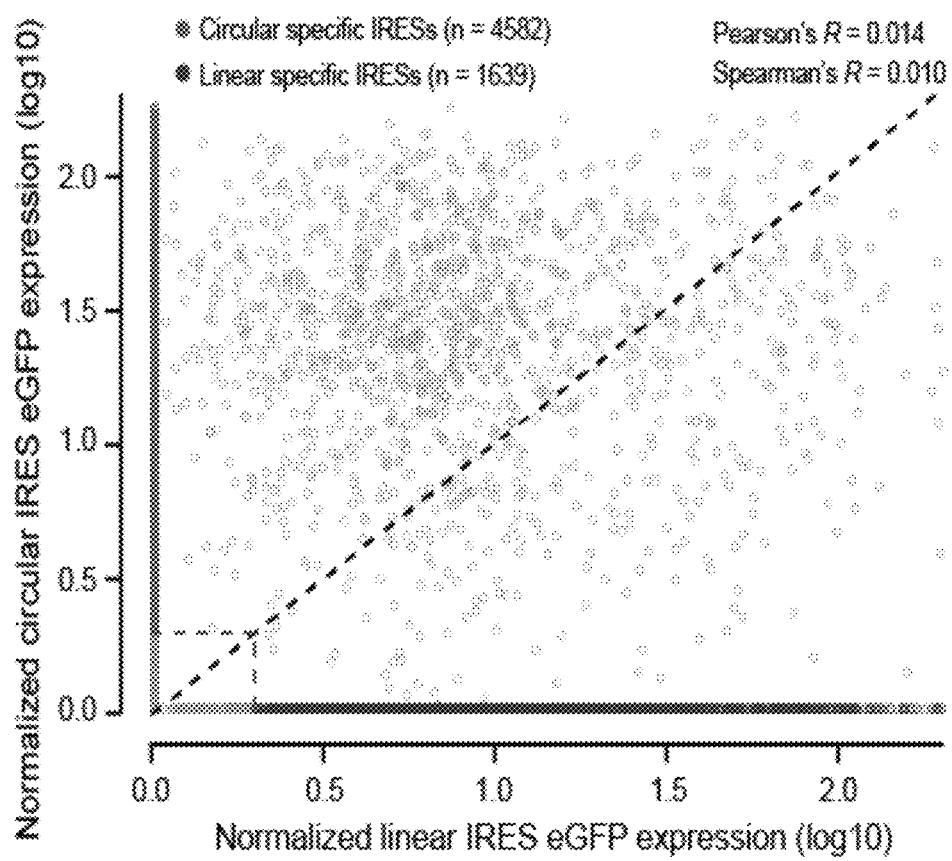
Figure 11A:
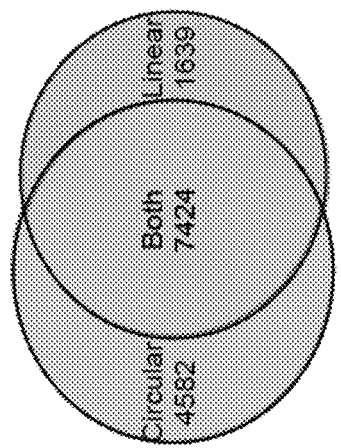
FIG. 11A-11D show the IRES composition among the captured linear and circular IRES.

Because a previous study has utilized the same synthetic oligo library on a linear bicistronic eGFP reporter screening assay to identify oligos with cap-independent translation activity on linear RNA over no-IRES-inserted reporter plasmid as threshold (Weingarten-Gabbay et al., 2016), it was possible to compare the cap-independent translation activity of each oligo sequence on linear RNA and circular RNA respectively. For each oligo, the normalized eGFP expression was calculated, from the circRNA vs. from the linear RNA template. It was discovered that among the oligos captured in both circRNA and linear RNA reporter screens (n=13,645), a large number of the oligos showed cap-independent translation activity in both linear and circular RNA screening system (n=7,424) (FIG. 1D, FIG. 11A). However, there was little correlation between the overall IRES activity of circular vs. linear RNA (Pearson's R=0.014; Spearman's R=0.010) (FIG. 1D). Interestingly, some oligos were also captured that show IRES activity specifically in either linear or circular screening system (linear IRES and circular IRES, respectively) (FIG. 1D). To define linear and circular IRES, a more conservative approach was taken, where linear IRES represents the oligo showing cap-independent translation activity in the linear RNA screening system only; and circular IRES represents the oligo showing cap-independent translation activity in the circular RNA screening system only. With this approach, 4,582 circular IRESs and 1,639 linear IRESs were identified (FIG. 1D, FIG. 11A).

Figure 11C:
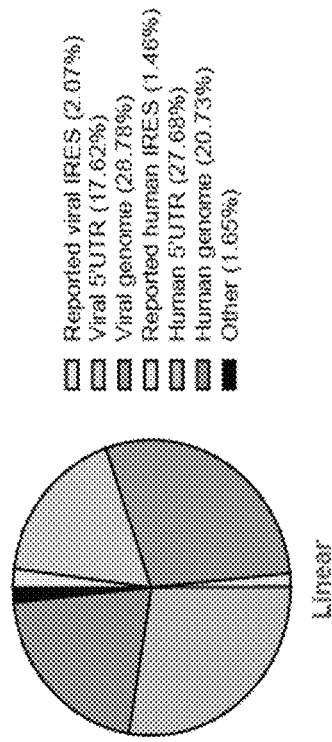
Figure 11B:
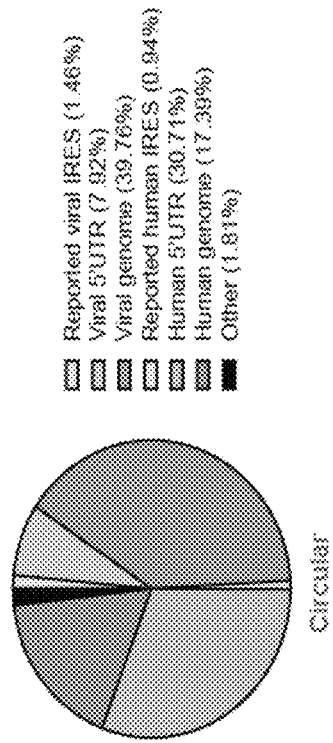
Figure 11D:
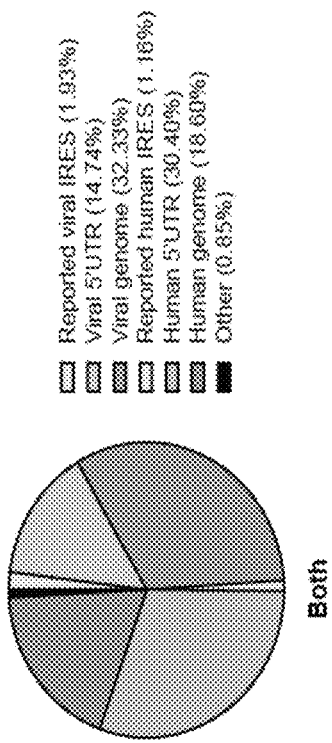

Furthermore, when the distribution of the human and viral IRES was examined among circular IRES, linear IRES, and the IRES showing translation activity in both linear and circular RNA, respectively, no significant difference was found among the IRES (FIG. 11B-11D). The result suggests that the recruitment or the activity of circRNA-specific IRES trans-acting factors (ITAFs) on the circular RES may depend on circRNA-specific biogenesis, such as circRNA back-splicing or circRNA nuclear export to distinguish circRNAs from linear RNAs. Together, these results demonstrate that the high-throughput screening assay utilizing the circRNA reporter construct is able to systematically identify the RNA sequences harboring TRES activity that can facilitate cap-independent translation on circRNA.

Example 2

This example demonstrates that synthetic circRNAs harboring eGFP+oligo sequences are actively translated.

Figure 2A:
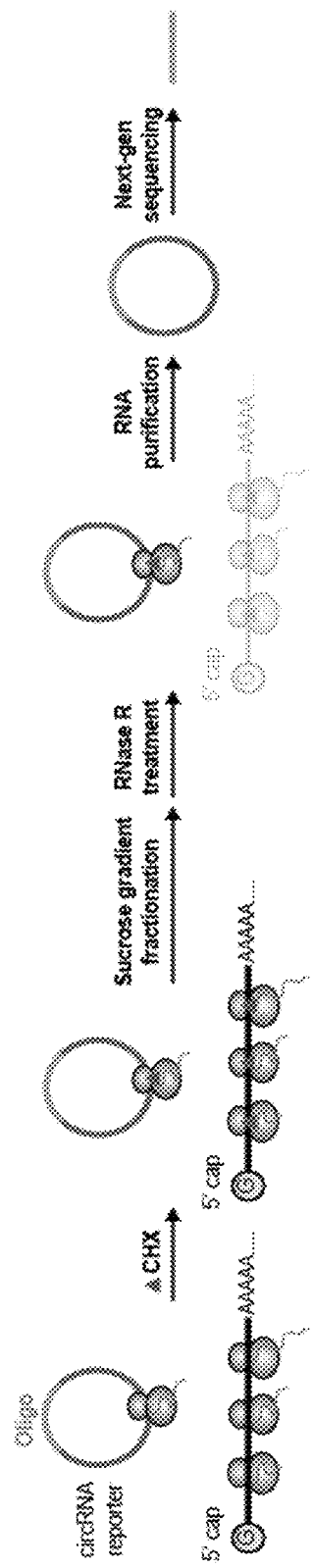
FIG. 2A-2E show that circRNAs containing an eGFP(+) oligo have higher cap-independent translation activity.
Figure 2B:
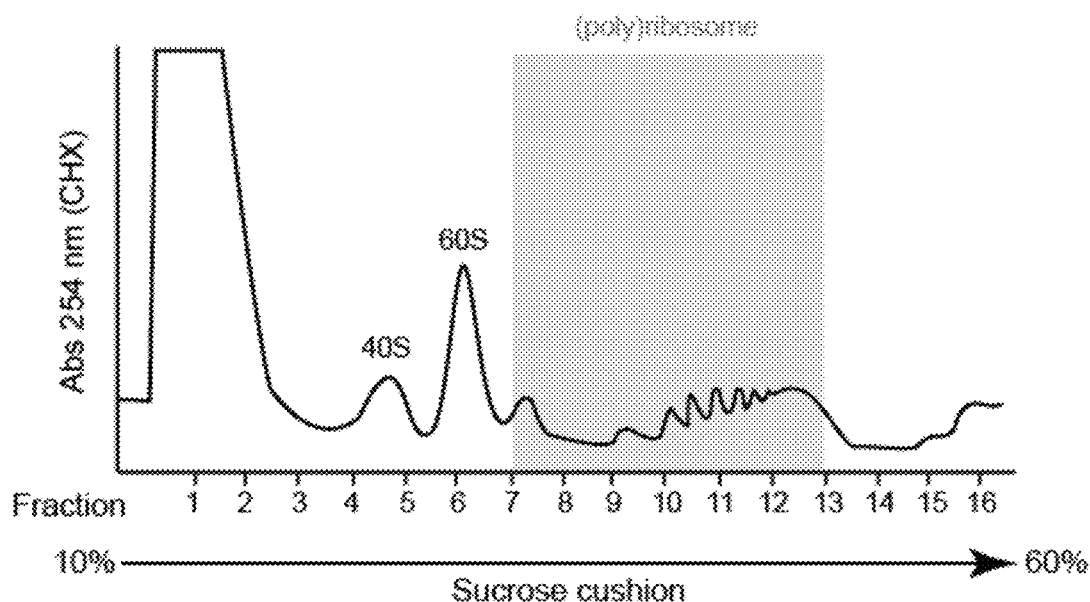
Figure 2C:
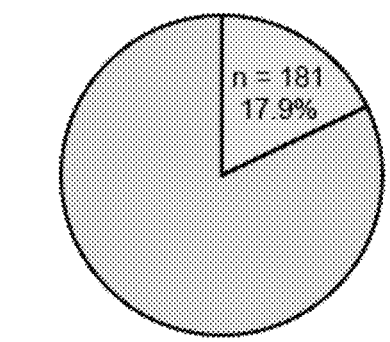
Figure 2C:
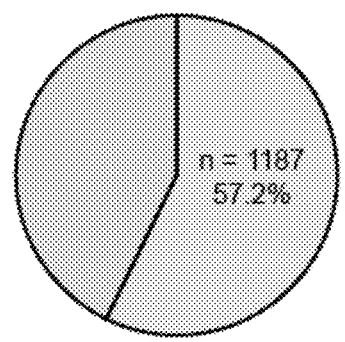
Figure 2E:
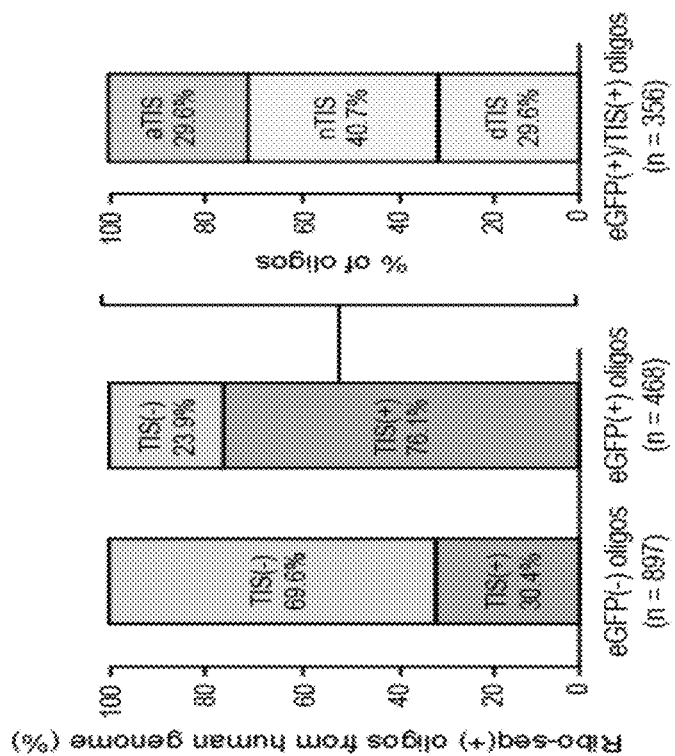
Figure 2D:
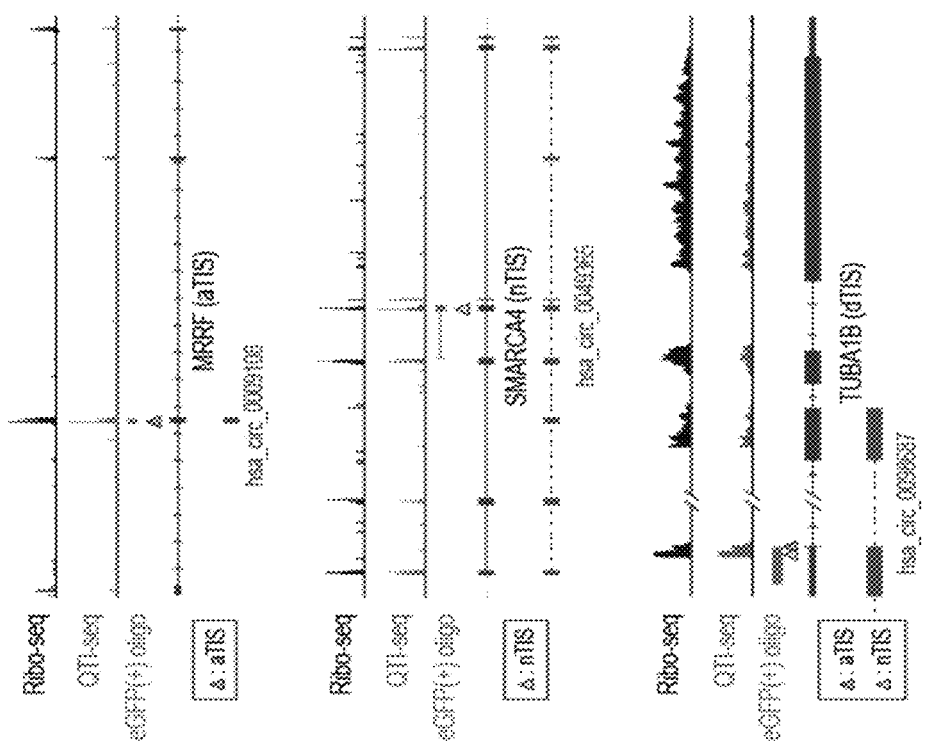
Figure 12A:
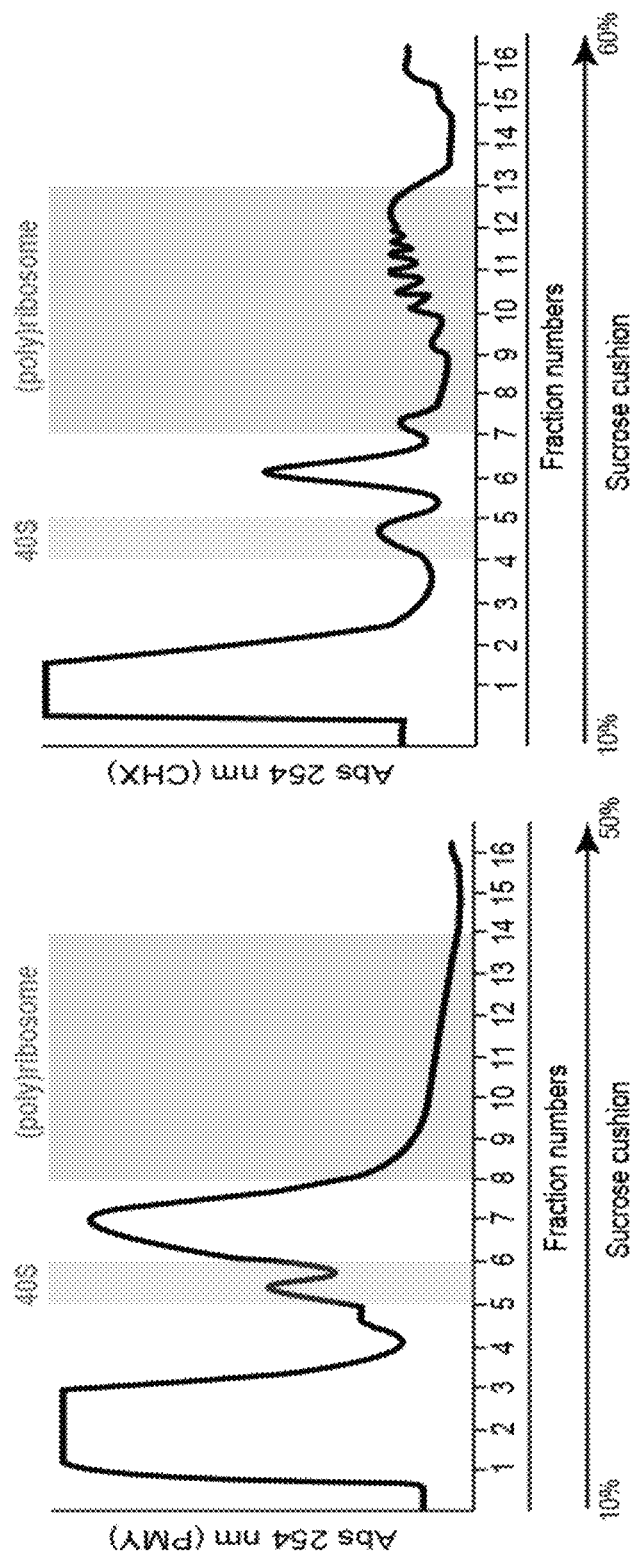
FIG. 12A-12E show that the circRNAs containing the eGFP(+) oligo sequence are more actively translated.
Figure 12C:
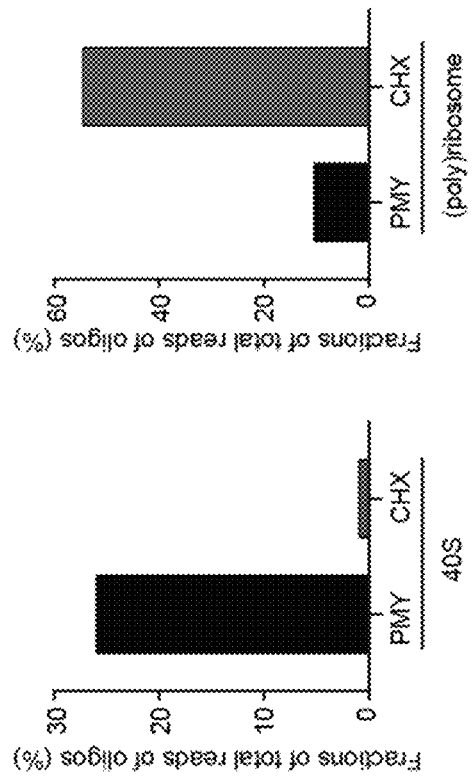
Figure 12E:
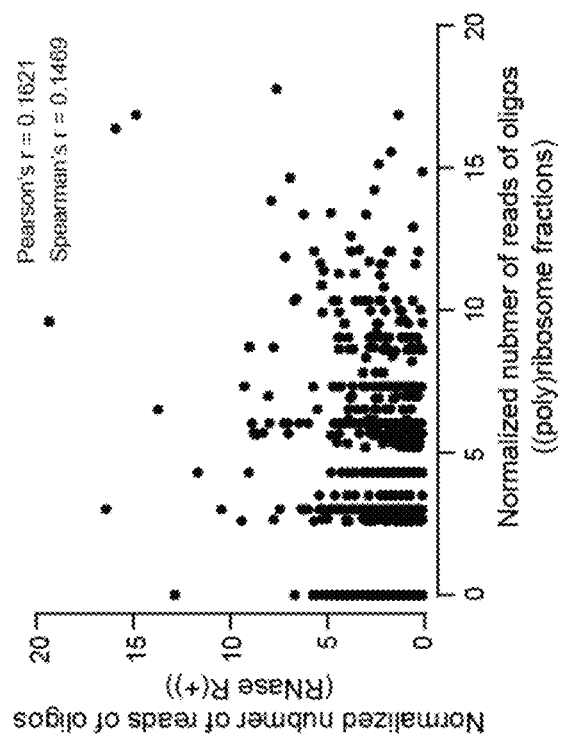
Figure 12B:
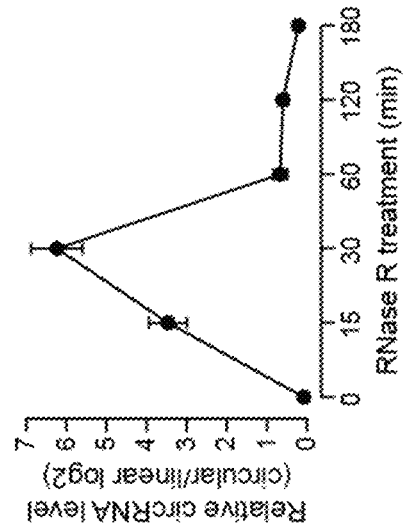
Figure 12D:
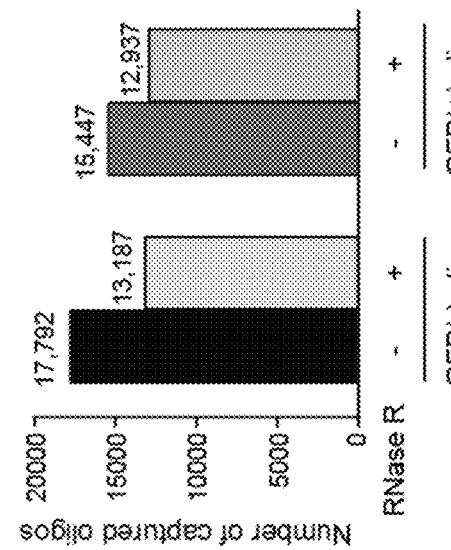
Figure 13A:
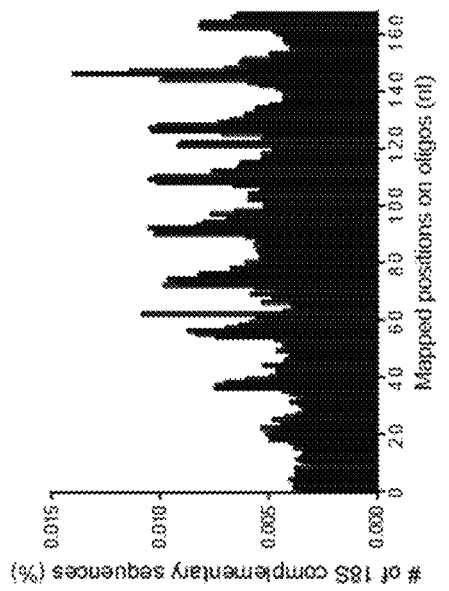
FIG. 13A-13D show that eGFP(+) oligos are more frequently overlapped with the translation initiation sites (TIS) on the human genome. Shown in FIG. 13A is quantification of the number of TIS reads in eGFP(+) or eGFP(−) oligos on the human genome. **** represents p-value<0.001 by an unpaired two-sample t-test. Error bar: SEM. Shown in FIG. 13B are the mapped positions of TIS on each TIS(+) oligo plotted on the oligo. The TIS positions were sorted by the mapped position on the oligo.
Figure 13B:
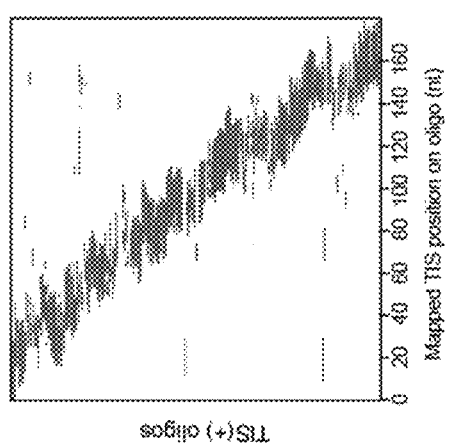

To validate the screening results of Example 1, polysome profiling was used to examine whether circRNAs containing the identified eGFP(+) oligo sequence are actively translated and engaged on the ribosome. First, HEK-293T cells were transfected with the oligo-split-eGFP-circRNA reporter construct containing the synthetic oligo library, treated the transfected cells with cycloheximide (CHX), and isolated (poly)ribosome-associated RNAs with sucrose gradient fractionation (FIG. 2A, 2B, FIG. 12A). Further, the fractions with RNase R were treated to obtain high enrichment of (poly)ribosome-associated circRNAs and high-throughput sequencing was performed to identify the TRES sequences harbored by the circRNA in each fraction. The RNase R treatment was performed in conditions that allows RNase R to digest potential G-quadruplex containing linear RNA efficiently, and the RNase R digestion duration was optimized to obtain >100 fold circRNA enrichment over linear RNA (FIG. 12B). In comparison to the CHX treatment, treating transfected cells with puromycin (PMY) caused translated circRNAs shifting from the poly(ribosome)-associated fractions to the 40S fraction (FIG. 12C), suggesting that CHX treatment is able to capture translated circRNAs. To avoid the result being confounded by the weakly translated circRNAs (data not shown), the ratio of (poly)ribosome-enriched oligos among the eGFP(+) oligos with eGFP expression above the 80th percentile was calculated and compared with the eGFP(−) oligos with eGFP expression below the 20th percentile. The result demonstrated that the eGFP(+) oligos are more enriched in the (poly)ribosome fractions (57.2%) than the eGFP(−) oligos (17.9%) (FIG. 2C). It was confirmed that the higher enrichment of (poly)ribosome-associated eGFP(+) oligos was not caused by the capturing efficiency or the expression level of the oligos (FIGS. 12D and 12E). The result suggests that the circRNAs containing the eGFP(+) oligo sequences are more actively translated. However, since polysome profiling has a lower sensitivity for capturing weakly translated circRNAs (data not shown), quantitative translation initiation sequencing (QTI-seq) data was utilized for additional validation. Next, published data from the QTI-seq was examined, which is a modified ribosome-profiling (Ribo-seq) technique that maps the translation initiation sites (TIS) genome-wide (Gao et al., Nat Methods 12, 147-153, 2015). First, it was examined if the eGFP(+) oligo sequences overlap with those identified TIS on the human transcripts. The results demonstrated that among the oligos derived from the human genome with Ribo-seq coverage, the majority of the eGFP(+) oligos (~76%) overlaps with the identified TIS on human transcripts identified by QTI-seq (TIS(+) oligos), while only 30% of the eGFP(−) oligos are TIS(+) (FIGS. 2D and 2E, FIG. 13A), suggesting that the eGFP(+) oligos are more likely to initiate translation at those TIS than the eGFP(−) oligos. Interestingly, by examining the eGFP(+)/TIS(+) oligos on the human genome, three types of eGFP(+)/TIS(+) oligos were identified: (1) oligos containing the translated initiation site that have been annotated on linear transcripts (annotated TIS; aTIS), (2) oligos containing the translated initiation site that were not annotated on linear transcripts (non-annotated TIS; nTIS) which can be located at the 5' UTR, CDS or 3' UTR region of the transcripts, and (3) oligos containing both aTIS and nTIS signal (dual TIS; dTIS) (FIGS. 2D and 2E). These different types of TIS(+) oligos may suggest that the oligos utilized different mechanisms for initiating translation. While aTIS oligos (~30%) may utilize the same annotated translation initiation site as the linear transcript for cap-independent translation, nTIS (~41%) in contrast represent novel translation initiation sites that are different from the linear transcript for cap-independent translation, which has been observed in initiating the synthesis of alternative translation products. For dTIS oligos, they may utilize some uncharacterized regulatory mechanisms to coordinate the dual activity between aTIS and nTIS which require further investigation. Importantly, while the oligo library was enriched of the oligos located at the upstream of the annotated start codon, no bias was observed towards the ratio of aTIS oligos, suggesting that the result was not confounded by the design of the oligo library. Interestingly, it was found that eGFP(+)/TIS(+) oligos are located within the genomic regions that encode annotated circRNAs (FIG. 2D), which suggests that these circRNA may utilize the TIS on the oligo for initiating endogenous circRNA translation. Nevertheless, when the position of translation initiation sites was mapped on each oligo, no translation initiation hot spots were observed on the oligo (FIG. 13B), suggesting that the translation initiation is not influenced by the position on the oligo. Together, the results above provide strong evidence that the screening assay described herein is able to identify the oligo sequences that are capable of facilitating cap-independent translation activity on circRNAs.

Example 3

This example describes the identification of 18S rRNA complementary sequences that facilitate circRNA translation.

Figure 3I:
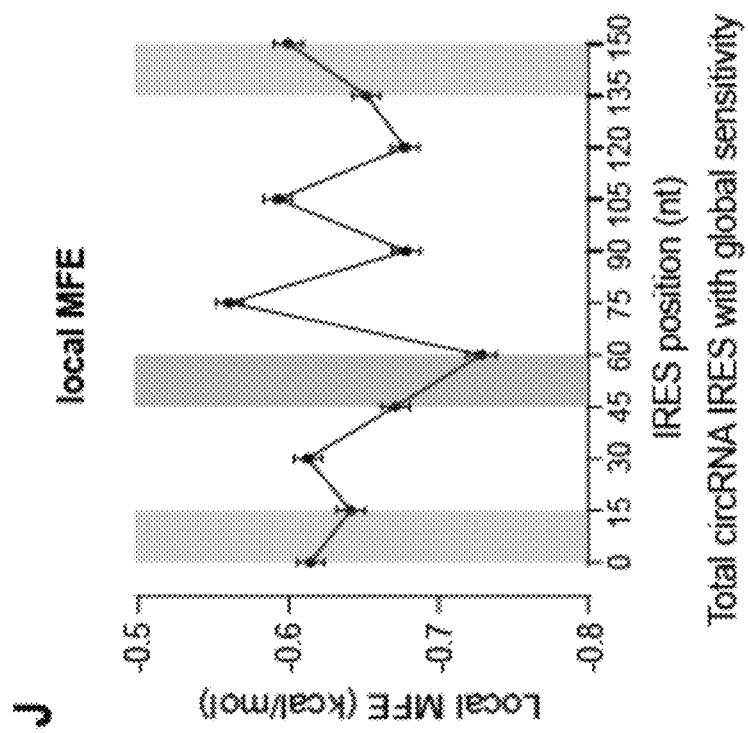

Watson-Crick base-pairing between IRES and 18S ribosomal RNA (18S rRNA) has been demonstrated to facilitate cap-independent translation of linear mRNAs. Thus, it was evaluated whether the screen may identify the regions on human 18S rRNA that can interact with circRNA IRES and facilitate cap-independent translation. The synthetic oligo library was designed to contain 171 oligos with sequences complementary to human 18S rRNA, with a 10-nt sliding window between each consecutive oligo that reconstitutes the entire 1869-nt full-length 18S rRNA sequence (FIG. 3A, SEQ ID NO: 28977-28983). For each position on the 18S rRNA, the average eGFP expression of all the oligos containing the corresponding complementary sequence was calculated. With this sliding window method, the circRNA IRES activity was determined for each 10-nt window across the human 18S rRNA sequence (FIG. 3A). Six "active regions" on the 18S rRNA were identified, where the complementary sequence within these active regions shows average eGFP expression higher than the background eGFP expression (FIG. 3B). Interestingly, active regions 2, 4, 5, and 6 harbor helices that have been reported to contact mRNAs in the eukaryotic ribosome initiation complex and interact with translated RNAs (Pisarev et al., EMBO J 27, 1609-1621 (2008)) (FIG. 3C). Furthermore, active region 4, and active regions 2 and 6, harbored the sequences that have been characterized to facilitate cap-independent translation of IGF1R and HCV IRES, respectively, by Watson-Crick base pairing (FIG. 3C). Active region 3 is located in one of the expansion segments on 18S rRNA (ES6S), which has been implicated in the recruitment of eukaryotic initiation factor 3 (eIF3). eIF3 directly binds to the 5' UTR N6-methyladenosine (m6A) of linear mRNA and initiates cap-independent translation, suggesting that active region 3 on 18S rRNA may be crucial for eIF3-m6A-mediated cap-independent translation. Active region 1 is located in another expansion segment on 18S rRNA (ES3S) that interacts and forms a tertiary structure with active region 3, which suggests that active region 1 may be involved in the eIF3-m6A-mediated cap-independent translation as well. These results suggest that the active regions on 18S rRNA identified indeed play roles in facilitating cap-independent translation.

Figure 13C:
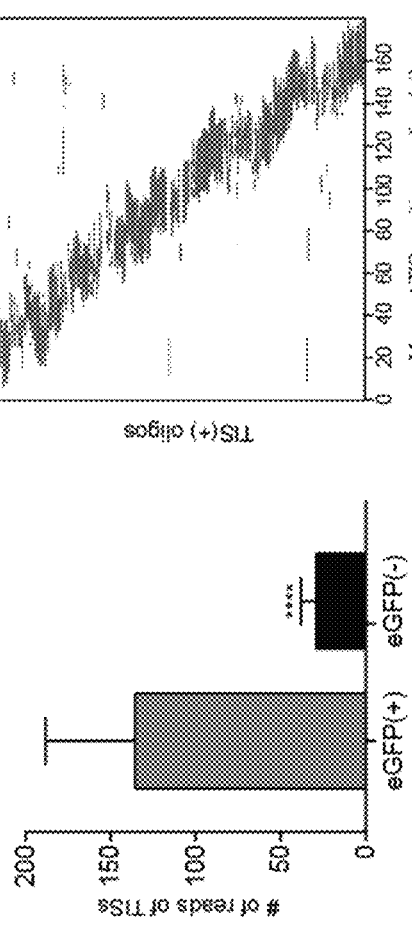
Figure 13D:
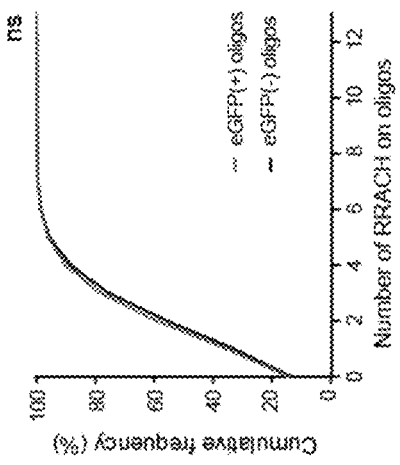

Since the 7-mers derived from active region 4 have been shown to be enriched in reported IRES for linear RNAs, all 7-mers were extracted from the sequence complementary to the active regions of 18S rRNA (active 7-mers), and the number of active 7-mers harbored by the eGFP(+) and eGFP(−) oligos, respectively, were compared. It was found that eGFP(+) oligos have higher enrichment of active 7-mers than eGFP(−) oligos (FIG. 3D). In contrast, when the matched-number of random 7-mers which do not overlap with the active 7-mers between eGFP(+) and eGFP(−) oligos was compared, no significant difference was found (FIG. 3D), suggesting that the higher enrichment of active 7-mers in eGFP(+) oligos observed here is specific to the 18S rRNA complementary sequence. Nevertheless, no hot spot positions of the active 7-mers located on the circRNA IRES were observed (FIG. 13C). To further validate the results, the 18S rRNA complementarity of the IRES was perturbed by either substituting the 18S rRNA complementary sequence with a random 7-mer or adding the flanking 18S rRNA complementary sequence to the IRES and measured their circRNA translation activity (FIG. 3E). Diminished IRES activity was observed with lower 18S rRNA complementarity on the IRES, and conversely stronger IRES activity was programmed with higher 18S rRNA complementarity added to the IRES (FIG. 3E). These results suggest that the circRNA IRES containing RNA sequence complementary to the active regions on 18S rRNA is one of the regulatory elements that can facilitate cap-independent translation on circRNA.

Example 4

This example describes the identification of essential elements on circRNA IRES using systematic scanning mutagenesis.

Scanning mutagenesis was employed to define the essential elements on circRNA IRES. Included in this analysis were oligos designed for scanning mutagenesis of 99 reported IRESs and 734 native 5' UTRs in the synthetic oligo library. The oligos were designed as non-overlapping sliding windows of 14-nt random substitution mutation tiling across the entire IRES or 5' UTR (FIG. 3F). With the screening results, it was possible to determine the effect of the substitution mutations on each 14-nt window on IRES activity across each oligo sequence (FIG. 3F). The essential elements (FIG. 3G; highlighted in blue) were determined as the region from the start position of the mutation (FIG. 3G; black dots) where there was a sharp decrease of the IRES activity to the next start position of the mutation where the IRES activity was resumed or above the mean eGFP expression level. By comparing the quantification result with a well-characterized IRES, hepatitis C virus (HCV) IRES, it was observed that the known functional domains on the HCV IRES (FIG. 3G; redlines) co-localized with the mutation positions that have dramatically reduction in IRES activity. The specific reduction in IRES activity at those mutation positions suggested that the mutations disrupted essential elements of the IRES, abolishing its cap-independent translation activity. The results demonstrated that the assay can indeed capture all of the reported essential elements on the HCV IRES, as well as one possible novel essential element that has not been characterized yet (FIG. 3G).

The same scanning mutagenesis assay was also utilized to further identify the essential elements on the identified circRNA IRES by scanning mutagenesis. The synthetic oligo library contains oligos carrying sliding windows of 14-nt random substitution mutation tiling across the circRNA IRES. With the scanning mutagenesis, two classes of circRNA IRES were captured—circRNA IRES with local sensitivity, which shows reduction in circRNA IRES activity only when a specific position in mutated (FIG. 3H; top), and circRNA IRES with global sensitivity, which mutation in most positions can cause reduction in IRES activity (FIG. 3H; bottom). The local and global sensitive IRES were defined as whether the IRES activity was affected by a single mutation or multiple mutations, respectively. The global sensitive IRESs have more structured sequences (i.e., significantly lower minimum free energy (MFE) value) compared to local sensitive IRESs; which suggests that the overall secondary structure of global sensitive IRESs are crucial for their TRES activity, because the more structured sequences are more likely to be affected by the mutation regardless of the position of the mutation. On the other hand, local sensitive IRESs have less structured sequences and are more resistant to the mutation; which suggests that the IRES activity of local sensitive IRESs may be regulated by a short sequence as the essential element.

Figure 3J:
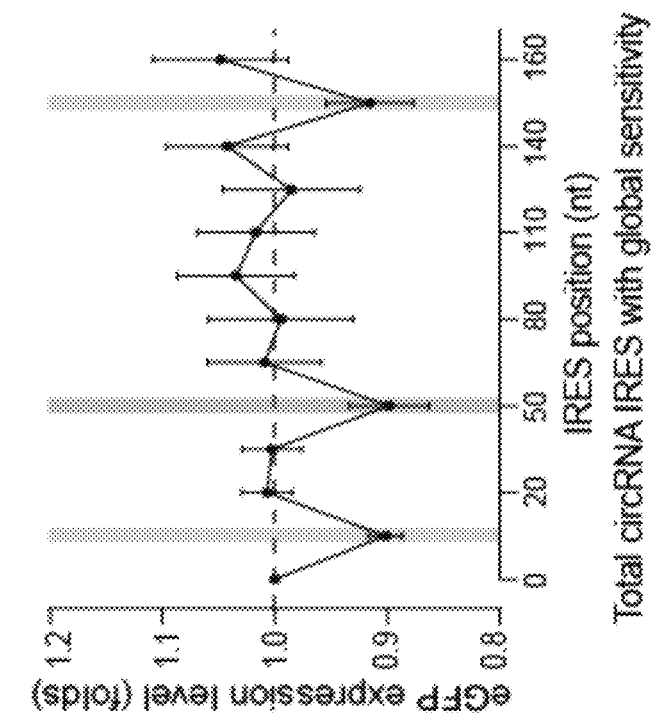

By overlaying the eGFP expression level of all the captured circRNA IRESs with global sensitivity, three regions (5-15 nt, 40-60 nt, and 135-165 nt) were identified on the IRES, where when the mutation hit these regions, the IRES activity decreased significantly (FIG. 3I), suggesting that these regions may harbor the key elements for facilitating cap-independent translation of the circRNA IRES. To further characterize if the element harbored by the regions is structure-dependent, the local MFE was calculated along the circRNA IRESs with global sensitivity in a 15 nt non-overlapping window. It was discovered that the local MFE of the 40-60 nt region on the circRNA IRES shows significantly lower local MFE (FIGS. 3I and 3J; shaded in red), suggesting that this region may harbor the local structural element that can drive circRNA translation. In contrast, the local MFE of 5-15 nt and 135-165 nt regions do not differ from other regions on the IRES (FIGS. 3I and 3J; shaded in blue), which suggests that the regulatory elements located at these two regions are not involved in local secondary structures.

Taken together, this data indicates that, with scanning mutagenesis, the assay is able to determine circRNA IRES with local or global sensitivity, and systematically identify essential circRNA IRES elements that are required for IRES activity in a high-throughput manner.

Example 5

This example demonstrates that a stem-loop structure at distinct positions on circRNA IRESs facilitates cap-independent translation.

Figure 14A:
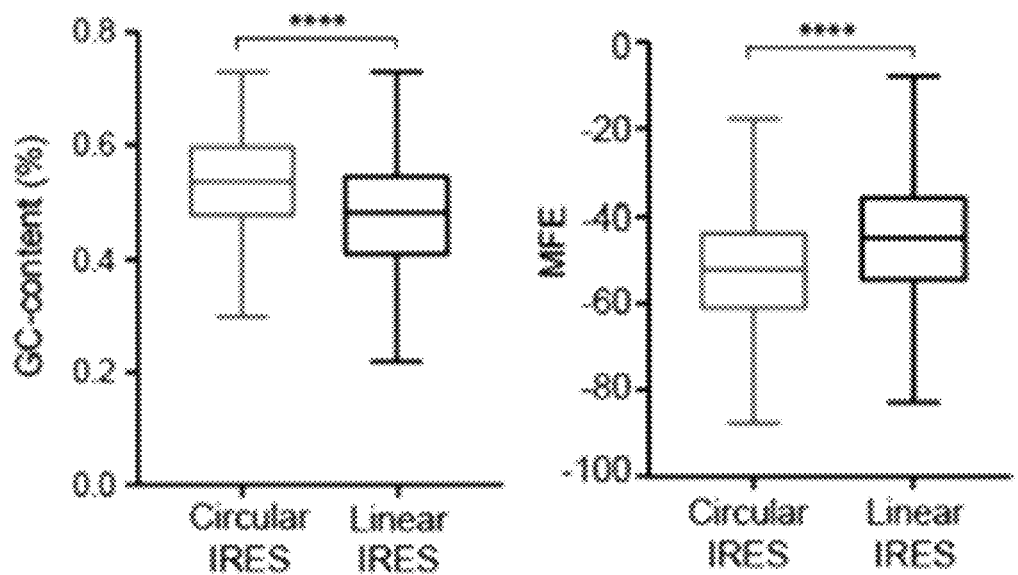
FIG. 14A-14G show a feature comparison between linear and circular IRES sequences. Shown in FIG. 14A is quantification of the GC-content (left) and MFE (right) of circular IRESs and linear IRESs, plotted as Tukey box-plot (outliers not shown). **** represents p-value<0.001 by an unpaired two-sample t-test.
Figure 14B:
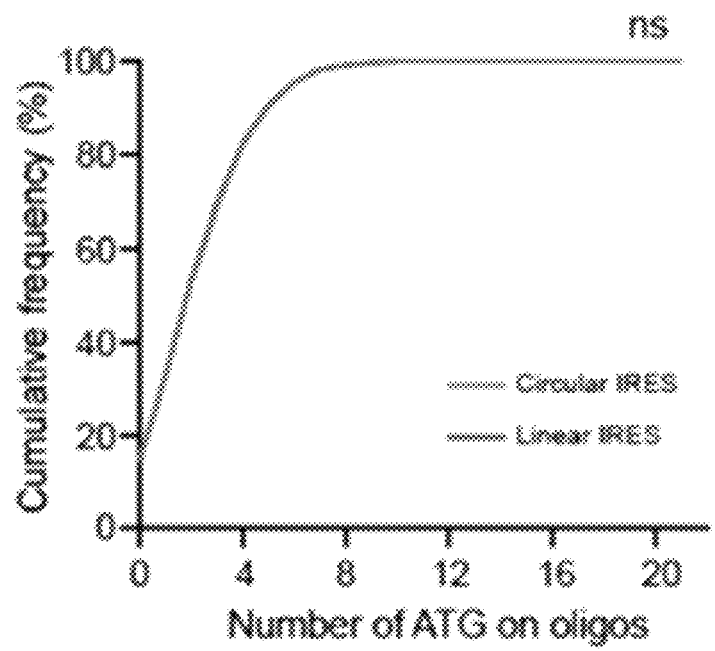
Figure 14C:
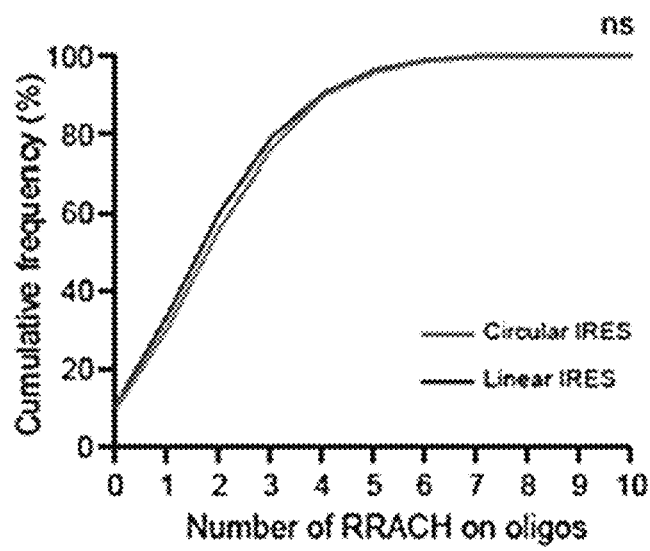
Figure 14D:
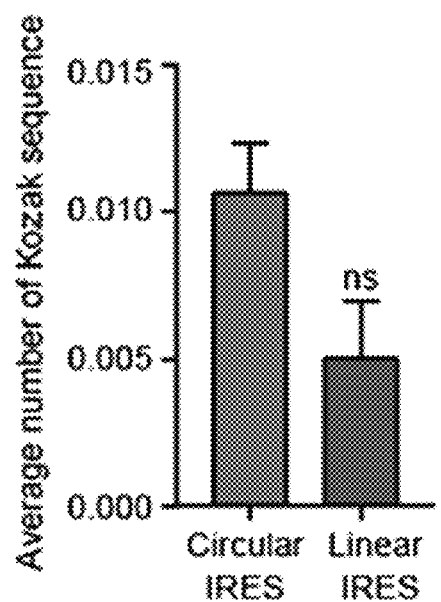

While many native and synthetic IRES have been reported to be able to facilitate cap-independent translation on circRNA, most of the TRES were characterized in a linear RNA reporter system, and no differential IRES activity of TRES on linear vs. circular RNA has been reported yet. By comparing the screening results from the circRNA reporter system described herein with the previous screening study done on a linear RNA reporter system using the same synthetic oligo library, two distinct groups of oligos were identified that harbor IRES activity on either linear or circular RNA specifically (linear IRES and circular IRES, respectively). To characterize the features on these oligos that can distinguish linear and circular IRESs, the primary sequence of the oligos was analyzed, and it was discovered that circular IRES contain higher GC-content and lower MFE than linear IRES (FIG. 14A). On the other hand, the number of the canonical translation start-codon (AUG), the Kozak consensus sequence (ACCAUGG, SEQ ID NO: 34039), and the m6A motif (RRACH, SEQ ID NO: 33944) showed no difference between linear and circular IRESs (FIG. 14B-14D). Since RNA with low MFE often indicates that the RNA has a stable secondary structure, the low MFE of circular IRES suggests some structural elements may play a role in facilitating cap-independent translation activity on circRNA.

Figure 14E:
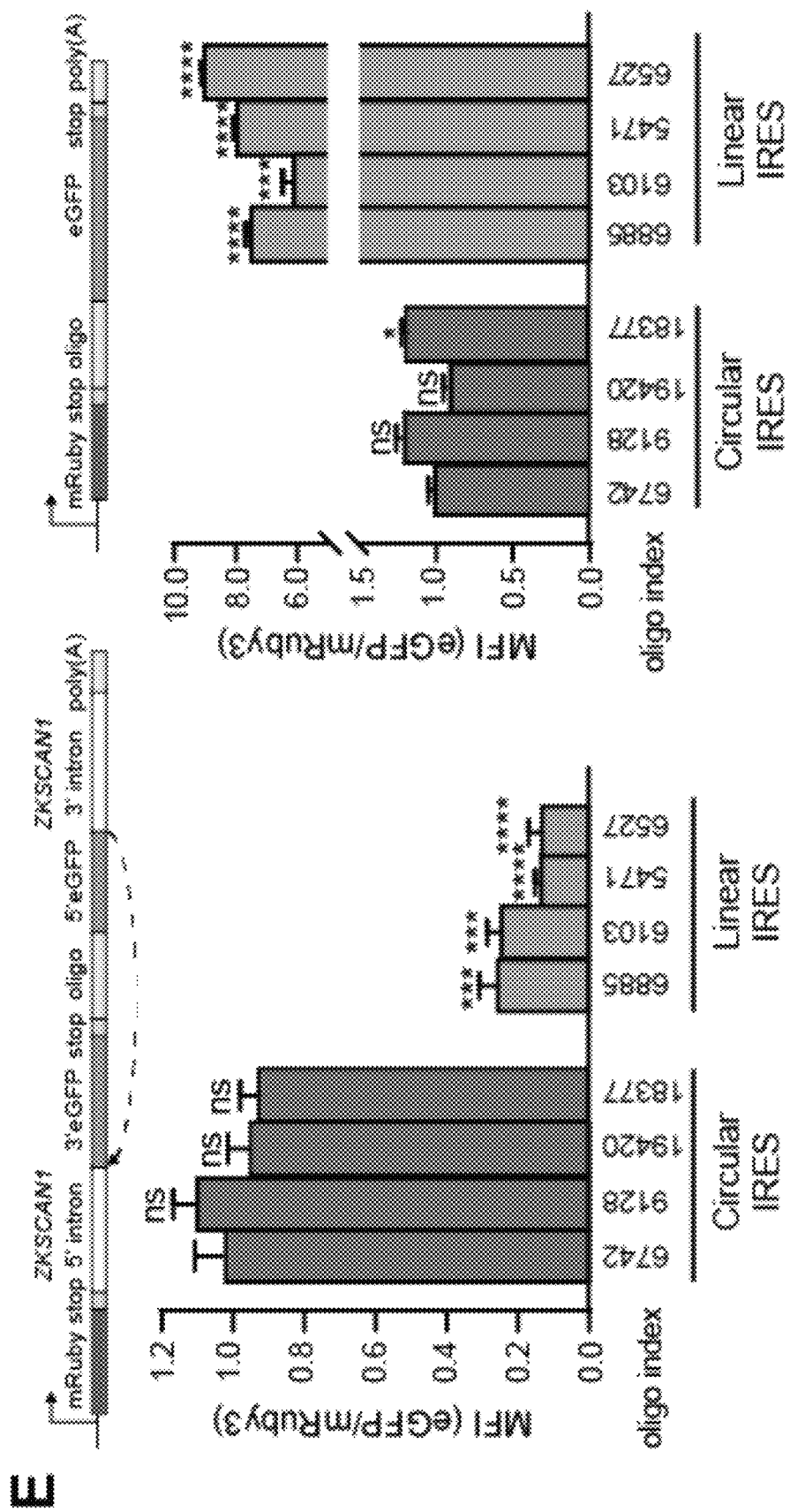
Figure 14F:
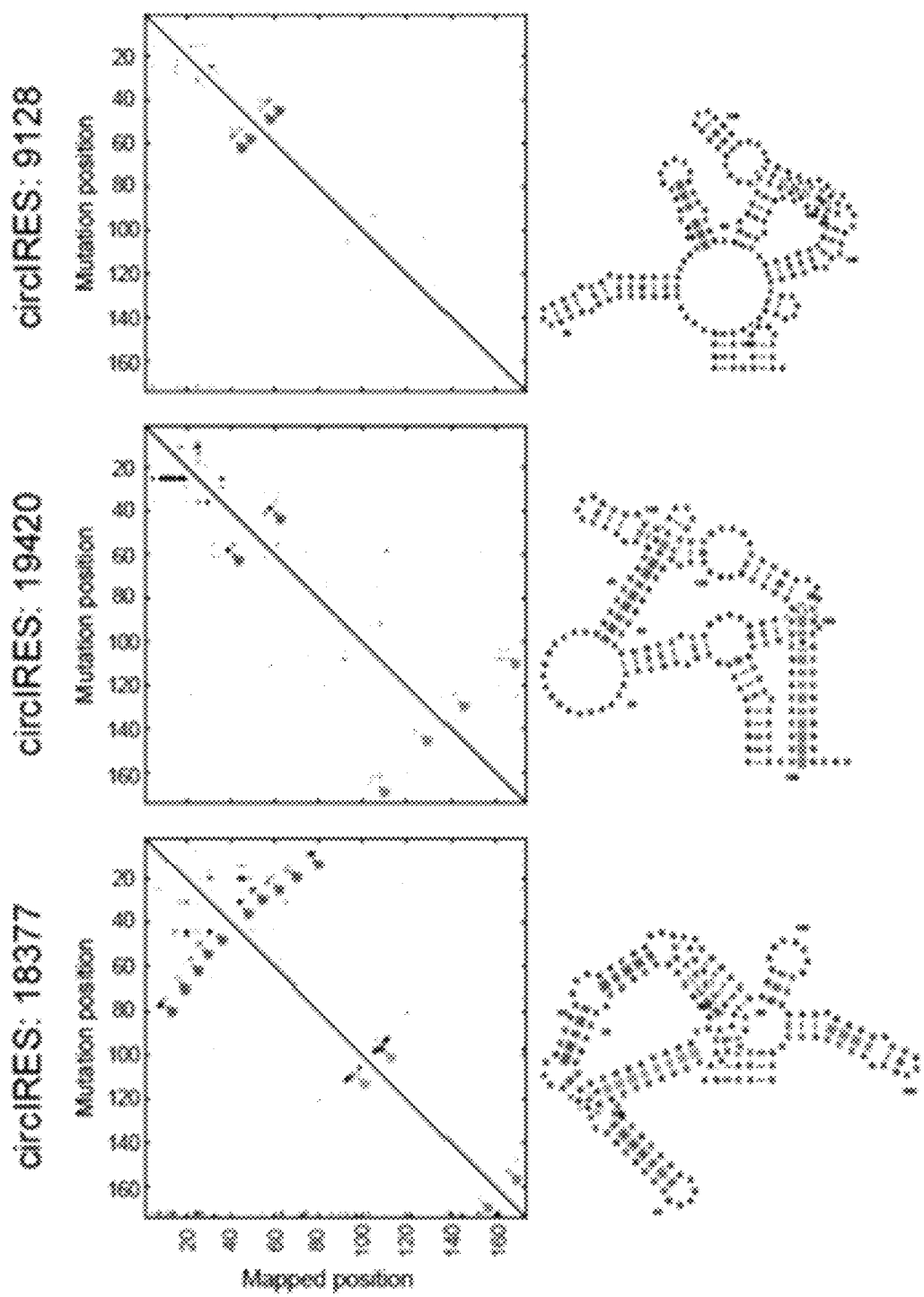
Figure 14G:
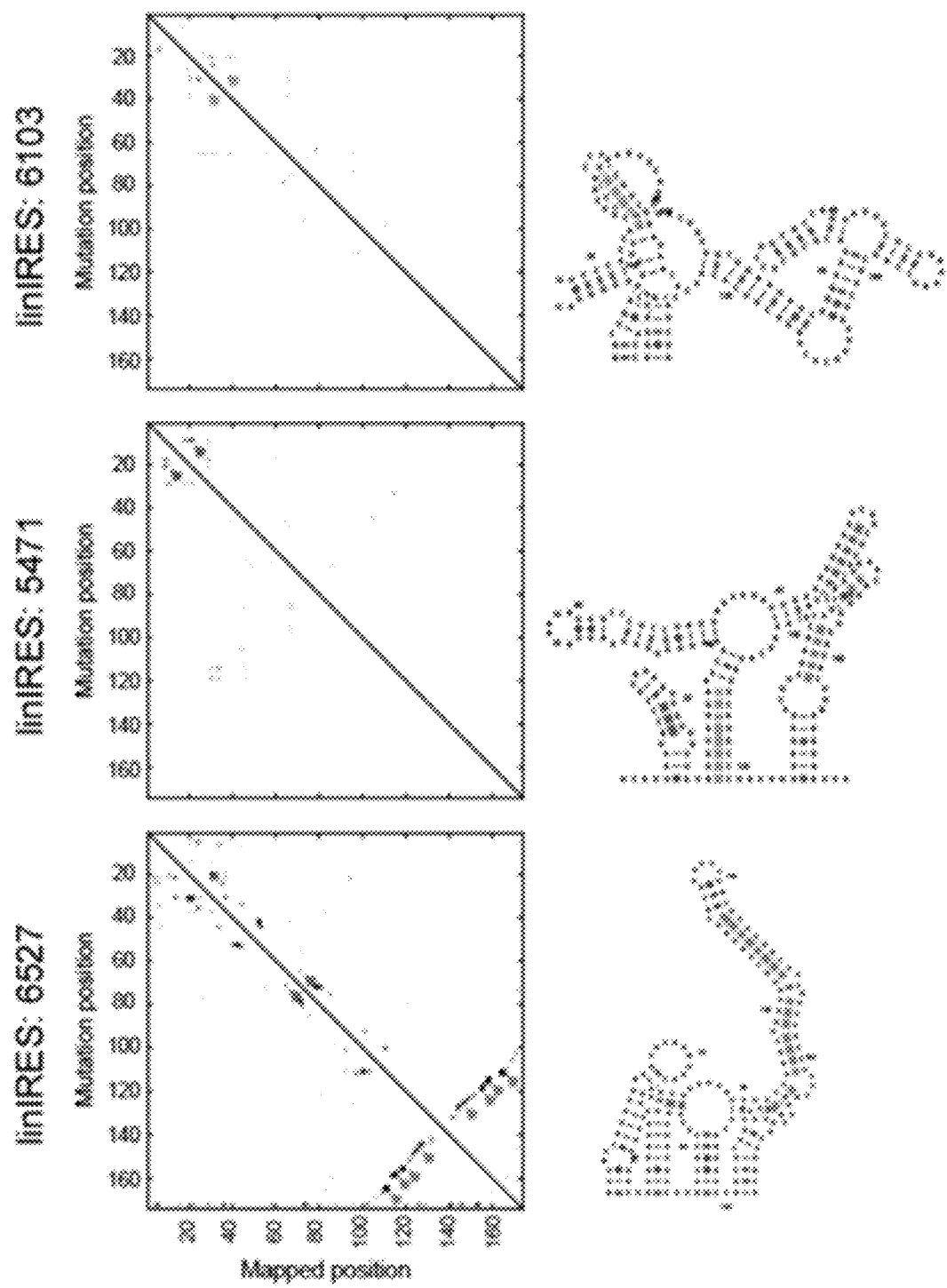

The secondary structure of linear and circular IRES was then characterized with M2-seq, an assay of systematic mutational profiling and chemical structure probing that captures RNA secondary structure with very low false-positive rate. Four circular IRES and linear IRES were selected that specifically show IRES activity on circRNA or linear RNA, respectively (FIG. 14E) and their secondary structure was determined with M2-seq. These oligos were selected because they harbor strong IRES activity in circular RNA system (circular IRES: 6742, 9128, 19420 and 18377) or linear RNA system (linear IRES: 6885, 6103, 5471 and 6527), respectively, and do not show any activity of read-through translation, ribosome re-initiation, and hidden promoter activity on the linear bicistronic construct to ensure that the eGFP signal detected here on the linear bicistronic construct came from the cap-independent translation of the oligos. The M2-seq results revealed that while linear IRES harbored structured elements, the circular IRES are in general more structured than linear IRES (FIGS. 4A and 4B, FIGS. 14F and 14G). Among all four circular IRES examined, all contained a stem-loop structured RNA element (SuRE) on the IRES at a distinct position (40-60 nt position from the +1 position (the first nucleotide) of the IRES), while all the linear IRES examined did not contain such a structure at this position (FIGS. 4A and 4B, FIGS. 14F and 14G). In line with previous systematic scanning mutation profiling, which also suggests that this distinct position on IRES contains structural element required for facilitating circRNA translation (FIGS. 3I and 3J), it was proposed that the SuRE at this distinct position on the IRES can facilitate cap-independent translation activity on circular IRES.

Figures 4E, 4F:
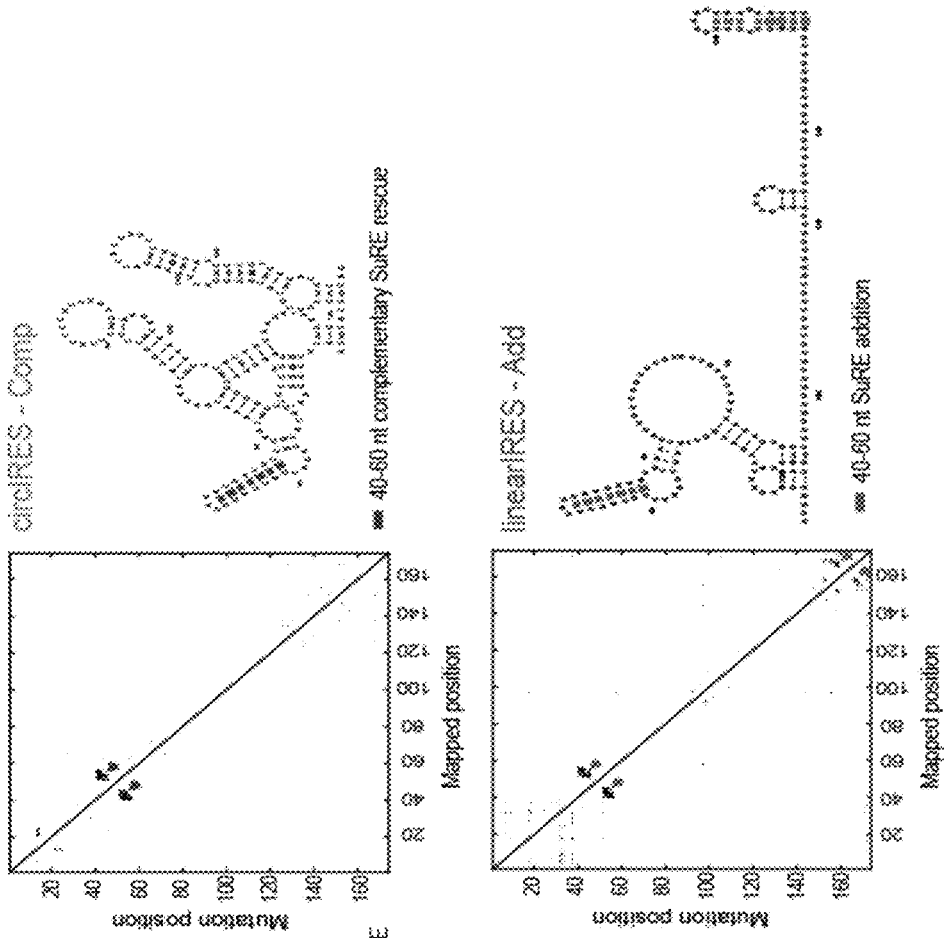
Figures 4G, 4H:
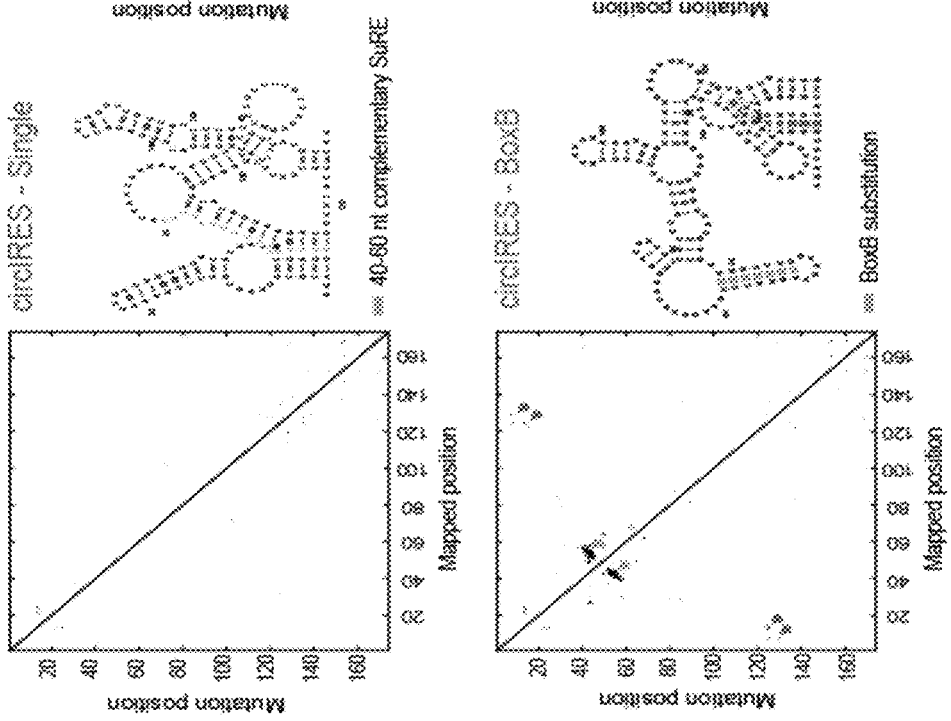
Figure 4I:
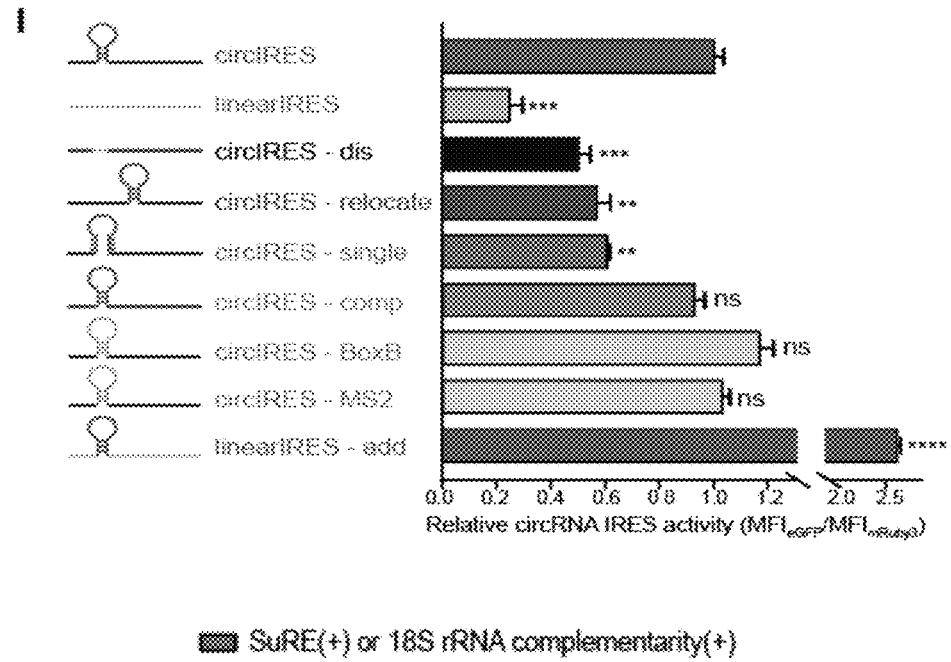

To test this hypothesis, the SuRE at 40-60 nt position on the circular IRES (oligo index: 6742) was disrupted by substituting it with the sequence extracted from the same position on the linear IRES (oligo index: 6885), forming a different secondary structure at this position (FIG. 4C). Interestingly, disrupting the SuRE at this position on the circular IRES leads to a reduction in its IRES activity (FIG. 4I). Moreover, to test if the SuRE element is position sensitive, the SuRE element was relocated from the 40-60 nt position to the 90-110 nt position by swapping the sequences of these two regions on the IRES. A decreased translation activity of the IRES was observed (FIGS. 4D and 4I). To further validate that the SuRE is structural dependent rather than sequence-dependent, compensatory mutagenesis of the SuRE element was performed. Specifically, each of the seven base pairs on the stem region of the SuRE element were mutated to disrupt its duplex structure. Lower translation activity of the IRES was observed (FIGS. 4E and 4I). Furthermore, the translation activity of the IRES can be rescued by compensatory double complementary mutations to restore each of the seven base pairs on the stem region (FIGS. 4F and 4I). Interestingly, when the SuRE was substituted with MS2 or BoxB, which have a similar RNA structure, the same IRES activity was observed as the wild-type IRES (FIGS. 4G and 4I), suggesting that the IRES activity regulated by the SuRE is indeed structure-dependent rather than sequence-dependent. Finally, the linear IRES was converted into a circular IRES by transplanting the SuRE from the circular IRES to the 40-60 nt position on the linear IRES (FIGS. 4H and 4I). The results above suggest that the 40-60 nt SuRE on the IRES can indeed facilitate circRNA translation.

Figure 4J:
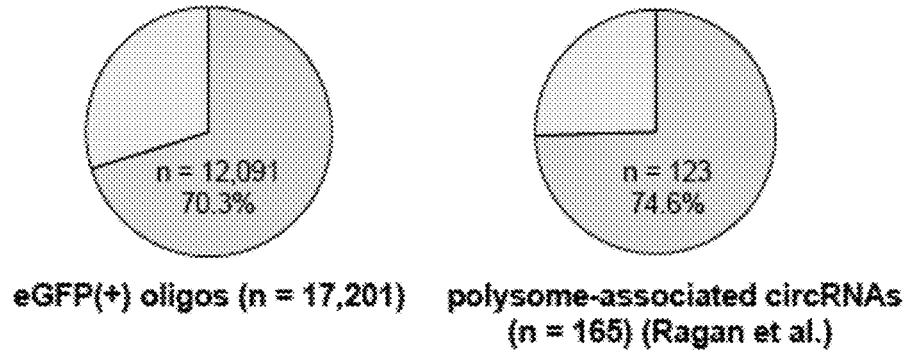
Figure 4K:
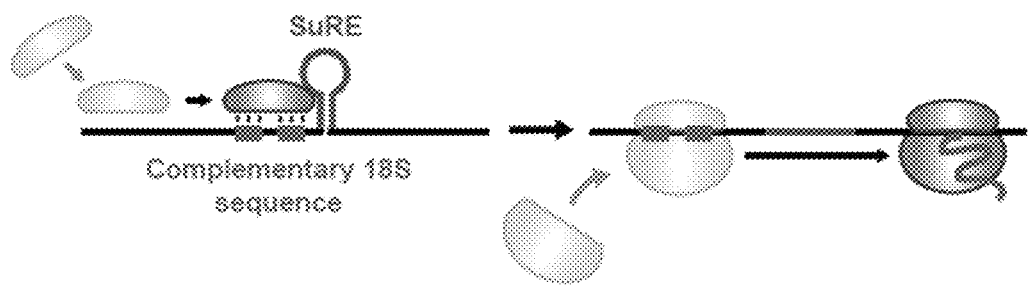

Together, the results above along with the 18S rRNA profiling suggest that two key regulatory elements on circRNA IRES, the 18S rRNA complementarity and 40-60 nt SuRE on the IRES, can facilitate cap-independent translation on circRNA. In line with this model, among the 17,201 eGFP(+) oligos captured by the screen, 12,091 of them (~70%) harbor high 18S rRNA complementarity (18S rRNA complementarity (+)) or 40-60 nt SuRE (SuRE(+)) (FIG. 4J), which suggests that these two regulatory elements can facilitate the exogenous reporter circRNA translation. To further validate if these two regulatory elements can also facilitate endogenous circRNA translation, the polysome-associated circRNAs (translating circRNAs) captured in HEK-293 cells (Ragan et al., 2019) were examined, and it was found that 123 out of 165 endogenous translate circRNAs (~75%) are 18S rRNA complementarity (+) or 40-60 nt SuRE(+) circRNAs (FIG. 4J), indicating that these two regulatory elements are common features among the endogenous translated circRNAs. These results suggest that the 18S rRNA complementarity and 40-60 nt SuRE can facilitate the translation of both exogenous reporter circRNAs and endogenous circRNAs. Nevertheless, no preferential localization of the 18S complementary sequence to the 5' or 3' of the SuRE was observed (FIG. 13C); this suggests that the SuRE on the IRES may cause a pause for RNA unwinding, increasing the chance for the 18S complementary sequence on the IRES to interact with the 18S 25 rRNA on the ribosome, and facilitate cap-independent translation on circRNAs (FIG. 4K).

Example 6

This example demonstrates that the IRES elements facilitate translation initiation of endogenous circRNAs.

Figure 5A:
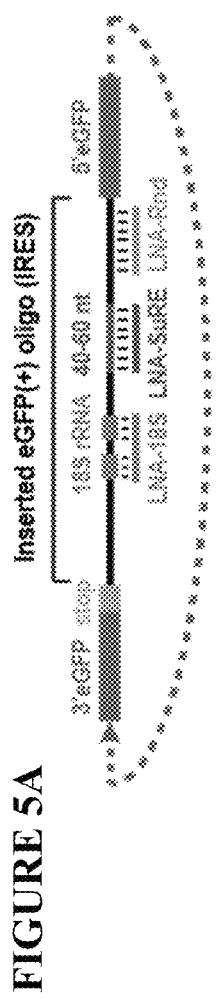
FIG. 5A-5E show that IRES elements facilitate translation initiation of endogenous circRNAs.
Figure 5B:
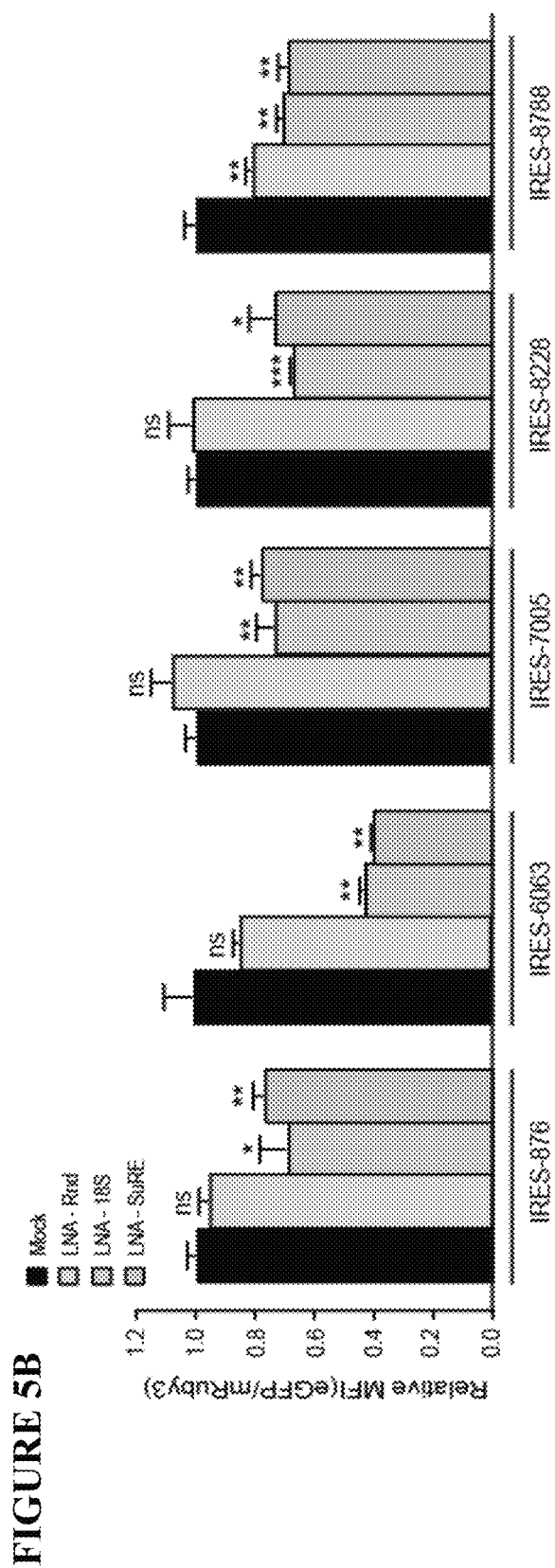
Figure 15A:
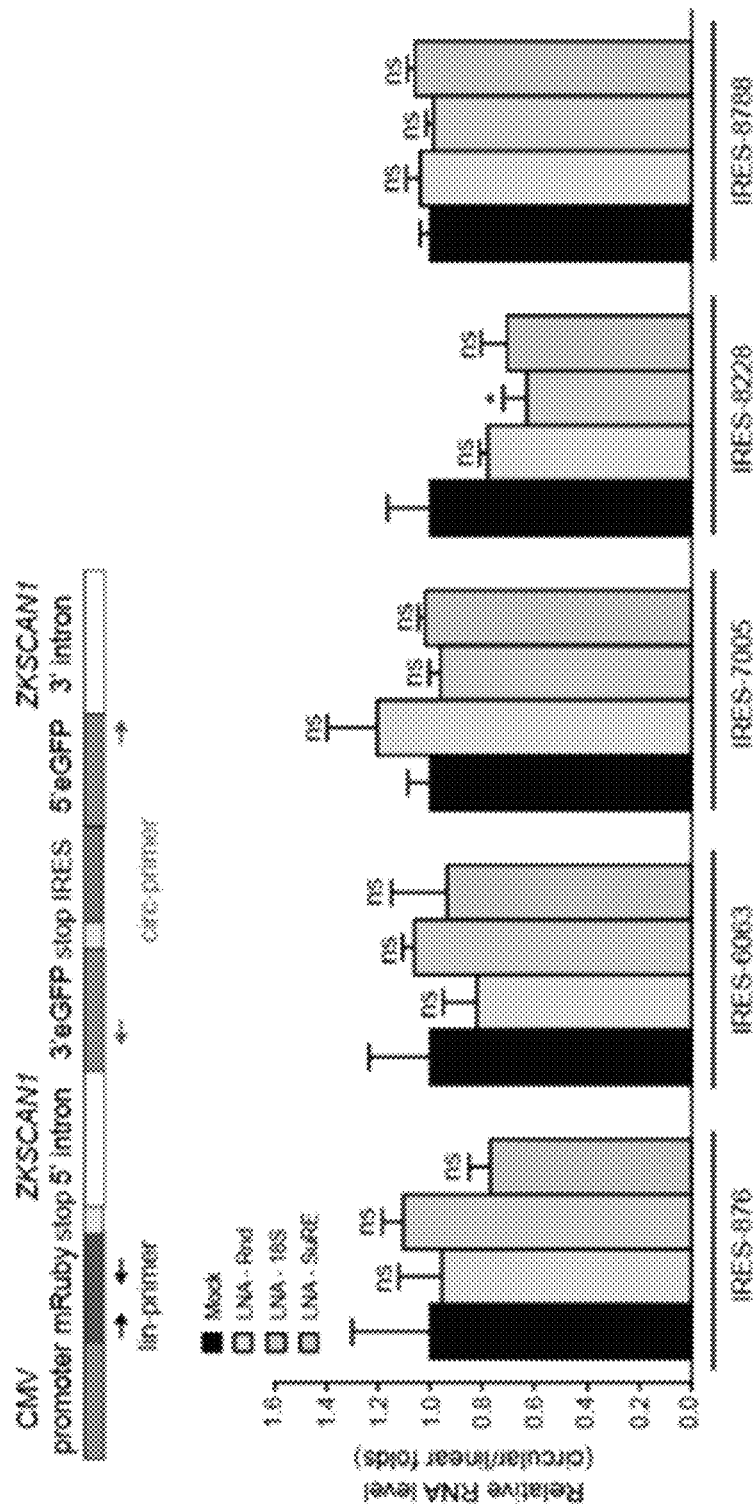
FIG. 15A-15B show that IRES elements facilitate translation initiation of endogenous circRNAs.

To examine if the key regulatory elements identified on the IRES, such as the 18S rRNA complementary sequence and the SuRE at the 40-60 nt position, can facilitate translation of human endogenous circRNAs, a locked nucleic acid (LNA) was utilized to disrupt these key elements on the IRES because LNA has been utilized to specifically disrupt the functional regions on the HCV IRES and inhibit HCV IRES activity. Anti-sense LNAs were designed targeting (i) the 18S rRNA complementary sequence on the IRES to block 18S rRNA binding to the IRES (LNA-18S), (ii) the SuRE at the 40-60 nt position to disrupt the SuRE on the IRES (LNA-SuRE), and (iii) random position downstream of the LNA-18S or LNA-SuRE on the IRES (LNA-Rnd) for identified IRESs (FIG. 5A). The LNAs were then co-transfected with the oligo-split-eGFP-circRNA reporter construct containing the corresponding IRES, respectively, and translation activity of the eGFP reporter was measured by its normalized fluorescence signal intensity. It was found that co-transfecting LNA-18S or LNA-SuRE can indeed disrupt the cap-independent translation activity of all IRESs (10 out of 10 LNAs), while most of the LNA-Rnd co-transfection did not affect the translation activity of the IRES (4 out of 5 LNAs) (FIG. 5B). It was also confirmed that the result was not confounded by the change of circRNA expression level because co-transfecting the LNAs generally did not change the circRNA expression level (FIG. 15A). The result suggests that disrupting the key elements on the IRES with LNA can affect the cap-independent translation activity of the exogenous reporter circRNA.

Figure 5C:
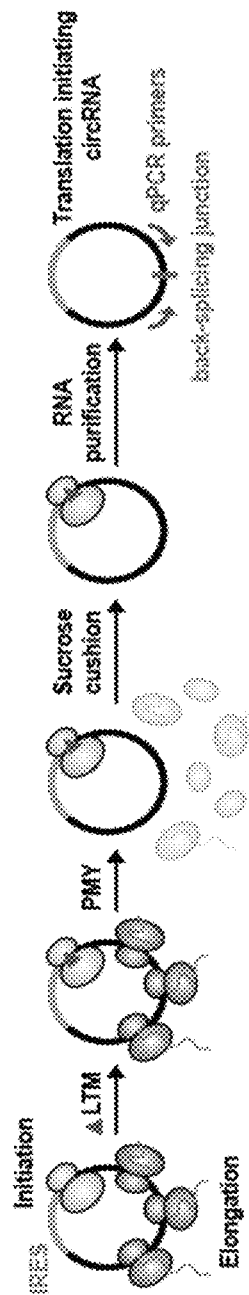
Figure 5D:
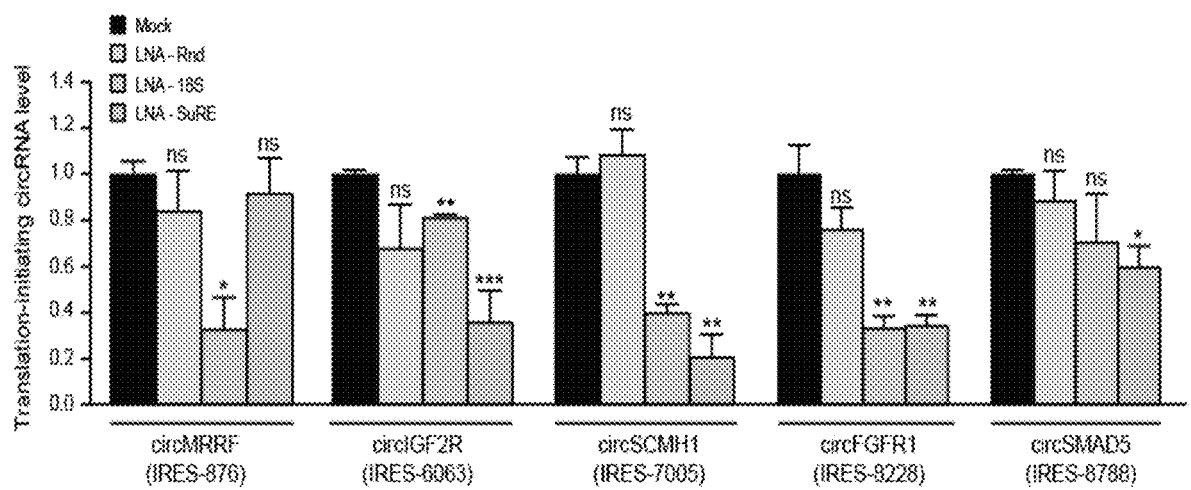
Figure 5E:
Figure 15B:
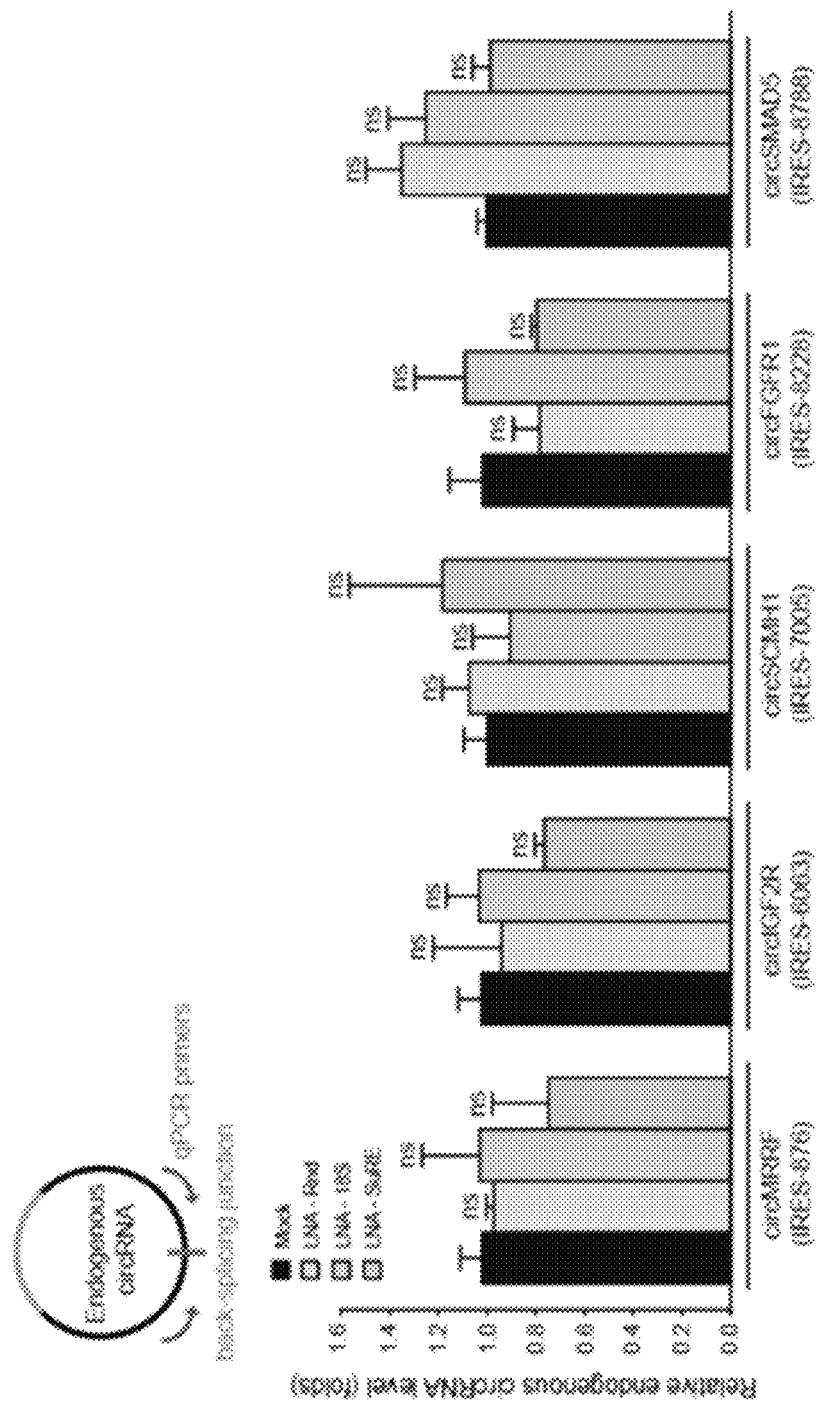

To further examine if the identified key regulatory elements on the IRES can also facilitate translation of human endogenous circRNAs, the cells were transfected with the corresponding anti-sense LNA and quantified translating circRNAs by the QTI method. Specifically, to isolate translating RNAs, LNA-transfected cells were treated with lactimidomycin (LTM) followed by puromycin (PMY) treatment, ribosome-associated RNAs were sedimented with sucrose cushion, and the translating RNAs were purified (FIG. 5C). The level of translating endogenous circRNA was then quantified, which contains the LNA-targeted IRES by qRT-PCR using the divergent primers spanning across the back-splicing junction of the circRNA. It was found that disrupting the key regulatory elements by LNA-18S or LNA-SuRE on the IRES of the endogenous circRNA can in general cause decreased translation activity of the circRNAs (8 out of 10 LNAs), while all the LNA-Rnd did not influence the translation activity of the endogenous circRNAs (5 out of 5 LNAs) (FIG. 5D). It was also confirmed that the LNA transfection did not change the expression level of the endogenous circRNAs (FIG. 15B). Since QTI method specifically captured the RNAs that are at the initiation stage of translation, it suggested that the decrease of endogenous circRNA translation observed upon LNA transfection came from the decrease in translation initiation. The results were further validated by quantifying the protein level produced from the endogenous circRNAs by Western blotting. The Western blotting result matched what was observed in the QTI-qRT-PCR result—disrupting the key regulatory elements on the IRES of the endogenous circRNA generally reduces the protein level produced from the circRNA (3 out of 4 LNAs) (FIG. 5E). The results above suggest that the key elements identified on the IRES, such as the 18S rRNA complementary sequence and the SuRE at the 40-60 nt position, are important for facilitating translation initiation of endogenous circRNAs.

Example 7

Figure 6A:
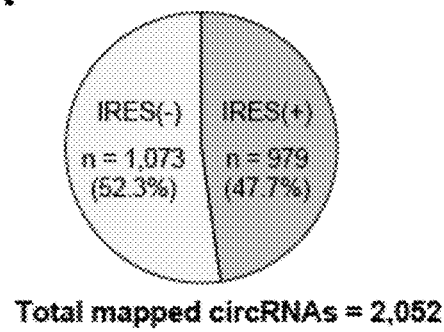
Figure 6B:
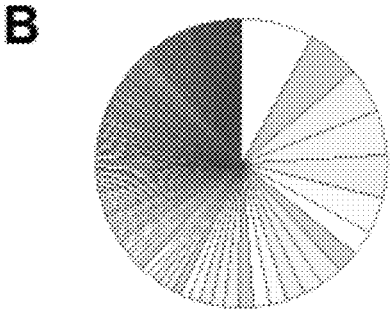
Figure 6C:
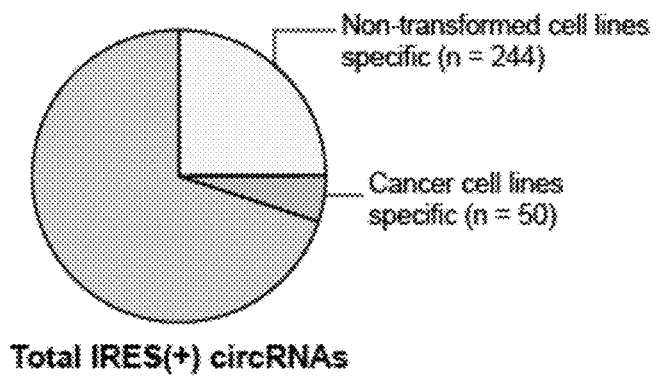
Figure 16A:
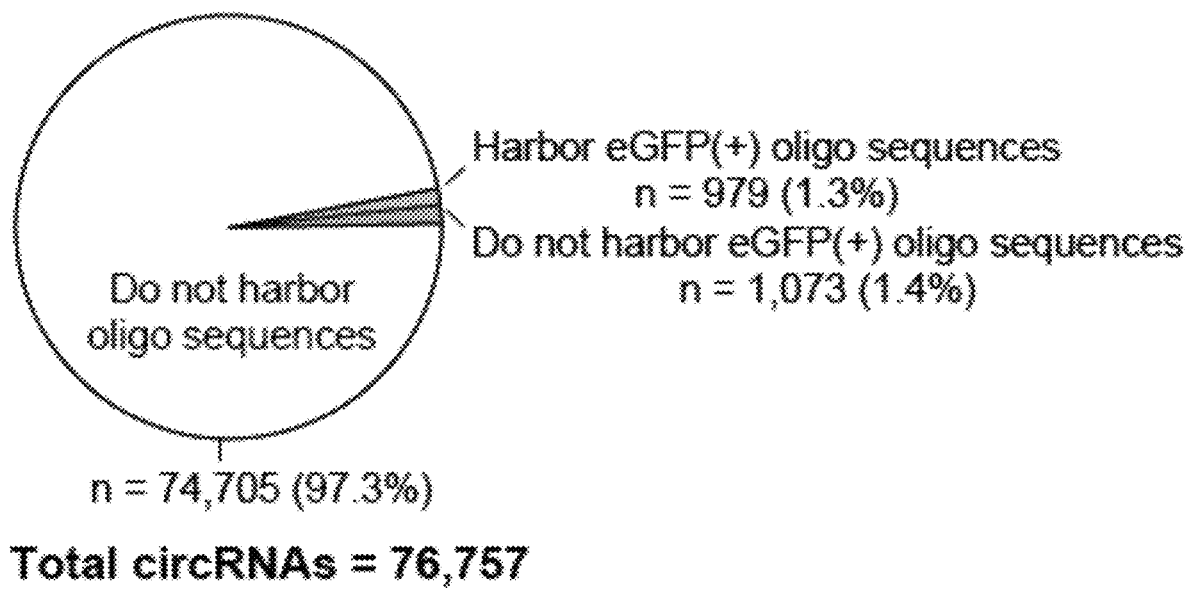

This example describes the identification of possible endogenous protein-coding circRNAs. Introducing synthetic IRES on circRNAs is sufficient to initiate cap-independent translation, suggesting that endogenous circRNAs harboring the active circular IRES may have the potential of producing proteins with cap-independent translation. Thus, to determine the potential circRNA proteome, the eGFP(+) oligo sequences captured in the screens to the human circRNA database (circBase) (Glazar et al., RNA 20, 1666-1670 (2014)) to identify the endogenous circRNAs which harbor the active IRES. Data was gated against false positive by only considering circRNAs that have been annotated by two different circRNA prediction algorithms, and only including circRNAs with high mapping score in this analysis. The result suggested a high proportion of the endogenous circRNAs are potentially protein-coding: Out of 2,052 endogenous circRNAs containing the oligo sequences from the synthetic library used for the screening assay, 979 circRNAs (~48%) contain one or more eGFP(+) oligo sequences (IRES(+) circRNAs) (FIG. 6A, FIG. 16A, Table 6). These circRNAs were generated from various parent genes which showed a fairly homogenous distribution across the genome (Gini index=0.38) (FIG. 6B). To further determine if these IRES(+) circRNAs are associated with cancer progression, the cancer-specific circRNA database (CSCD) (Xia et al., Nucleic Acids Res 46, D925-D929 (2018)) was examined, which contains the collection of potential cancer-associated circRNAs by analyzing the RNA-seq data of 228 cancer and normal cell lines. Interestingly, it was discovered that 294 of 979 IRES(+) circRNAs (~30%) are expressed specifically in either non-transformed cell lines (n=141 cell lines) or cancer cell lines (n=87 cell lines across 19 cancer types), respectively (FIG. 6C), indicating their potential association with cancer progression.

Figure 16B:
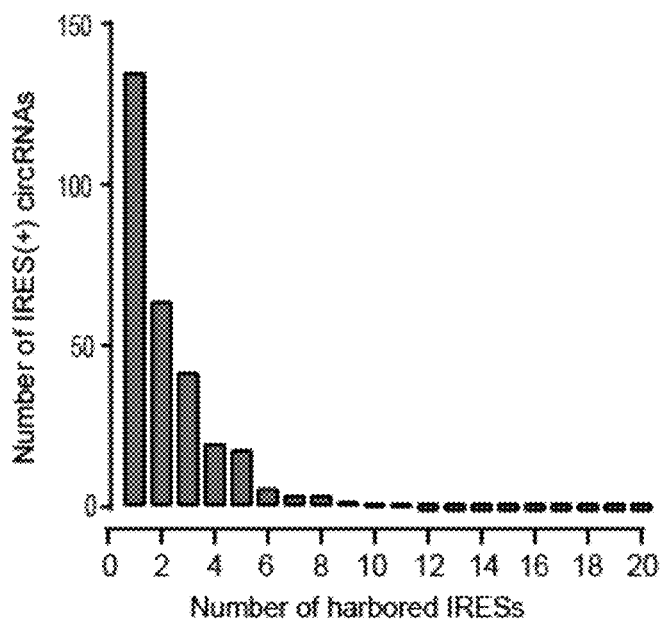
Figure 16C:
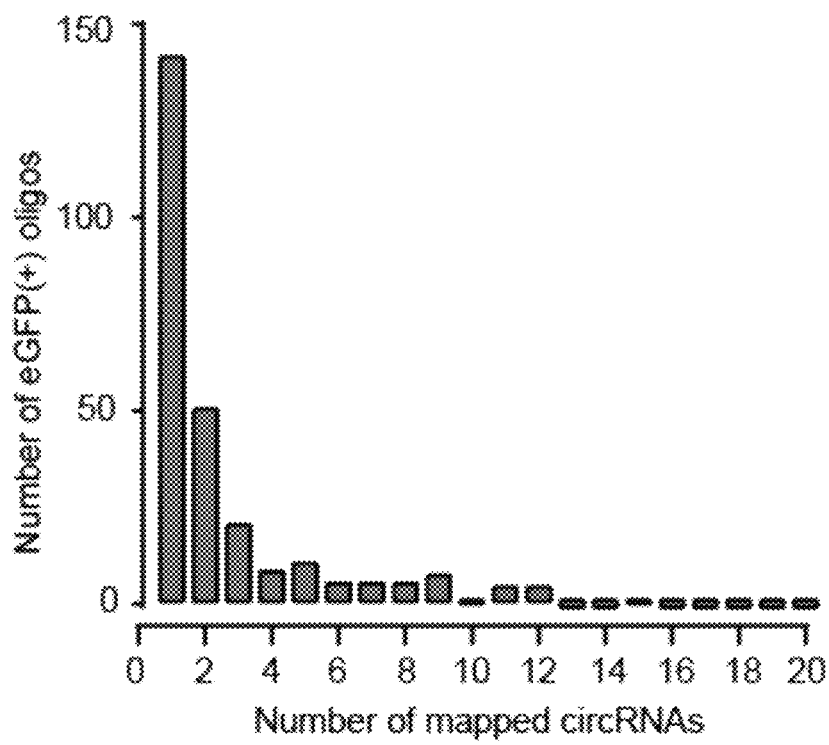
Figure 16D:
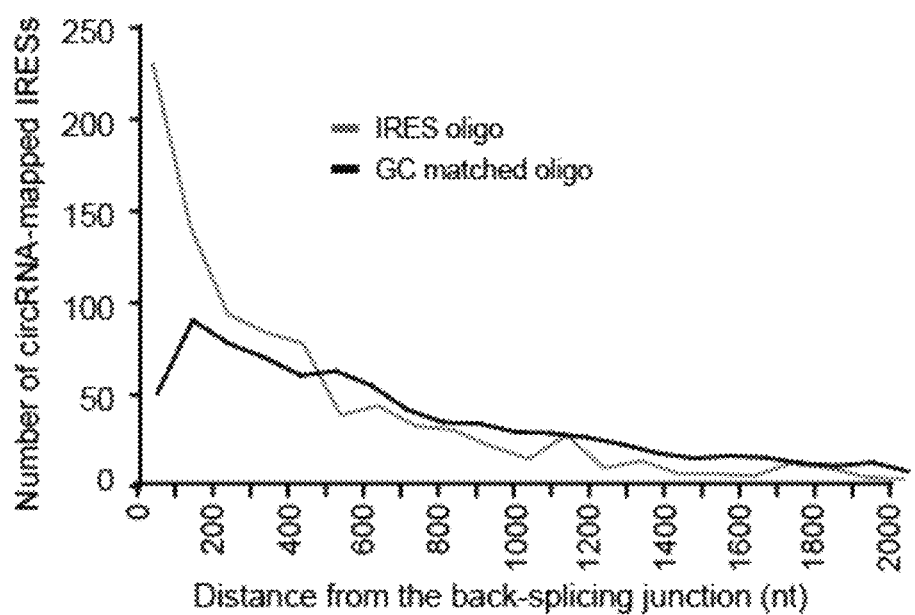

It was discovered that most IRES(+) circRNAs contain only one IRES (FIG. 6D) and most eGFP(+) oligos map to only one circRNA (FIG. 6E), suggesting a specific one-to-one relationship between these IRES(+) circRNAs and the proteins encoded by them. This result is expected in part based on the library design. In addition, for 159 transcripts for which oligos tiling across the entire transcripts were designed, a preponderance of one IRES per circRNA was observed (FIGS. 16B and 16C). Thus, circRNA IRES would have been difficult, if impossible, to discover by comparative sequence analysis across circRNAs, but can be discovered by unbiased functional screening. The result also suggests that circRNA IRES activity may require long RNA sequences which are more likely to show up once per transcript, rather than very short or repetitive sequences that would show up multiple times per transcript. Furthermore, it was discovered that the position of mapped eGFP(+) oligos on circRNAs is most frequently near the back-splicing junction of the circRNA (within 100-200 nt from the junction), while the average position of GC-matched oligos (the 174 nt oligos on the IRES-mapped circRNA with the same GC content as the mapped eGFP(+) oligo) showed a random distribution across a wide range of distance from the back-splicing junction on the circRNAs (100 to 2000 nt from the junction) (FIG. 16D). This result suggests that the cap-independent translation activity of the IRES on the circRNA is back-splicing dependent—the IRES element or its downstream open reading frame (ORF) is only assembled upon back-splicing. This requires the IRES to be located in the proximity of the junction to facilitate its cap-independent translation activity. Finally, gene ontology (GO) analysis of the parent genes of these circRNAs suggested that they are enriched in stress-response and translation regulation (FIG. 6F). Above all, these results demonstrated that with the identified eGFP(+) oligo sequences, it is possible to determine endogenous circRNAs with potential cap-independent translation activity that may encode new protein isoforms.

Example 8

This example describes the identification of potential endogenous circRNA-encoded polypeptides.

Figure 6G:
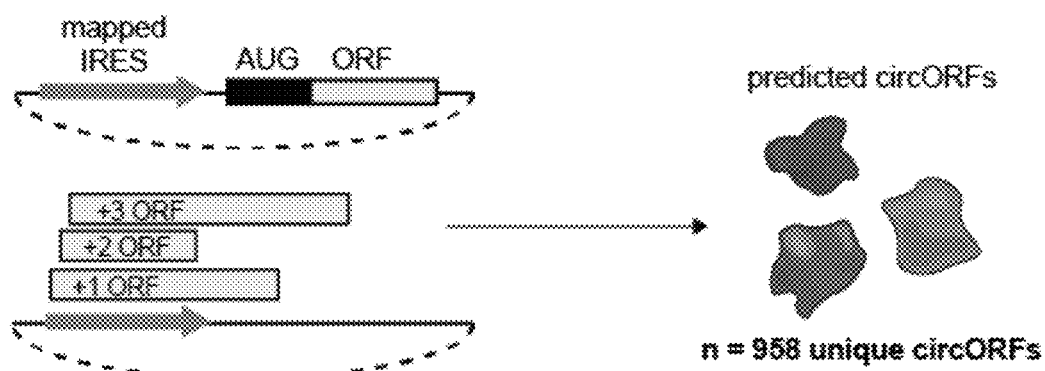

In order to determine the polypeptide sequence of proteins encoded by RNA, protein-coding sequence on the RNA were defined. This is commonly achieved by ORF analysis. However, ORF analysis on circRNAs often returns a large number of results due to the lack of information of where translation initiates on the circRNA. The data presented herein can map the position of eGFP(+) oligo sequences on the circRNA, which allows for determination of the regions on circRNAs where the translation start sites may be located. Thus, to determine the potential polypeptide sequence of the proteins encoded by the endogenous circRNAs, the eGFP(+) oligo sequences were mapped to the sequence of each individual high-confident circRNA in the circBase (pre-gated the high confident circRNAs as described above) to determine the location of the IRES on each circRNA (FIG. 6G). Predicted polypeptide sequences of the protein(s) encoded by each circRNA were then generated by performing ORF analysis from the immediate downstream translation initiation codon (AUG) of the mapped IRES location (FIG. 6G). Because many IRES have been reported to be able to initiate translation from non-canonical initiation codons, ORF analysis was also performed on the top three frames (+1 to +3) with non-canonical initiation codons from the mapped IRES position (FIG. 6G). With this method, a list of predicted polypeptide sequences encoded by human endogenous circRNAs (circORFs) was generated. To be conservative, micropeptides encoded by linear RNAs were also examined and any overlapped circORFs were excluded in the final list (n=5 overlapped circORFs). The final list contains 958 potential circORFs encoded by endogenous circRNAs (FIG. 6G, SEQ ID NO: 32954-33911, Tables 7A and 7B).

Figure 16G:
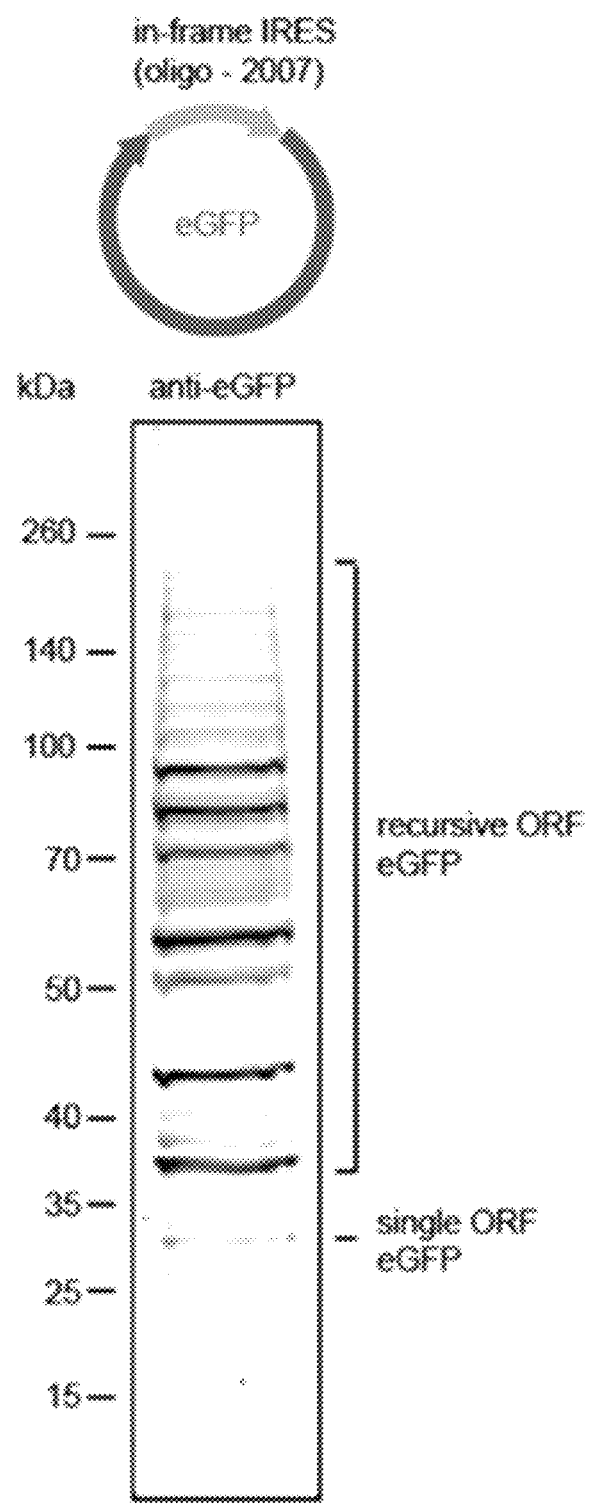

By analyzing the circORF sequences and mapped IRES position on the circRNAs, it was discovered that some circRNAs contain the IRES sequence overlapping the translated region of the ORF (n=457; ~48%) (FIG. 16E). The IRES-overlapping ORF has been observed in some endogenous circRNA-encoded proteins, which suggests some regulatory mechanisms may exist between the initiation and the elongation of circRNA translation. Interestingly, among these circRNAs with IRES-overlapping ORFs, some of them contain in-frame ORFs without stop codons (n=82; ~18%), forming recursive ORFs which may be the mechanism of amplifying the expression level of the circRNA-encoded proteins (FIG. 16F). It was further demonstrated that the in-frame IRES can indeed produce recursive ORF on the eGFP circRNA reporter (FIG. 16G).

Figure 6H:
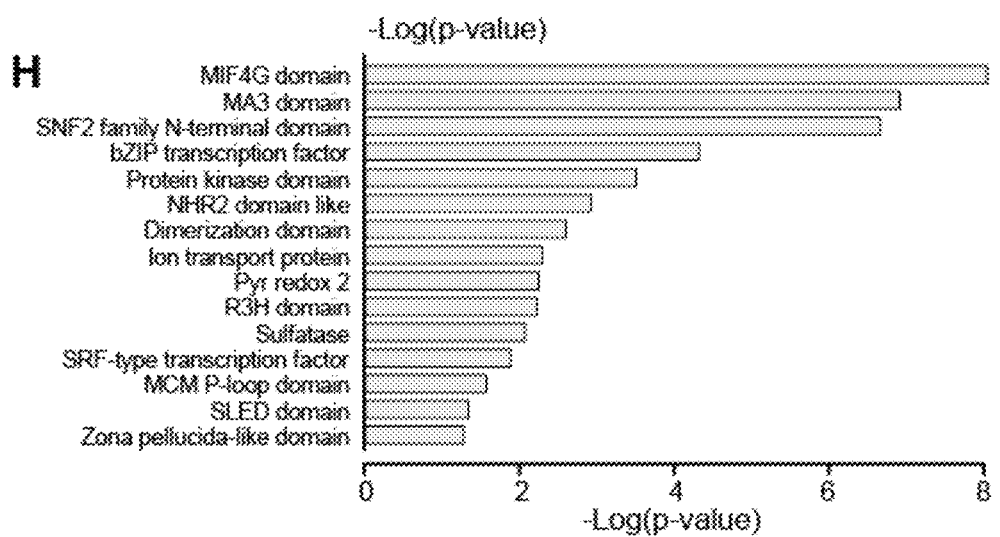
Figure 16H:
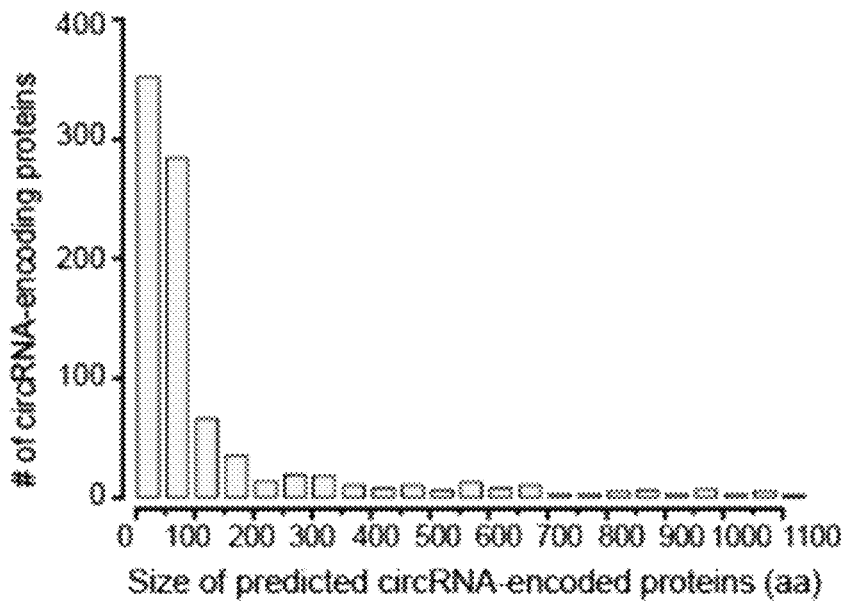

Next, it was the general functions of these potential circORFs were characterized by searching for conserved motifs on the predicted polypeptide sequences. Pfam analysis revealed that a substantial number of circORFs contain conserved motifs. The top motifs are DNA binding motifs, translation elongation factors binding motifs, protein kinase domains, and protein dimerization domains (FIG. 6H), suggesting that circORFs may play roles in regulating various biological functions including signal transduction, transcription, and translation. The size of most of these potential circORFs was small (<100 amino acids) (FIG. 16H), which suggests that the majority of them may be the truncated forms of the proteins generated from their parent linear transcripts.

Figure 16I:
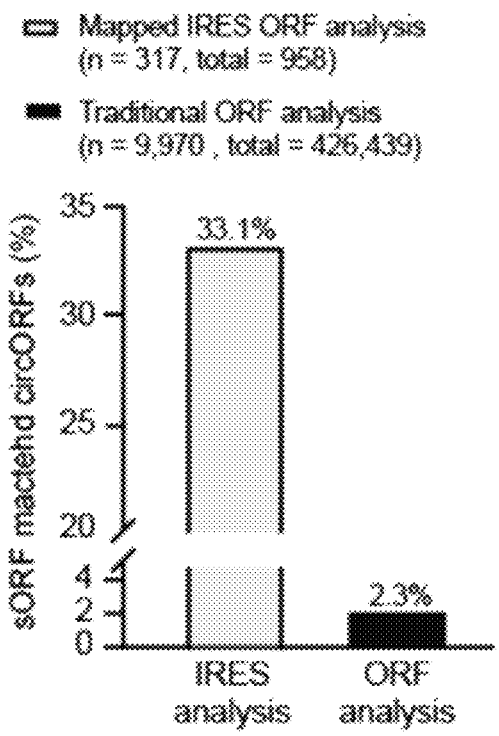

To further validate the potential circORFs, the short open reading frame (sORFs) database was examined (Olexiouk et al., Nucleic acids research 46, D497-D502 (2017)), which contains the polypeptide sequences (<100 amino acids) from the identified sORFs aggregated by multiple ribosome profiling studies, to checked if the polypeptide sequences of these sORFs can match the circORFs. The sORFs were first mapped to the current proteome database (UniProt) and those sORFs that completely matched the ORFs of the annotated linear transcripts were excluded. The remaining sORFs were then mapped to the potential circORFs. 317 predicted circORFs were identified, which can be matched by the sORFs (~33%) (FIG. 16I), suggesting that the mapped IRES ORF analysis method can identify endogenous circORF efficiently. On the other hand, traditional ORF analysis on the same circRNAs, which takes all possible translation initiation locations, gives a huge number of predicted polypeptides (n=426,439), where only a very small fraction of those polypeptides were captured by sORF studies (n=9,970; ~2%) (FIG. 16I). Thus, knowledge of the circRNA IRES led to an ~15-fold improvement in predicting circRNA derived sORFs. Together, the result suggests that in comparison to traditional ORF analysis, the mapped IRES ORF analysis is able to identify endogenous circORFs more efficiently.

Figure 6I:
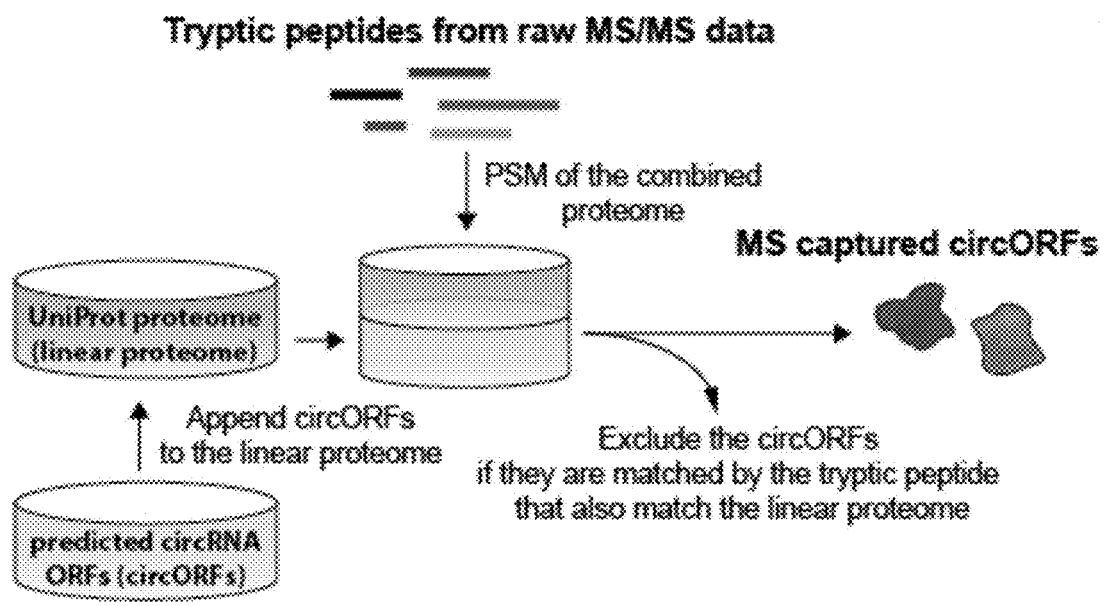
Figure 6J:
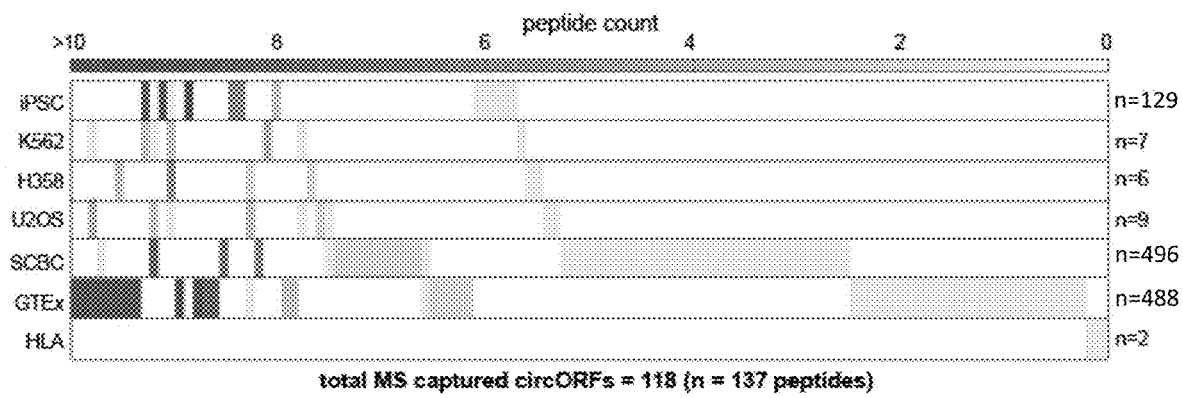
Figure 6K:
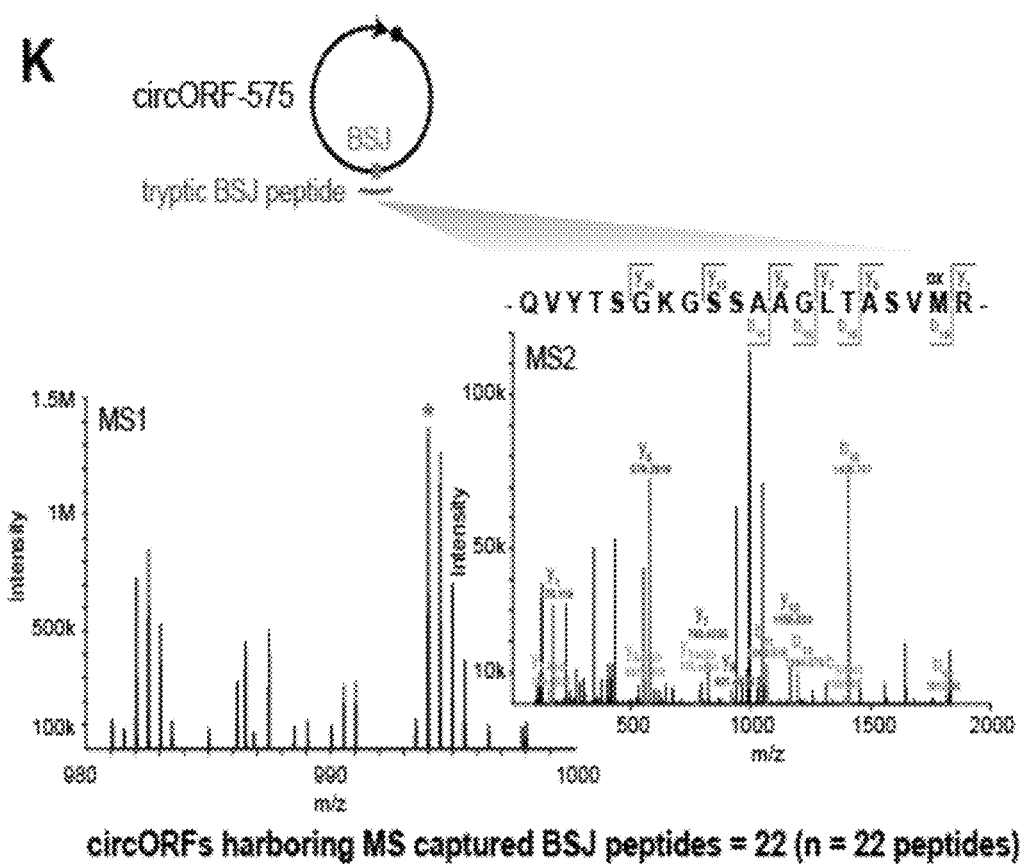
Figure 6L:
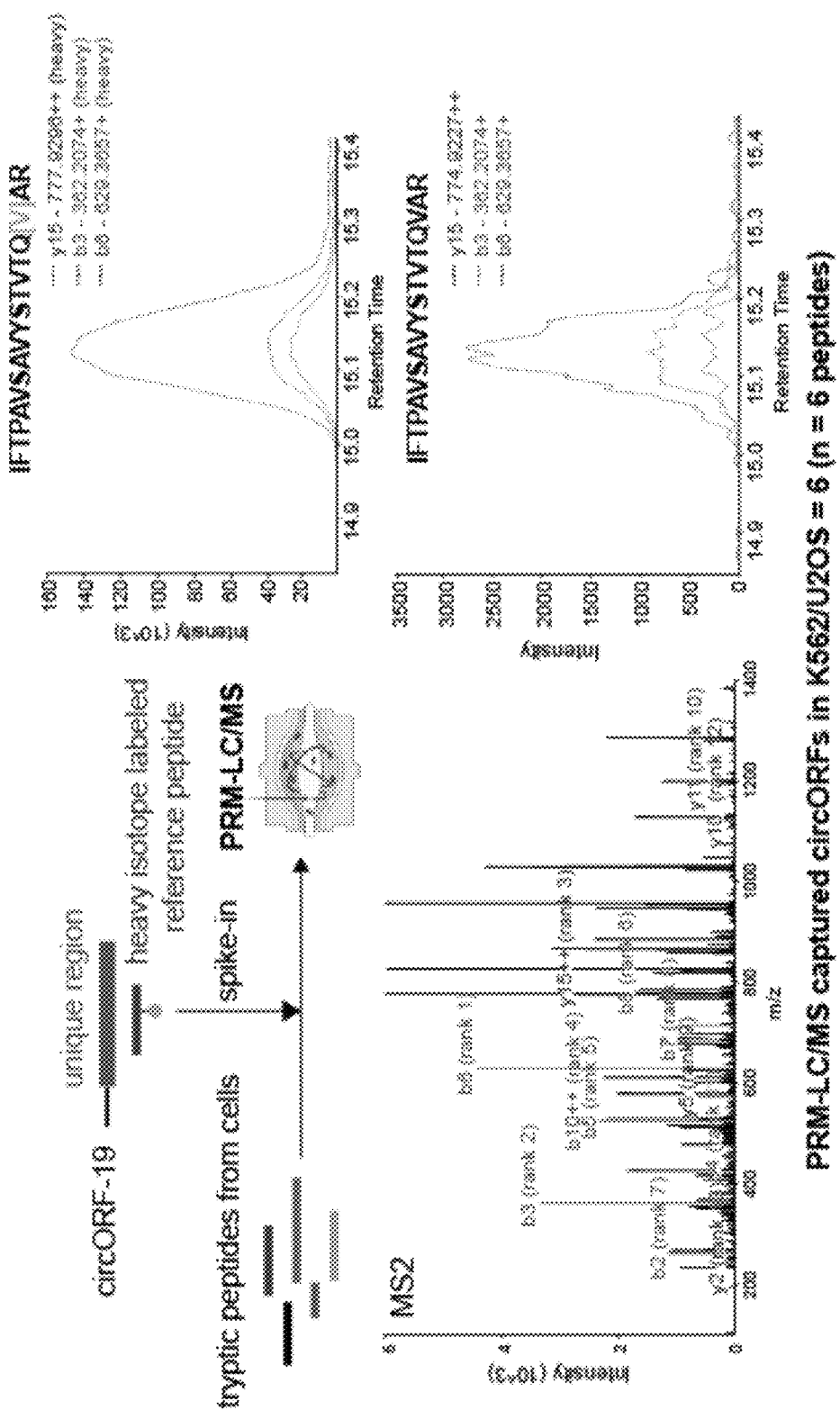
Figure 16J:
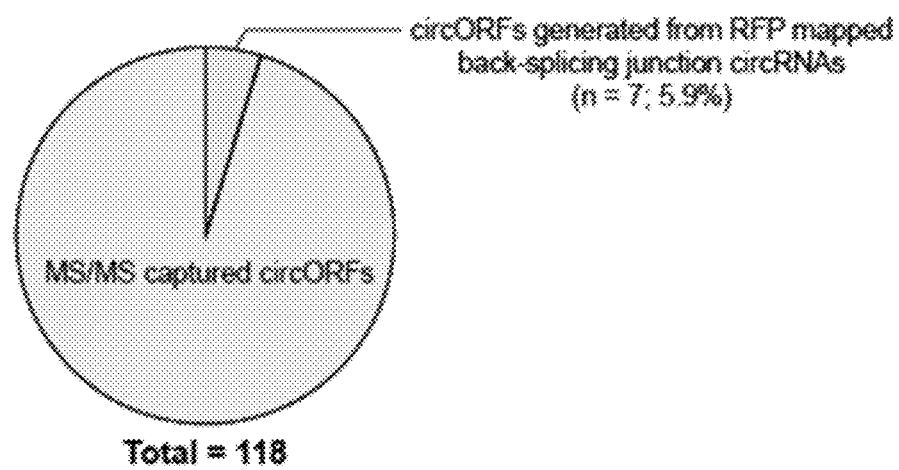

Subsequently, peptidomic analyses was performed on the tandem mass spectrometry (MS/MS) datasets to validate the endogenous expression of the circORFs. Specifically, the predicted circORF list was appended to the current proteome database (UniProt; linear proteome) and generated a combined proteome database (circORFs+linear proteome). The raw MS/MS data was then taken from a wide range of cell lines, including K562, H358, U2OS, subcellular compartments SubCellBarCode (SCBC) database, and 32 normal human tissues from the GTEx collection and performed peptide-spectrum match (PSM) against the combined proteome database (FIG. 6I). To distinguish circORFs from the linear proteome, the circORFs were excluded if the circORFs are matched by the tryptic polypeptides that can also match the linear proteome (FIG. 6I). 118 circORFs harboring MS-matched unique tryptic polypeptides (FIG. 6J) were captured, in which 22 circORFs harboring MS-matched tryptic polypeptides spanning across the circRNA back-splicing junction (BSJ) (FIG. 6K). In addition to the transformed cell lines, circORFs in the peptidomics of normal human tissues were captured (Jiang et al., 2020), suggesting that these circORFs are expressed in normal human cells. Moreover, parallel reaction monitoring-MS (PRM-MS) was performed to provide high resolution validation of the circORF expression in K562 and U2OS. Specifically, the heavy isotope-labeled reference polypeptides of the unique region of the circORFs identified from the K562 and U2OS MS/MS peptidomics were designed and synthesized, the labeled reference polypeptides were spiked in to the tryptic polypeptide samples, and precursor and transition ions detection was performed according to the labeled reference polypeptides (FIG. 6L, SEQ ID NO: 32954-33911, and Tables 7A and 7B). The PRM-MS further validates the existence of 6 out of 8 targeted circORFs (FIG. 6L, SEQ ID NO: 32954-33911, and Tables 7A and 7B). The MS/MS and the PRM-MS peptidomics provide strong evidence demonstrating the circORFs are indeed expressed endogenously. As a complementary approach, the ribosome footprinting (RFP) data was examined in human iPSCs (Chen et al., Science (2020) 367(6482):1140-1146), and it was found that 7 MS/MS detected circORFs contain at least one RFP fragment overlapping uniquely with the circRNA back-splicing junction (FIG. 16J). Together, these results suggest that it is possible to build a putative circORF list using the circRNA IRES screening assay which can be validated by genomic and peptidomic analyses.

To further examine if the circORFs are involved in antigen presentation, the human leukocyte antigen I (HLA1)-associated peptidomics was analyzed (Bassani-Sternberg et al., 2015). Two HLA1-associated circORFs were identified (FIG. 6J). In silico HLA1 binding predictor NetMHC4.1 analysis (Reynisson et al., 2020) suggests that these two circORFs are indeed strong HLA1 binder to the HLA1 variants expressed in the cell line used in HLA1 peptidomics (HLA-A03:01 for circORF_674 in fibroblast; HLA-C07:02 for circORF_917 in JY) (Tables 7A and 7B). The result indicates a new functional role of circORFs that some of the circORFs may enter the HLA-I presentation pathway and contribute to the antigen repertoire.

Figure 16K:
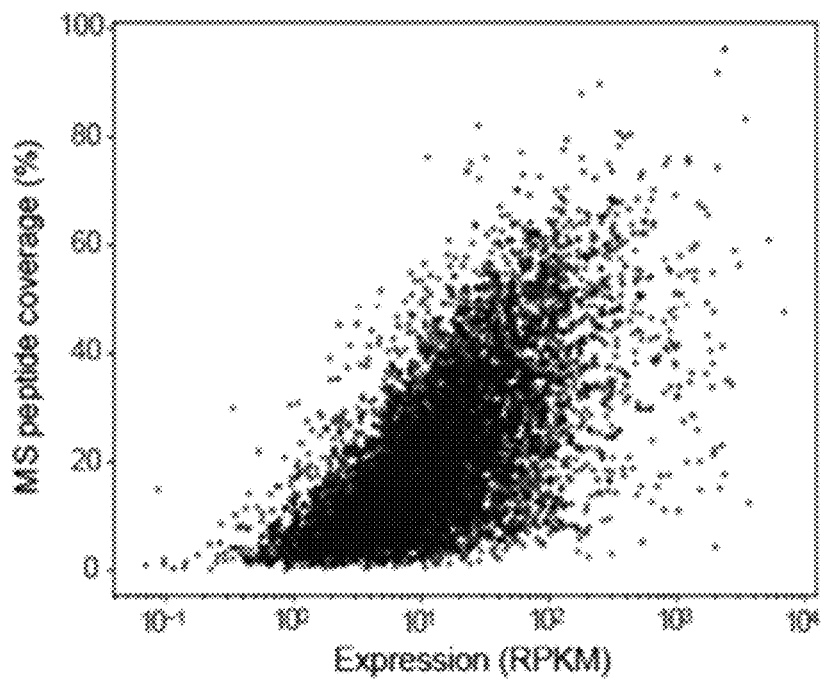
Figure 16L:
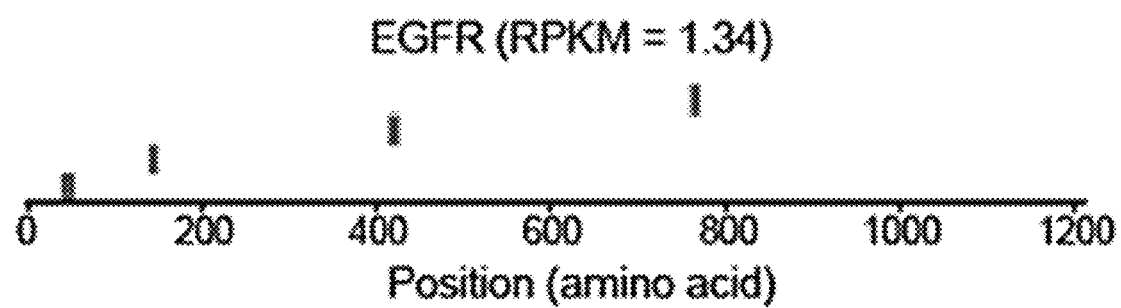

Notably, circORF detection by MS-based peptidomics is limited by (i) insufficient power to capture low abundance circORFs arising from low circRNA expression level in general, (ii) potential instability of circRNA-encoded polypeptides, (iii) the intrinsic difficulties to detect generally short circORFs, (iv) the number of cell lines/types of peptidomic datasets available, and (v) the narrow reference space of circORF unique polypeptides since all the regions that are shared by circORF and the linear proteome were excluded. Given the limitations of circORF peptidomics, identification of circORFs was interpreted as positive validation; the absence of detection in MS proteomic data does not rule out the translational potential for circRNA candidates. In line with the limitations above, when the same limitations were applied to proteins encoded by known mRNAs, matching for expression level and the cell line examined, and down-sampled reference space, it was found that current peptidomic data can only recover ~5% polypeptides of the protein encoded by the mRNA with the same RPKM as the mean circRNA RPKM (FIGS. 16K and 16L). Moreover, the expected discovery rate of circORFs is estimated to be ~4% since, since only the circORF unique regions are searched. The fact that it is possible to validate ~12.3% (118 out of 958) circORFs with peptidomics, which is much higher than the expected discovery rate for circORFs, further highlights that the approach disclosed herein can efficiently identify candidate endogenous circORFs, and supports the contention that circRNAs widely encode polypeptides similar to moderately expressed mRNAs.

Example 9

This example demonstrates that circFGFR1p suppresses cell proliferation under stress conditions through a dominant-negative regulation.

To evaluate the potential functions of the expanded circRNA proteome, an example of a potential protein-coding circRNA, hsa_circ_0084007, was chosen, and the function of its encoded protein was further examined. The circRNA is generated from the back-splicing of the exon 2 and the exon 7 of the human Fibroblast Growth Factor Receptor 1

(FGFR1) transcript; hence the names circFGFR1 and circFGFR1p were used to refer to this circRNA and its encoded protein, respectively. Down-regulation of circFGFR1 has been observed in clinical cancer patient samples, which may suggest its role in regulating important biological processes. CircFGFR1 harbors an IRES showing strong eGFP expression in the screening assay (top 2%), located in the 5' UTR region of FGFR1 followed immediately by an annotated AUG translation start codon (FIG. 7A). ORF analysis using the immediate downstream AUG revealed that the back-splicing generates a de novo stop codon within the IRES of circFGFR1, resulting in an ORF that partially overlaps with the IRES (circORF_949) (FIG. 7A). To better characterize the phenotype and the function regulated by circFGFR1, a non-transformed human cell line, BJ fibroblasts, was utilized for subsequent analysis. This cell line has a diploid genome for better phenotypic analysis and high FGFR1 expression. First, it was checked whether circFGFR1 expression can be detected in BJ cell by reverse transcriptase PCR (RT-PCR) and Sanger sequencing using the divergent primers flanking the back-splicing junction of the exon 2 and the exon 7 on circFGFR1 (FIG. 7B). The results demonstrated that circFGFR1 expression in BJ cells can successfully be detected.

Figure 17A:
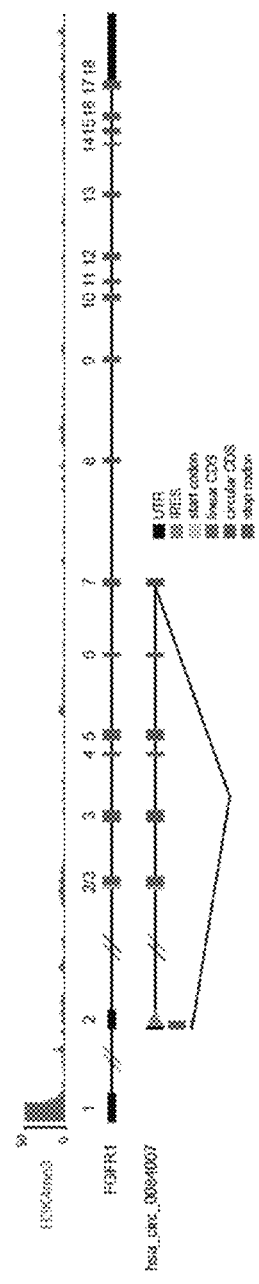
FIG. 17A-17I show that circRNA-encoded circFGFR1p suppresses cell growth under stress conditions.

Analysis of the predicted protein sequence indicated that circFGFR1p encodes a truncated form of FGFR1, which has an intact extracellular fibroblast growth factor 1 (FGF1) ligand-binding site, part of the dimerization domain (IgI, IgII, and partial N' terminus of IgIII) but lacks the intracellular FGFR1 tyrosine kinase domain (FIG. 7C). CircFGFR1p also harbor a unique region due to circFGFR1 back-splicing, where the polypeptide sequence of this region does not present in the linear proteome (UniProt) database (FIG. 7C). Western blotting using an antibody against the common region of circFGFR1p and FGFR1 (Ab-both) showed signals at the corresponding size of circFGFR1p (~38 kDa) and FGFR1 (70-90 kDa) (FIG. 7K). ENCODE data demonstrated an absence of chromatin signature of promoters (H3K4me3) near circFGFR1p IRES (FIG. 17A), suggesting the protein was not generated from the truncated linear transcript due to hidden promoters located in the exon 2 of FGFR1. In line with the observation above, the circFGFR1 IRES identified (oligo index: 8228) does not display promoter activity from the linear RNA IRES reporter screens (score=0) (Weingarten-Gabbay et al., 2016).

Figures 7D, 7E, 7F:
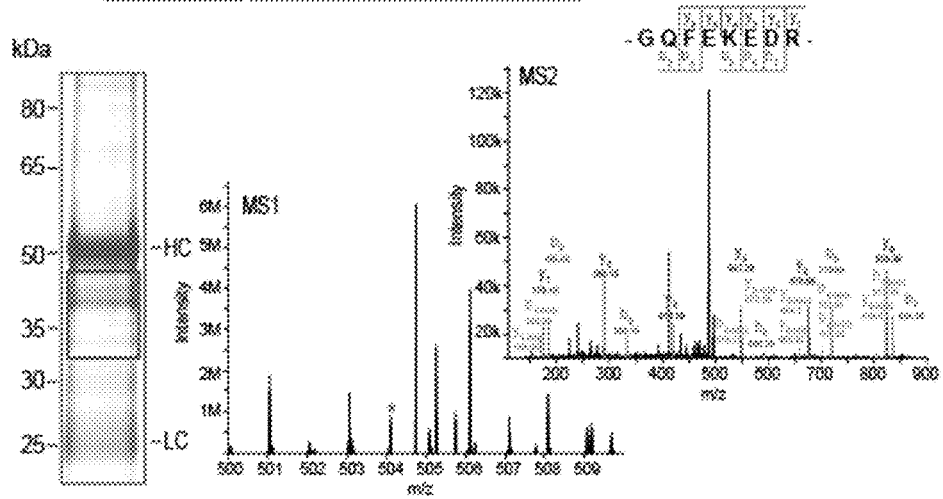

To validate endogenous circFGFR1p expression, a custom antibody against the unique region of circFGFR1p was generated. circFGFR1p was isolated by immunoprecipitation (IP) using the custom antibody, and proteins (size selected ~30-45 kDa on a polyacrylamide gel to separate circFGFR1p from FGFR1) were subjected to liquid chromatography with tandem mass spectrometry (LC-MS/MS) (FIG. 7D). While no circFGFR1p polypeptides were detected in the IgG control sample, it was possible to detect the tryptic polypeptides of the unique region of circFGFR1p as well as the tryptic polypeptides overlapped with the linear FGFR1 in the IP-LC-MS/MS sample (FIG. 7D). The result suggests that circFGFR1p is indeed expressed and can be captured by the circFGFR1p antibody. To further confirm circFGFR1p expression in high resolution, PRM-MS was performed using a synthetic heavy isotope-labeled reference polypeptide of the circFGFR1p unique region. It was possible to identify the corresponding precursor and transition ions of the labeled reference polypeptide and the sampling tryptic polypeptide from BJ cells, respectively (FIG. 7E). Collectively, the IP-MS and the PRM-MS provide the strong evidence demonstrating endogenous circFGFR1p expression.

Figure 17B:
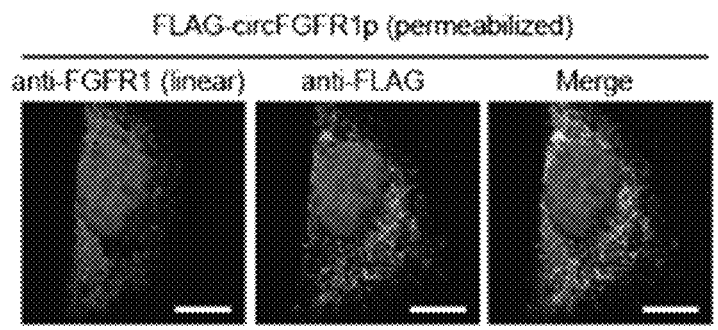
Figure 17C:
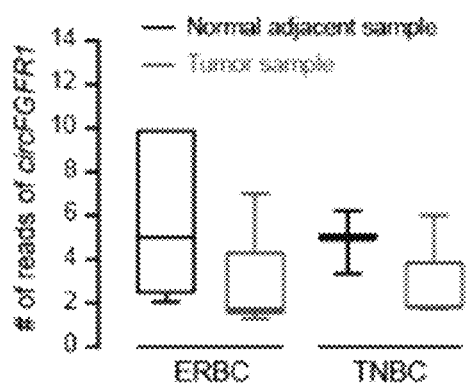
Figure 17D:
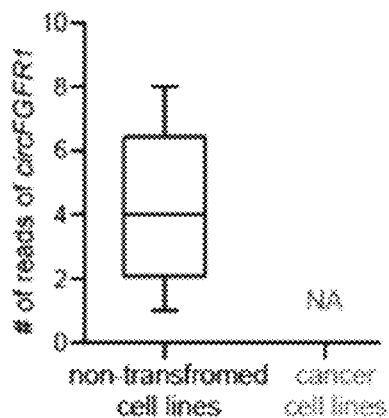

Upon binding to FGF, full-length FGFR1 dimerizes and autophosphorylates the kinase domain, which further triggers the downstream signaling pathway and facilitates cell proliferation. By co-expressing HA-tagged FGFR1 and FLAG-tagged circFGFR1p in HEK-293T cells and co-staining HA- and FLAG-tag to label FGFR1 and circFGFR1p respectively, it was confirmed that circFGFR1p is localized at the cell membrane in patchy domains and endosomes similarly to FGFR1 (FIG. 7F and FIG. 17B). CircFGFR1 contains the FGFR1 dimerization/ligand-binding domain but lacks the kinase domain, suggesting circFGFR1p may function as a dominant-negative regulator of FGFR1 that suppresses cell proliferation. Moreover, lower circFGFR1 expression level was found in the tumor samples of different subtypes of breast cancer in comparison to the normal adjacent samples from studies analyzing the RNA-sequencing data from The Cancer Genome Atlas (TCGA) (FIG. 17C). In addition, circFGFR1 expression was detected specifically in the non-transformed cell lines (n=5 unique non-transformed cell types out of 141 non-transformed cell line samples), but not in the cancer cell lines (n=87 cancer cell lines out of 87 cancer cell line samples) on the CSCD database (Xia et al., 2018) (FIG. 17D). These studies suggest that reduced circFGFR1 expression level may be associated with cancer progression by upregulating cell proliferation. Thus, circFGFR1p appears to function as a negative regulator of FGFR1 through a dominant-negative mechanism that suppresses cell proliferation.

Figure 7G:
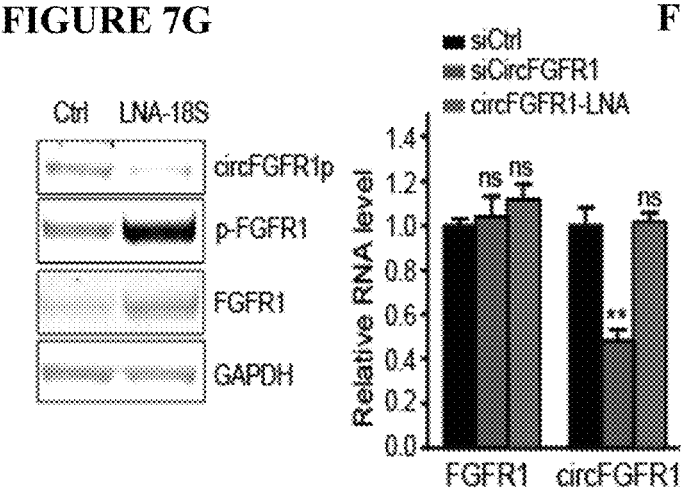
Figure 7H:
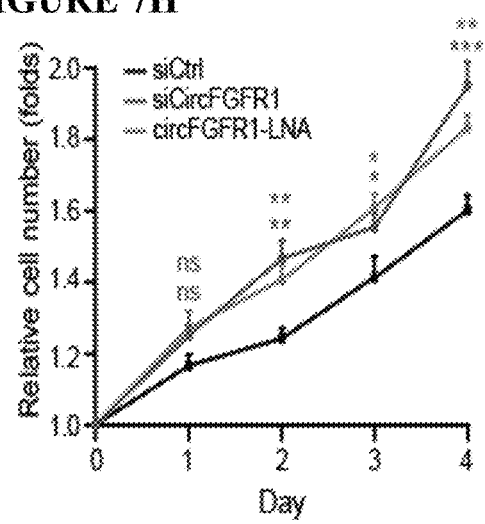
Figure 7I:
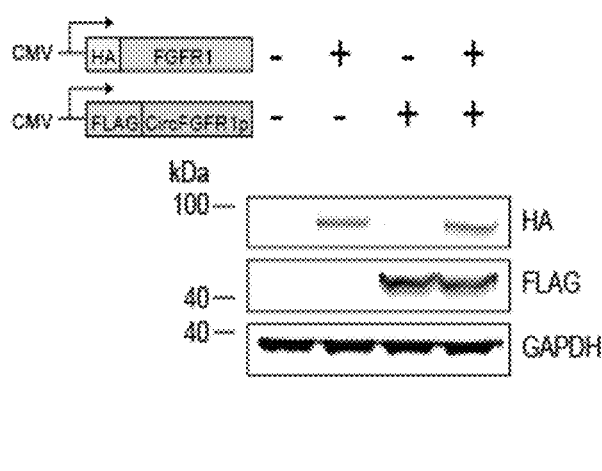
Figure 7I:
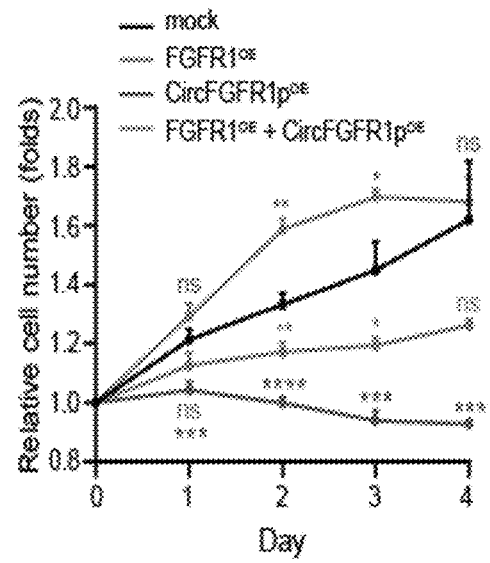
Figure 7L:
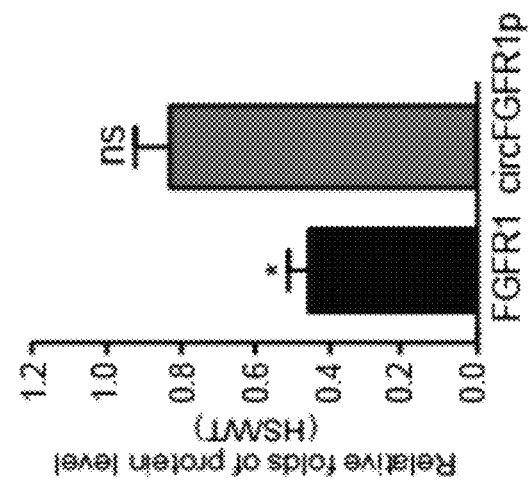
Figure 7K:
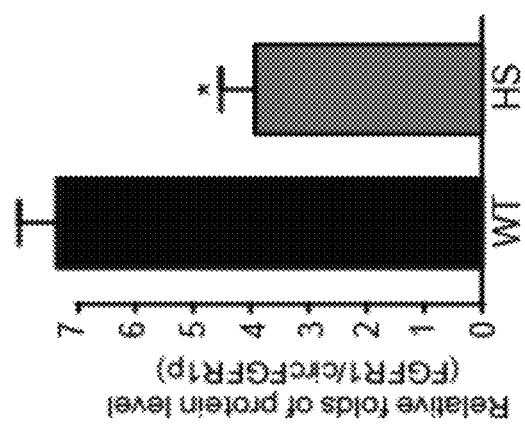
Figure 7J:
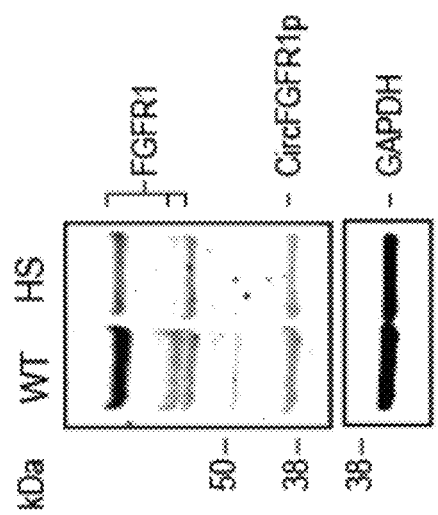

To test this hypothesis, circFGFR1 was first knocked down specifically with siRNAs targeting the back-splicing junction of circFGFR1 (FIG. 7G). It was discovered that knockdown of circFGFR1 can indeed facilitate cell proliferation upon FGF addition (FIG. 7H), suggesting that circFGFR1 negatively regulates FGFR1 function of facilitating cell proliferation. To confirm that the cell proliferation phenotype that was observed resulted from the downregulation of circFGFR1p protein rather than circFGFR1 RNA, the cell proliferation phenotype was further examined upon downregulating circFGFR1p protein specifically by disrupting the cap-independent translation of circFGFR1p IRES. Since the translation initiation is typically the rate limiting step of translation, the anti-sense LNA targeting the 18S rRNA complementary sequence on the circFGFR1 IRES (LNA-18S of IRES-8228) was utilized, which was found to effectively blocks circFGFR1p translation initiation (FIGS. 5B and 5D), to knock down circFGFR1p specifically without altering the level of circFGFR1 or FGFR1 RNA (FIG. 7G). LNA-mediated inhibition of circFGFR1 IRES caused a lower expression level of circFGFR1p and a higher level of phosphorylated FGFR1 (FIG. 7G), suggesting that knocking down circFGFR1p, but not circFGFR1 RNA, can indeed lead to an increase in FGFR1 phosphorylation, leading to a higher level of active FGFR1 (phosphorylated FGFR1). It is also in line with the observation that knocking down circFGFR1p leads to a higher cell proliferation rate (FIG. 7H). Interestingly, the depletion of circFGFR1p also leads to a higher level of total FGFR1 protein (FIG. 7G). The result suggests that circFGFR1p functions not solely as a dominant-negative of FGFR1 signal transduction, but circFGF1p also somehow inhibits full-length FGFR1 accumulation, perhaps by increasing FGFR1 turnover or degradation. A similar FGFR1 degradation phenotype has also been observed when dominant-negative variants of FGFR1 are expressed in vivo. Conversely, it was checked if circFGFR1 overexpression in cells can suppress cell proliferation by encoding circFGFR1p with a FLAG epitope tag. Then, it was cloned it into a linear mRNA expression plasmid driven by CMV promoter to effectively overexpress circFGFR1p, and the circFGFR1p expression plasmid was transfected into BJ cells (FIG. 7I). The results demonstrated that circFGFR1p overexpression (circFGFR1pOE) can indeed suppress cell proliferation (FIG. 7I). In addition, when FGFR1 and circFGFR1p were co-overexpressed in cells (FGFR1OE+circFGFR1pOE), the phenotype of cell proliferation suspension was partially rescued (FIG. 7I), which further suggests the antagonistic function of circFGFR1p for FGFR1. These results suggest that circRNA-encoded circFGFR1p can suppress cell growth by interacting with FGFR1 through a dominant-negative mechanism.

Figure 17E:
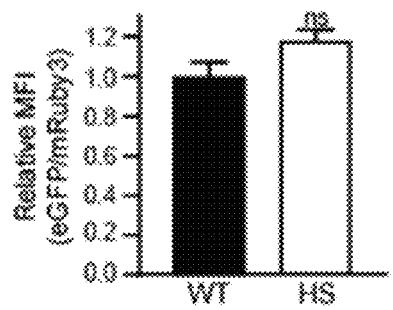
Figure 17F:
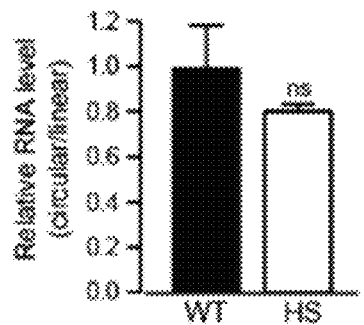
Figure 17G:
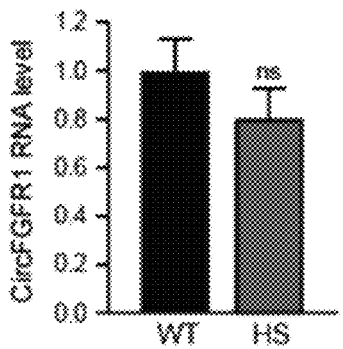
Figure 17H:
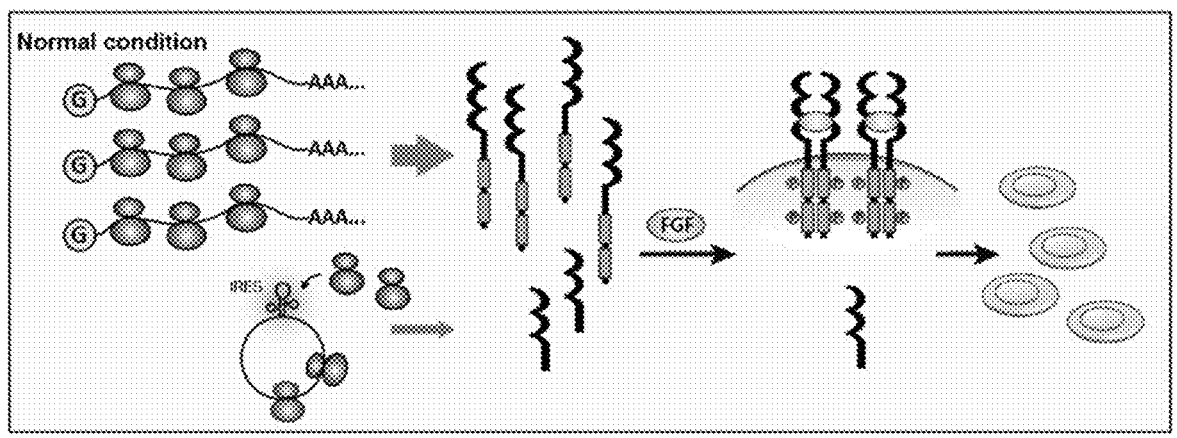
Figure 17I:
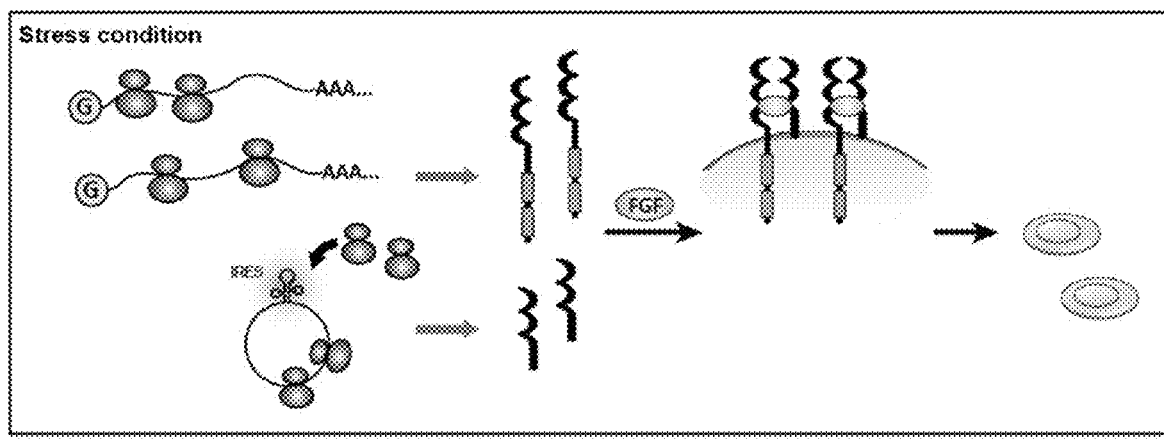
Figure 18A:
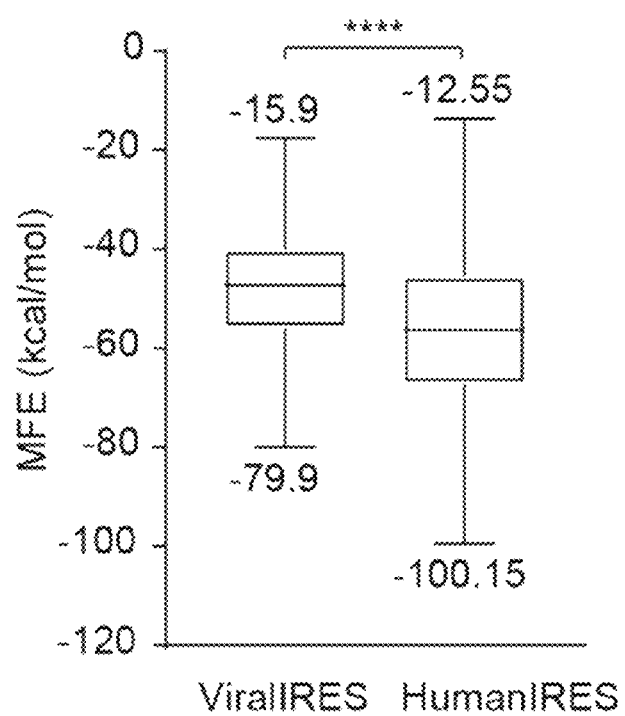
FIG. 18A-18B shows mean free energies (MFE) of various IRES identified and/or tested in the screen described herein.
Figure 18B:
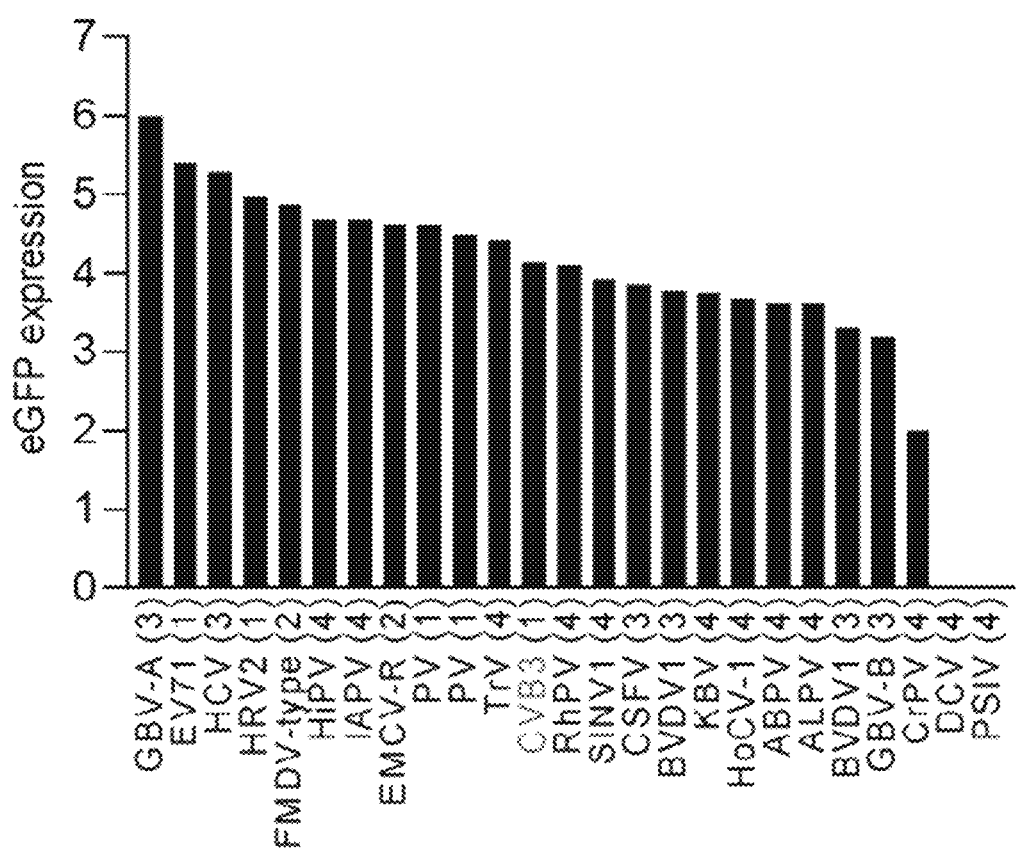

In comparison to FGFR1, the expression level of circFGFR1p is relatively low (FIGS. 7J and 7K), which indicates that circFGFR1p may not be a strong regulator under normal conditions. Nevertheless, many IRESs have been reported to have steady cap-independent translation activity under stress conditions, including the IRES of some endogenous protein-coding circRNAs, such as circZNF-609. Thus, the cap-independent translation activity of circFGFR1 IRES under stress conditions, such as under heat-shock, was further examined. First, cells were transfected with oligo-split-eGFP-circRNA reporter construct driven by circFGFR1 IRES and quantified the circFGFR1 IRES activity with or without the heat-shock. The results demonstrated that the cap-independent translation activity of 15 FGFR1 IRES remains steady during the heat-shock (FIG. 17E). Then, the FGFR1 and circFGFR1p protein levels were examined under the heat-shock condition. It was observed that FGFR1 protein level was downregulated after the heat-shock (FIGS. 7J and 7L), which is likely due to the global reduction in cap-dependent translation caused by the changes in the phosphorylation states of many eukaryotic initiation factors and the sequestration of eIF4G by Hsc70 during the heat-shock. On the other hand, the circFGFR1p level, which is regulated by cap-independent translation, remained steady after the heat-shock (FIG. 7J, 7L and FIGS. 17F and 17G). The result suggests that during heat shock although the global FGFR1 cap-dependent translation reduction is not directly caused by the circFGFR1p level, the reduced FGFR1 level and stable circFGFR1p level enhances the circFGFR1p dominant negative effect and further lower the cell growth rate. Moreover, FGFR1 has been shown to form homomultimers when induced by cell adhesion molecules. The nature of FGFR1 oligomerization may further enhance the dominant-negative effect of circFGFR1p because one circFGFR1p can join and "poison" the signaling ability or lead to degradation of more FGFR1 molecules. These phenomena may explain how lowly expressed circFGFR1p can effectively regulate highly expressed FGFR1 and suppress cell proliferation under heat shock or other forms of cell stress conditions (FIGS. 17H and 17I).

Interestingly, while the circFGFR1 IRES (oligo index: 8228) displayed strong cap-independent translation activity on the circRNA (top 2%), the same IRES showed very weak cap-independent translation activity on the linear RNA (bottom 10%) (Weingarten-Gabbay et al., 2016). This observation suggests that the cap-independent translation activity of circFGFR1 IRES is preferentially activated on circFGFR1 rather than the linear FGFR1 transcripts. This circRNA-5 biased IRES activity of circFGFR1 IRES may also explain how under the heat-shock condition circFGFR1 IRES can selectively produce the steady amount of circFGFR1p without increasing the level of FGFR1 protein isoforms produced from the cap-independent activity of circFGFR1 IRES on the linear FGFR1 transcripts, allowing circFGFR1p to regulate FGFR1 functions more effectively. In sum, the findings presented above demonstrated that with the disclosed methods, not a novel circRNA-encoded protein, circFGFR1p, was discovered that negatively regulates FGFR1 and suppresses cell proliferation through a dominant-negative mechanism under stress conditions. This study also reveals an important regulatory mechanism of circRNAs and their encoded proteins.

Various embodiments of this invention are described herein, including the best mode known to the inventors for carrying out the invention. Variations of these embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

INCORPORATION BY REFERENCE

All references, including publications, patent applications, and patents, cited herein are hereby incorporated by reference to the same extent as if each reference were individually and specifically indicated to be incorporated by reference and were set forth in its entirety herein.

NUMBERED EMBODIMENTS

Notwithstanding the appended claims, the following numbered embodiments also form part of the instant disclosure.

1. A polynucleotide sequence encoding a circular RNA molecule; wherein the circular RNA molecule comprises a protein-coding nucleic acid sequence region and an internal ribosome entry site (IRES) sequence region operably linked to the protein-coding nucleic acid sequence, wherein the IRES sequence region comprises: at least one sequence region having an RNA secondary structure element; and a sequence region that is complementary to an 18S ribosomal RNA (rRNA); wherein the TRES sequence region has a minimum free energy (MFE) of less than −18.9 kJ/mol and a melting temperature of at least 35.0° C.; and wherein the RNA secondary structure element is formed from the nucleotides at about position 40 to about position 60 of the IRES, wherein the first nucleic acid at the 5' end of the IRES is considered to be position 1.

2. The polynucleotide sequence of embodiment 1, wherein the protein coding nucleic acid sequence region is operably linked to the IRES sequence region in a non-native configuration.

3. The polynucleotide sequence of embodiment 1 or 2, wherein the polynucleotide sequence is a DNA sequence.

4. The polynucleotide sequence of any one of embodiments 1-3, wherein the sequence that is complementary to an 18S rRNA is any one SEQ ID NO: 28977-28983.

5. The polynucleotide sequence of any one of embodiments 1-4, wherein the at least one RNA secondary structure element is located 5' to the sequence region that is complementary to an 18S rRNA.

6. The polynucleotide sequence of any one of embodiments 1-4, wherein the at least one RNA secondary structure element is located 3' to the sequence region that is complementary to an 18S rRNA.

7. The polynucleotide sequence of any one of embodiments 1-6, wherein the at least one RNA secondary structure element is a stem-loop.

8. The polynucleotide sequence of any one of embodiments 1-7, wherein the at least one RNA secondary structure element comprises any one of the nucleic acid sequences listed in Table 2.

9. The polynucleotide sequence of any one of embodiments 1-8, wherein the IRES sequence region is about 100 to about 1000 nucleotides in length.

10. The polynucleotide sequence of any one of embodiments 1-8, wherein the IRES sequence region is about 200 to about 800 nucleotides in length.

11. The polynucleotide sequence of any one of embodiments 1-8, wherein the IRES sequence is between 150-200 nucleotides, between 160-180 nucleotides, or between 200-210 nucleotides in length.

12. The polynucleotide sequence of any one of embodiments 1-11, comprising at least one non-coding functional sequence.

13. The polynucleotide sequence of embodiment 12, wherein the non-coding functional sequence comprises one or more (a) microRNA binding sites or (b) RNA binding protein binding sites.

14. The polynucleotide sequence of any one of embodiments 1-11, wherein the DNA sequence comprises an aptamer.

15. A recombinant circular RNA molecule encoded by the polynucleotide sequence of any one of embodiments 1-14.

16. A DNA sequence encoding a circular RNA molecule; wherein the circular RNA molecule comprises a protein-coding nucleic acid sequence region and an internal ribosome entry site (IRES) sequence region operably linked to the protein-coding nucleic acid sequence; wherein the IRES sequence region comprises any one of the nucleic acid sequences listed in SEQ ID NO: 1-228 or SEQ ID NO: 229-17201, or a nucleic acid sequence having at least 90% or at least 95% identity or homology thereto.

17. The DNA sequence of embodiment 16, wherein the protein-coding nucleic acid sequence is operably linked to the IRES sequence region in a non-native configuration.

18. The DNA sequence of any one of embodiments 16-17, wherein the IRES sequence region has a G-C content of at least 25%.

19. The DNA sequence of any one of embodiments 16-18, wherein the IRES sequence region comprises any one of the nucleic acid sequences of SEQ ID NO: 1-228.

20. The DNA sequence of any one of embodiments 16-18, wherein the IRES sequence region comprises any one of the nucleic acid sequences of SEQ ID NO: 229-17201.

21. The DNA sequence of any one of embodiments 16-20, wherein the IRES sequence region comprises the nucleic acid sequence of any one of SEQ ID NOs: 531, 2270, 2602, 3042, 3244, and 33948.

22. The DNA sequence of any one of embodiments 16-21, wherein the IRES sequence region comprises a human IRES.

23. The DNA sequence of any one of embodiments 16-22, wherein the protein coding-nucleic acid sequence region encodes a therapeutic peptide or protein.

24. The DNA sequence of any one of embodiments 16-23, wherein the circular RNA molecule comprises between about 200 nucleotides and about 10,000 nucleotides.

25. The DNA sequence of any one of embodiments 13-24, wherein the circular RNA molecule comprises a spacer between the IRES sequence region and a start codon of the protein-coding nucleic acid sequence region.

26. The DNA sequence of embodiment 25, wherein the length of the spacer is selected to increase translation of the protein-coding nucleic acid sequence region relative to translation of a circular RNA having either no spacer or a spacer that differs from the selected spacer.

27. The DNA sequence of any one of embodiments 16-26, wherein the IRES sequence region is configured to promote rolling circle translation.

28. The DNA sequence of any one of embodiments 16-26, wherein the protein-coding nucleic acid sequence region lacks a stop codon.

29. The DNA sequence of any one of embodiments 16-26, wherein (i) the IRES sequence region is configured to promote rolling circle translation, and (ii) the protein-coding nucleic acid sequence region lacks a stop codon.

30. A recombinant circular RNA molecule encoded by the DNA sequence of any one of embodiments 16-29.

31. A viral vector comprising the polynucleotide of any one of embodiments 1-14 or the DNA sequence of any one of embodiments 16-29.

32. The viral vector of embodiment 31, which is selected from the group consisting of an adeno-associated virus (AAV) vector, an adenovirus vector, a retrovirus vector, a lentivirus vector, a vaccinia and a herpesvirus vector.

33. The viral vector of embodiment 31 or 32, wherein the viral vector is an AAV.

34. The viral vector of embodiment 33, wherein the AAV serotype is selected from the group consisting of AAV1, AAV2, AAV3, AAV4, AAV5, AAV6, AAV8, AAV9, AAVrh10 or any variant thereof having substantially the same tropism.

35. A viral-like particle comprising the polynucleotide of any one of embodiments 1-14 or the DNA sequence of any one of embodiments 16-29.

36. A nonviral-like particle comprising the polynucleotide of any one of embodiments 1-14 or the DNA sequence of any one of embodiments 16-29.

37. A closed-ended DNA sequence comprising the polynucleotide of any one of embodiments 1-14 or the DNA sequence of any one of embodiments 16-29.

38. A plasmid comprising the polynucleotide of any one of embodiments 1-14 or the DNA sequence of any one of embodiments 16-29.

39. A mini-intronic plasmid vector comprising the polynucleotide of any one of embodiments 1-14 or the DNA sequence of any one of embodiments 16-29.

40. A composition comprising the polynucleotide of any one of embodiments 1-14, the DNA sequence of any one of embodiments 16-29, or a recombinant circular RNA molecule of embodiment 15 or 30.

41. The composition of embodiment 40, wherein the lipid nanoparticle is decorated.

42. A host cell comprising the polynucleotide of any one of embodiments 1-14, the DNA sequence of any one of embodiments 16-29, or a recombinant circular RNA molecule of embodiment 15 or 30.

43. A method of producing a protein in a cell, the method comprising contacting a cell with (a) the polynucleotide of any one of embodiments 1-14, (b) the DNA sequence of any one of embodiments 16-29, (c) the circular RNA molecule of any one of embodiments 15 or 30, (d) the viral vector of any one of embodiments 31-34, (e) the viral like particle of embodiment 35, (f) the nonviral-like particle of embodiment 36, (g) the closed-end DNA sequence of embodiment 37, (h) the plasmid of embodiment 38, (i) the mini-intronic plasmid vector of embodiment 39, or (j) the composition of any one of embodiments 40-41 under conditions whereby the protein-coding nucleic acid sequence of the circular RNA is translated and the protein is produced in the cell.

44. The method of embodiment 43, wherein 5' cap-dependent translation in the cell is impaired or nonexistent.

45. The method of embodiment 43 or 44, wherein the cell is in vivo.

46. The method of embodiment 45, wherein the cell is a mammalian cell.

47. The method of embodiment 46, wherein the mammalian cell is derived from a human.

48. The method of any one of embodiments 45-46, wherein production of the protein is tissue-specific.

49. The method of embodiment 48, wherein the tissue specificity is localized to a tissues selected from the group consisting of muscle, liver, kidney, brain, lung, skin, pancreas, blood, and heart.

50. The method of embodiment 43 or 44, wherein the cell is in vitro.

51. The method of any one of embodiments 43-48, wherein the protein is expressed recursively in the cell.

52. The method of any one of embodiments 43-51, wherein the half-life of the circular RNA in the cell is about 1 to about 7 days.

53. The method of any one of embodiments 43-55, wherein the protein is produced in the cell for at least about 10%, at least about 20%, or at least about 30% longer than if the protein-coding nucleic acid sequence is provided to the cell in a linear format RNA or encoded for transcription as a linear RNA.

54. A protein produced by the method of any one of embodiments 43-53.

55. A recombinant circular RNA molecule comprising a protein-coding nucleic acid sequence and an internal ribosome entry site (IRES) operably linked to the protein-coding nucleic acid sequence, wherein the IRES comprises: at least one RNA secondary structure; and a sequence that is complementary to an 18S ribosomal RNA (rRNA); wherein the IRES has a minimum free energy (MFE) of less than −18.9 kJ/mol and a melting temperature of at least 35.0° C.

56. The recombinant circular RNA molecule of embodiment 55, wherein the protein-coding nucleic acid sequence is operably linked to the IRES in a non-native configuration.

57. The recombinant circular RNA molecule of embodiment 55 or 56, wherein the sequence that is complementary to an 18S rRNA is encoded by any one of SEQ ID NO: 28977-28983.

58. The recombinant circular RNA molecule of any one of embodiments 55-57, wherein the at least one RNA secondary structure is located 5' to the sequence that is complementary to an 18S rRNA.

59. The recombinant circular RNA molecule of any one of embodiments 55-57, wherein the at least one RNA secondary structure is located 3' to the sequence that is complementary to an 18S rRNA.

60. The recombinant circular RNA molecule of any one of embodiments 55-59, wherein the at least one RNA secondary structure is a stem-loop.

61. The recombinant circular RNA molecule of any one of embodiments 55-59, wherein the at least one RNA secondary structure comprises a sequence encoded by any one of the DNA sequences listed in Table 2.

62. The recombinant circular RNA of any one of embodiments 55-61, wherein the IRES is about 100 to about 1000 nucleotides in length.

63. The recombinant circular RNA of any one of embodiments 55-61, wherein the IRES is about 200 to about 200 nucleotides in length.

64. The recombinant circular RNA of any one of embodiments 55-61, wherein the IRES sequence is between 150-200 nucleotides, between 160-180 nucleotides, or between 200-210 nucleotides in length.

65. The recombinant circular RNA of any one of embodiments 62-64, wherein the RNA secondary structure is formed from the nucleotides at about position 40 to about position 60 of the IRES, relative to the 5' end thereof.

66. The recombinant circular RNA of any one of embodiments 55-65, comprising at least one non-coding functional sequence.

67. The recombinant circular RNA of embodiment 66, wherein the non-coding functional sequence comprises one or more (a) microRNA binding sites or (b) RNA binding protein binding sites.

68. The recombinant circular RNA of any one of embodiments 55-65, wherein the circular RNA comprises an aptamer.

69. A recombinant circular RNA molecule comprising a protein-coding nucleic acid sequence and an internal ribosome entry site (IRES) operably linked to the protein-coding nucleic acid sequence; wherein the IRES is encoded by any one of the DNA sequences listed in SEQ ID NO: 1-228 or SEQ ID NO: 229-17201, or a DNA sequence having at least 90% or at least 95% identity or homology thereto.

70. The recombinant circular RNA molecule of embodiment 69, wherein the protein-coding nucleic acid sequence is operably linked to the IRES in a non-native configuration.

71. The recombinant circular RNA of any one of embodiments 55-70, wherein the recombinant circular RNA comprises a back-splice junction, and wherein the IRES is located within about 100 to about 200 nucleotides of the back-splice junction.

72. The recombinant circular RNA molecule of any one of embodiments 55-71, wherein the IRES has a G-C content of at least 25%.

73. The recombinant circular RNA molecule of any one of embodiments 55-72, wherein the IRES is encoded by any of the DNA sequences of SEQ ID NO: 1-228.

74. The recombinant circular RNA molecule of any one of embodiments 55-72, wherein the IRES is encoded by any one of the DNA sequences of SEQ ID NO: 229-17201.

75. The recombinant circular RNA molecule of embodiment 74, wherein the IRES is encoded by any one of the DNA sequences shown in SEQ ID NO: 531, 2270, 2602, 3042, 3244, 33948.

76. The recombinant circular RNA molecule of any one of embodiments 55-75, wherein the IRES is a human IRES.

77. The recombinant circular RNA molecule of any one of embodiments 55-76, wherein the protein coding-nucleic acid sequence encodes a therapeutic peptide or protein.

78. The recombinant circular RNA molecule of any one of embodiments 55-77, wherein the circular RNA comprises between about 200 nucleotides and about 10,000 nucleotides.

79. The recombinant circular RNA molecule of any one of embodiments 55-78, wherein the circular RNA molecule comprises a spacer between the IRES sequence region and a start codon of the protein-coding nucleic acid sequence region.

80. The recombinant circular RNA molecule of embodiment 79, wherein the length of the spacer is selected to increase translation of the protein-coding nucleic acid sequence region relative to translation of a circular RNA having either no spacer or a spacer that differs from the selected spacer.

81. The recombinant circular RNA molecule of any one of embodiments 55-78, wherein the IRES sequence region is configured to promote rolling circle translation.

82. The recombinant circular RNA molecule of any one of embodiments 55-78, wherein the protein-coding nucleic acid sequence region lacks a stop codon.

83. The recombinant circular RNA molecule of any one of embodiments 55-78, wherein (i) the IRES sequence region is configured to promote rolling circle translation, and (ii) the protein-coding nucleic acid sequence region lacks a stop codon.

84. A composition comprising the recombinant circular RNA molecule of any one of embodiments 55-83.

85. A host cell comprising the recombinant circular RNA molecule of any one of embodiments 55-83 or the composition of embodiment 84.

86. A method of producing a protein in a cell, the method comprising contacting a cell with the recombinant circular RNA molecule of any one of embodiments 55-83, or the composition of embodiment 84 under conditions whereby the protein-coding nucleic acid sequence is translated and the protein is produced in the cell.

87. The method of embodiment 86, wherein 5' cap-dependent translation in the cell is impaired or nonexistent.

88. The method of embodiment 86 or 87, wherein the cell is in vivo.

89. The method of embodiment 86 or 87, wherein the cell is a mammalian cell.

90. The method of embodiment 89, wherein the mammalian cell is derived from a human.

91. The method of any one of embodiments 55-90, wherein production of the protein is tissue-specific.

92. The method of embodiment 91, wherein the tissue specificity is localized to a tissues selected from the group consisting of muscle, liver, kidney, brain, lung, skin, pancreas, blood, and heart.

93 The method of embodiment 86 or 87, wherein the cell is in vitro.

94. The method of any one of embodiments 86-93, wherein the protein is expressed recursively in the cell.

95. The method of any one of embodiments 86-94, wherein the half-life of the circular RNA in the cell is about 1 to about 7 days.

96. The method of any one of embodiments 86-94, wherein the protein is produced in the cell for at least about 10%, at least about 20%, or at least about 30% longer than if the protein-coding nucleic acid sequence is provided to the cell in a linear format RNA or encoded for transcription as a linear RNA.

97. A protein produced by the method of any one of embodiments 86-96.

98. An oligonucleotide molecule comprising a nucleic acid sequence that hybridizes to an internal ribosome entry site (IRES) present on a circular RNA molecule and inhibits translation of the circular RNA molecule.

99. The oligonucleotide molecule of embodiment 98, wherein the circular RNA is a recombinant circular RNA.

100. The oligonucleotide molecule of embodiment 98, wherein the recombinant circular RNA is the recombinant circular RNA of any one of embodiments 55-83.

101. The oligonucleotide molecule of embodiment 98, wherein the circular RNA is a naturally occurring circular RNA.

102. The oligonucleotide molecule of any one of embodiments 98-101, wherein the oligonucleotide is an antisense oligonucleotide.

103. The oligonucleotide of embodiment 102, wherein the antisense oligonucleotide is a locked nucleic acid oligonucleotide (LNA).

104. The oligonucleotide of any one of embodiments 98-103, wherein the oligonucleotides is chemically modified at its 5' and/or its 3' end.

105. A method of inhibiting translation of a protein-coding nucleic acid sequence present on a circular RNA molecule, which method comprises contacting the circular RNA molecule with an oligonucleotide molecule of any one of embodiments 98-104, whereby the oligonucleotide molecule hybridizes to the RNA secondary structure and/or the nucleic acid sequence complementary to 18S rRNA present on the IRES of the circular RNA molecule and inhibits translation of the circular RNA molecule.

106. The method of embodiment 105, wherein the oligonucleotide hybridizes to the RNA secondary structure or the nucleic acid sequence that is complementary to 18S rRNA.

107. The method of embodiment 105, wherein the oligonucleotide hybridizes to the RNA secondary structure and the nucleic acid sequence that is complementary to 18S rRNA.

108. The method of embodiment 105, wherein a first oligonucleotide hybridizes to the RNA secondary structure and a second oligonucleotide hybridizes to the nucleic acid sequence that is complementary to 18S rRNA.

SEQUENCE LISTING (34039 sequences)

SEQ ID NO: 1 - DNA, 203 bp, synthetic construct
  source 1..203: mol_type = other DNA
ggcgcgccagtcctccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 2 - DNA, 203 bp, synthetic construct
  source 1..203: mol_type = other DNA
ggcgcgccagtccttgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 3 - DNA, 203 bp, synthetic construct
  source 1..203: mol_type = other DNA
ggcgcgccagtcctctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 4 - DNA, 203 bp, synthetic construct
  source 1..203: mol_type = other DNA
ggcgcgccagtccttttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 5 - DNA, 203 bp, synthetic construct
  source 1..203: mol_type = other DNA
ggcgcgccagtcctaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 6 - DNA, 203 bp, synthetic construct
  source 1..203: mol_type = other DNA
ggcgcgccagtcctgggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcgactcggaccgatg

SEQ ID NO: 7 - DNA, 203 bp, synthetic construct
  source 1..203: mol_type = other DNA
ggcgcgccagtcctttaaaacagcctgtgggttgatcccacccacagggcccattgggcgctagcactctggtatcacggtacctttgtgcgcctgttttataccccctcccccaactgtaacttagaagtaacacacaccgatcaacagtcagcgtggcacaccagccacgttttgatcaagcacttcgactcggaccgatg

SEQ ID NO: 8 - DNA, 203 bp, synthetic construct
  source 1..203: mol_type = other DNA
ggcgcgccagtcctttaaaacagctctggggttgttcccaccccagaggcccacgtggcggctagtacactggtatcacggtacctttgtacgcctgttttatactccctcccccgcaacttagaagcatacaattcaagctcaataggagggggtgcaagccagcgcctccgtgggcaagcactactcgactcggaccgatg

SEQ ID NO: 9 - DNA, 203 bp, synthetic construct
  source 1..203: mol_type = other DNA
ggcgcgccagtcctgataaaagaacctataatcccttcgcacaccgcgtcacaccgcgctatatgctgctcattaggaattacggctccttttttgtggatacaatctcttgtatacgatatacttattgttaatttcattgacctttacgcaatcctgcgtaaatgctggtatagggtgtacttcggcgactcggaccgatg

SEQ ID NO: 10 - DNA, 203 bp, synthetic construct
  source 1..203: mol_type = other DNA
ggcgcgccagtcctcaaaattgcgtgcgagaaagcacgcaaatcaaagtctagtgcgtaattcactcactaccggcgtaatttgtggttatgctattgcgttgagagtgttgtgggcgtagtacgggggcttttggtttgtgtgtgattaatatgcattcccagttttgtttagttttagattactgacgactcggaccgatg

SEQ ID NO: 11 - DNA, 203 bp, synthetic construct
  source 1..203: mol_type = other DNA
ggcgcgccagtcctcttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttcgactcggaccgatg

SEQ ID NO: 12 - DNA, 203 bp, synthetic construct
  source 1..203: mol_type = other DNA
ggcgcgccagtcctttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgactcggaccgatg

SEQ ID NO: 13 - DNA, 203 bp, synthetic construct
  source 1..203: mol_type = other DNA
ggcgcgccagtcctaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcgcgactcggaccgatg

SEQ ID NO: 14 - DNA, 203 bp, synthetic construct
  source 1..203: mol_type = other DNA
ggcgcgccagtcctcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggcgactcggaccgatg

SEQ ID NO: 15 - DNA, 203 bp, synthetic construct
  source 1..203: mol_type = other DNA
ggcgcgccagtcctgtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgcgactcggaccgatg

SEQ ID NO: 16 - DNA, 203 bp, synthetic construct
  source 1..203: mol_type = other DNA
ggcgcgccagtcctatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaaccgactcggaccgatg

SEQ ID NO: 17 - DNA, 203 bp, synthetic construct
  source 1..203: mol_type = other DNA
ggcgcgccagtcctcttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagcgactcggaccgatg

SEQ ID NO: 18 - DNA, 203 bp, synthetic construct
  source 1..203: mol_type = other DNA
ggcgcgccagtccttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactgcgactcggaccgatg

SEQ ID NO: 19 - DNA, 203 bp, synthetic construct
  source 1..203: mol_type = other DNA
ggcgcgccagtcctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatatcgactcggaccgatg

SEQ ID NO: 20 - DNA, 203 bp, synthetic construct
  source 1..203: mol_type = other DNA
ggcgcgccagtcctaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactcgactcggaccgatg

SEQ ID NO: 21 - DNA, 203 bp, synthetic construct
  source 1..203: mol_type = other DNA
ggcgcgccagtcctttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttacgactcggaccgatg

SEQ ID NO: 22 - DNA, 203 bp, synthetic construct
  source 1..203: mol_type = other DNA
ggcgcgccagtcctgggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatccgactcggaccgatg

SEQ ID NO: 23 - DNA, 203 bp, synthetic construct
  source 1..203: mol_type = other DNA
ggcgcgccagtcctccacacacagcgcgggcttctagcgctcggcaccggcgggccaggcgcgtcctgccttcatttatccagcagcttttcggaaaatgcatttgctgttcggagtttaatcagaagacgattcctgcctccgtccccggctccttcatcgtcccatctcccctgtctctctcctggcgactcggaccgatg

SEQ ID NO: 24 - DNA, 203 bp, synthetic construct
  source 1..203: mol_type = other DNA
ggcgcgccagtcctcctgccttcatttatccagcagcttttcggaaaatgcatttgctgttcggagtttaatcagaagacgattcctgcctccgtccccggctccttcatcgtcccatctcccctgtctctctcctggggaggcgtgaagcggtcccgtggatagagattcatgcctgtgtccgcgcgcgactcggaccgatg

SEQ ID NO: 25 - DNA, 203 bp, synthetic construct
  source 1..203: mol_type = other DNA
ggcgcgccagtccttcgatctggaaatcctcctaatttttactccctctccccccgactcctgattcattgggaagtttcaaatcagctataactggagagtgctgaagattgatgggatcgttgccttatgcatttgttttggttttacaaaaaggaaacttgacagaggatcatgctgtacttaaacgactcggaccgatg

SEQ ID NO: 26 - DNA, 203 bp, synthetic construct
  source 1..203: mol_type = other DNA
ggcgcgccagtcctaaacgcacctgattttttacttattagtttgttttttctttaacctttcagcatcacagaggaagtagactgatattaacaatacttactaataataacgtgcctcatgaaataaagatccgaaaggaattggaataaaaatttcctgcgtctcatgccaagagggaaacaccacgactcggaccgatg

SEQ ID NO: 27 - DNA, 203 bp, synthetic construct
  source 1..203: mol_type = other DNA
ggcgcgccagtccttgcctcatgaaataaagatccgaaaggaattggaataaaaatttcctgcgtctcatgccaagagggaaacaccagaatcaagtgttccgcgtgattgaagacaccccctcgtccaagaatgcaaagcacatccaataaaatagctggattataactcctcttctttctctggggcgactcggaccgatg

SEQ ID NO: 28 - DNA, 203 bp, synthetic construct
  source 1..203: mol_type = other DNA
ggcgcgccagtcctaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtatacgactcggaccgatg

SEQ ID NO: 29 - DNA, 203 bp, synthetic construct
  source 1..203: mol_type = other DNA
ggcgcgccagtcctgccaggggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaacgactcggaccgatg

SEQ ID NO: 30 - DNA, 203 bp, synthetic construct
  source 1..203: mol_type = other DNA
ggcgcgccagtcctcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaacgactcggaccgatg

SEQ ID NO: 31 - DNA, 203 bp, synthetic construct
  source 1..203: mol_type = other DNA
ggcgcgccagtcctggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 32 - DNA, 203 bp, synthetic construct
  source 1..203: mol_type = other DNA
ggcgcgccagtcctcctcccccttccctcccccttttttttgttttccgttcccctttcccctcccttccctatccccgacgaccggatcctgaggaggcagctgcggtggcagctgctgagttctcggtgaaggtatttcatttctcctgtcccctcccctccccaccccatctattaatattattccgactcggaccgatg

SEQ ID NO: 33 - DNA, 203 bp, synthetic construct
  source 1..203: mol_type = other DNA
ggcgcgccagtccttctagatgggggtcctgggccccagggtgtgcagccactgacttggggactgctggtggggtagggatgagggagggaggggcattgtgatgtacagggctgctctgtgagatcaagggtctcttaagggtgggagctggggcagggactacgagagcagccagatgggctgaacgactcggaccgatg

SEQ ID NO: 34 - DNA, 203 bp, synthetic construct
  source 1..203: mol_type = other DNA
ggcgcgccagtcctatgtatgcatgtgtatgtatgtatatgcatgtatgtgtatgtgtatatatgtatgtgtgtgtatgtatatgtgtgtgtatgtgtatgtgtgtgtgtatgtgtgtgtgtatgtatgtatgtatgtatatgtattatacacatatacacatattggtttttttaatcatttgagagcgactcggaccgatg

SEQ ID NO: 35 - DNA, 203 bp, synthetic construct
  source 1..203: mol_type = other DNA
ggcgcgccagtcctcccactcggcagccttcctctccaggatccccaaggctaggaggccaacctactaacaggtgggtgggtatggtgtgtggtttcactcagttcttctcatggggtttctctgagctccattcataccagaaagggagcaggagagagaggacaagtggatccaacagccttcgccgactcggaccgatg

SEQ ID NO: 36 - DNA, 203 bp, synthetic construct
  source 1..203: mol_type = other DNA
ggcgcgccagtccttactaacaggtgggtgggtatggtgtgtggtttcactcagttcttctcatggggtttctctgagctccattcataccagaaagggagcaggagagagaggacaagtggatccaacagccttcgctccaggggaatcagggcatcgcctccttttctgggaggacactcccttctcgactcggaccgatg

SEQ ID NO: 37 - DNA, 203 bp, synthetic construct
  source 1..203: mol_type = other DNA
ggcgcgccagtcctggggtttctctgagctccattcataccagaaagggagcaggagagagaggacaagtggatccaacagccttcgctccaggggaatcagggcatcgcctccttttctgggaggacactcccttctgatggtgaatgggaactcccttcctcctgcagcagcctgcctgcagctgtcgactcggaccgatg

SEQ ID NO: 38 - DNA, 203 bp, synthetic construct
  source 1..203: mol_type = other DNA
ggcgcgccagtcctacaagtggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcagaagctgtcactgccccagaaagacgactcggaccgatg

SEQ ID NO: 39 - DNA, 203 bp, synthetic construct
  source 1..203: mol_type = other DNA
ggcgcgccagtcctggctggcgtgtgaccccgttttgagtcaggtggacagagggctggccaccttcggaaccatgggtgcaatacggagtcagacctcaatacaagcccactctttcacatatttgaacttttttcacatatcaactttttttgttcactgtgcagggattgttcattgctgctggacgactcggaccgatg

SEQ ID NO: 40 - DNA, 203 bp, synthetic construct
  source 1..203: mol_type = other DNA
ggcgcgccagtccttttcacatatttgaacttttttcacatatcaactttttttgttcactgtgcagggattgttcattgctgctggaggaagatcatggactgtcgcgggaaactgaagtggttgagtatccactagtcgtggatgagggcagtgacttcgcagttttttgcgaattacacatctctcgactcggaccgatg

SEQ ID NO: 41 - DNA, 203 bp, synthetic construct
  source 1..203: mol_type = other DNA
ggcgcgccagtcctcagggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagtcatttagtgtttgggatcgactcggaccgatg

SEQ ID NO: 42 - DNA, 203 bp, synthetic construct
  source 1..203: mol_type = other DNA
ggcgcgccagtcctggagaacttcacagttgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttttttctccgactcggaccgatg

SEQ ID NO: 43 - DNA, 203 bp, synthetic construct
  source 1..203: mol_type = other DNA
ggcgcgccagtcctacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggacgactcggaccgatg

SEQ ID NO: 44 - DNA, 203 bp, synthetic construct
  source 1..203: mol_type = other DNA
ggcgcgccagtcctgcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgccgactcggaccgatg

SEQ ID NO: 45 - DNA, 203 bp, synthetic construct
  source 1..203: mol_type = other DNA
ggcgcgccagtcctgccgggcgaactcaaggggcgcagctctttgctttgacagagctggccggcggaggcgtgcagagcggcgagccggcgagccaggctgagaaactcgacccgggaacaaagaggggtcggactgagtgtgtgtgtcggctcgagctccgggagaggcatttgcccgaggccccgcgactcggaccgatg

SEQ ID NO: 46 - DNA, 203 bp, synthetic construct
  source 1..203: mol_type = other DNA
ggcgcgccagtcctcggaggcgtgcagagcggcgagccggcgagccaggctgagaaactcgacccgggaacaaagaggggtcggactgagtgtgtgtgtcggctcgagctccgggagaggcatttgcccgaggccccgctgtgactccccgagactccgcagtgccctccactgggagtccccgcgctcgactcggaccgatg

SEQ ID NO: 47 - DNA, 203 bp, synthetic construct
  source 1..203: mol_type = other DNA
ggcgcgccagtcctgagaggcatttgcccgaggccccgctgtgactccccgagactccgcagtgccctccactgggagtccccgcgcttgccggaaaaactttattcttggcaaacttctctttctcttcccctcctcctcggcccccatcttctgctcctcctccttctctagcagattaaatgagccgactcggaccgatg

SEQ ID NO: 48 - DNA, 203 bp, synthetic construct
  source 1..203: mol_type = other DNA
ggcgcgccagtcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttcgactcggaccgatg

SEQ ID NO: 49 - DNA, 203 bp, synthetic construct
  source 1..203: mol_type = other DNA
ggcgcgccagtcctggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaaccgactcggaccgatg

SEQ ID NO: 50 - DNA, 203 bp, synthetic construct
  source 1..203: mol_type = other DNA
ggcgcgccagtccttttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcgcgactcggaccgatg

SEQ ID NO: 51 - DNA, 203 bp, synthetic construct
  source 1..203: mol_type = other DNA
ggcgcgccagtcctatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggcgactcggaccgatg

SEQ ID NO: 52 - DNA, 203 bp, synthetic construct
  source 1..203: mol_type = other DNA
ggcgcgccagtcctcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcggggccgactcggaccgatg

SEQ ID NO: 53 - DNA, 203 bp, synthetic construct
  source 1..203: mol_type = other DNA
ggcgcgccagtccttttttaaatttgcaattttatattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggcgactcggaccgatg

SEQ ID NO: 54 - DNA, 203 bp, synthetic construct
  source 1..203: mol_type = other DNA
ggcgcgccagtcctccgtgctcccccgttcttccctgcggagtgcgctgcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 55 - DNA, 203 bp, synthetic construct
  source 1..203: mol_type = other DNA
ggcgcgccagtcctgcaatccggagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccacttcgactcggaccgatg

SEQ ID NO: 56 - DNA, 203 bp, synthetic construct
  source 1..203: mol_type = other DNA
ggcgcgccagtcctttgtaagtatcattatgaactaatgaattttcaacatatttgatatatttcaatccattgccatcattgttcttatcgatatttgagttggctcactttgccagtaagagtctattcaaattggcttctgagtccatttgacacaacacctttgatctttgacagtttccttggcgactcggaccgatg

SEQ ID NO: 57 - DNA, 203 bp, synthetic construct
  source 1..203: mol_type = other DNA
ggcgcgccagtcctcaatccattgccatcattgttcttatcgatatttgagttggctcactttgccagtaagagtctattcaaattggcttctgagtccatttgacacaacacctttgatctttgacagtttccttggttttaggtgctagatgatttctcaggctcaccttagacatttcctgccaccgactcggaccgatg

SEQ ID NO: 58 - DNA, 203 bp, synthetic construct
  source 1..203: mol_type = other DNA
ggcgcgccagtcctctcaccttagacatttcctgccacagacttagaatcagccatttctctaaggaccctgattccatttcatgagaaatgatagagaccacaatcaaaacaagtcatgaatttatactgatattttcaattcaaattaaagatgaggtttttgctaaatttttttgagtttatattcgactcggaccgatg

SEQ ID NO: 59 - DNA, 203 bp, synthetic construct
  source 1..203: mol_type = other DNA
ggcgcgccagtccttttcctaattagtaacataattattcatttgatgggtaaatattttagggccgattctttggttttatagccaagataccctgttgataaagtcttgtgggagcaattataagactggcttattttgaagctttttaaaaaagacatccttacctgttttaactgtagattatacgactcggaccgatg

SEQ ID NO: 60 - DNA, 203 bp, synthetic construct
  source 1..203: mol_type = other DNA
ggcgcgccagtcctgctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtccccgactcggaccgatg

SEQ ID NO: 61 - DNA, 203 bp, synthetic construct
  source 1..203: mol_type = other DNA
ggcgcgccagtcctatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccacgactcggaccgatg

SEQ ID NO: 62 - DNA, 203 bp, synthetic construct
  source 1..203: mol_type = other DNA
ggcgcgccagtccttttgcacctctccctgcccgggtgctcgagctgccgttgcaaagccaactttggaaaaagttttttgggggagacttgggccttgaggtgcccagctccgcgctttccgattttgggggcctttccagaaaatgttgcaaaaaagctaagccggcgggcagaggaaaacgcctgcgactcggaccgatg

SEQ ID NO: 63 - DNA, 203 bp, synthetic construct
  source 1..203: mol_type = other DNA
ggcgcgccagtcctcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcccccacaccggtagacgcctcggctggcgactcggaccgatg

SEQ ID NO: 64 - DNA, 203 bp, synthetic construct
  source 1..203: mol_type = other DNA
ggcgcgccagtcctccggcgggcagaggaaaacgcctgtagccggcgagtgaagacgaaccatcgactgccgtgttccttttcctcttggaggttggagtcccctgggcgcccccacaccggtagacgcctcggctggttcgcgacgcagccccccggccgtggatgctcactcgggctcgggatccgcgactcggaccgatg

SEQ ID NO: 65 - DNA, 203 bp, synthetic construct
  source 1..203: mol_type = other DNA
ggcgcgccagtcctgactgccgtgttccttttcctcttggaggttggagtcccctgggcgcccccacaccggtagacgcctcggctggttcgcgacgcagccccccggccgtggatgctcactcgggctcgggatccgcccaggtagccggctcggacccaggtcctgcgcccaggtcctcccctgcccgactcggaccgatg

SEQ ID NO: 66 - DNA, 203 bp, synthetic construct
  source 1..203: mol_type = other DNA
ggcgcgccagtcctcacaccggtagacgcctcggctggttcgcgacgcagccccccggccgtggatgctcactcgggctcgggatccgcccaggtagccggctcggacccaggtcctgcgcccaggtcctcccctgccccccagcgacggagccggggccgggggcggcggcgcccgggggccatgcgcgactcggaccgatg

SEQ ID NO: 67 - DNA, 203 bp, synthetic construct
  source 1..203: mol_type = other DNA
ggcgcgccagtcctcagcctctgcagcggccgcggtggctgaggaggcccgagaggagtcggtggcagcggcggcggcgggaccggcagcagcagcagcagcagcagcagcaaccactagcctcctgccccgcggcgctgccgcacgagccccacgagccgctcaccccgccgttctcagcgctgccccgactcggaccgatg

SEQ ID NO: 68 - DNA, 203 bp, synthetic construct
  source 1..203: mol_type = other DNA
ggcgcgccagtcctcactagcctcctgccccgcggcgctgccgcacgagccccacgagccgctcaccccgccgttctcagcgctgcccgaccccgctcgcgcgccctcccgccgccagtcccggcagcgccctcagttgtcctccgactcgccctcggccttccgcgccagccgcagccacagccgcacgactcggaccgatg

SEQ ID NO: 69 - DNA, 203 bp, synthetic construct
  source 1..203: mol_type = other DNA
ggcgcgccagtcctccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgactcggaccgatg

SEQ ID NO: 70 - DNA, 203 bp, synthetic construct
  source 1..203: mol_type = other DNA
ggcgcgccagtcctcatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgaccgactcggaccgatg

SEQ ID NO: 71 - DNA, 203 bp, synthetic construct
  source 1..203: mol_type = other DNA
ggcgcgccagtcctacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggacgactcggaccgatg

SEQ ID NO: 72 - DNA, 203 bp, synthetic construct
  source 1..203: mol_type = other DNA
ggcgcgccagtccttcagcagaatcaggctcaggttctgaggaagaagaggaggaggaggaagaggaggaggaggaagggagcaccagtgaagaatcagaggaggaagaggaagaggaggaggaggagaccggcagcaactctgaggaggcatcagagcagtctgccgaagaagtaagtgaggaagaacgactcggaccgatg

SEQ ID NO: 73 - DNA, 203 bp, synthetic construct
  source 1..203: mol_type = other DNA
ggcgcgccagtcctgtttacatatttatgtaaaataagcatttaaaaattattagttttattctgcctgcttaaatattactttcctcaaaaagagaaaacaaaaatgctagattttactttatgacttgaatgatgtggtaatgtcgaactctagtatttagaattagaatgtttcttagcggtcgtcgactcggaccgatg

SEQ ID NO: 74 - DNA, 203 bp, synthetic construct
  source 1..203: mol_type = other DNA
ggcgcgccagtccttttactttatgacttgaatgatgtggtaatgtcgaactctagtatttagaattagaatgtttcttagcggtcgtgtagttatttttatgtcataagtggataatttgttagctcctataacaaaagtctgttgcttgtgtttcacattttggatttcctaatataatgttctctcgactcggaccgatg

SEQ ID NO: 75 - DNA, 203 bp, synthetic construct
  source 1..203: mol_type = other DNA
ggcgcgccagtcctatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcagcgactcggaccgatg

SEQ ID NO: 76 - DNA, 203 bp, synthetic construct
  source 1..203: mol_type = other DNA
ggcgcgccagtcctacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatctcgactcggaccgatg

SEQ ID NO: 77 - DNA, 203 bp, synthetic construct
  source 1..203: mol_type = other DNA
ggcgcgccagtcctggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggaccgactcggaccgatg

SEQ ID NO: 78 - DNA, 203 bp, synthetic construct
  source 1..203: mol_type = other DNA
ggcgcgccagtcctatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggcccgactcggaccgatg

SEQ ID NO: 79 - DNA, 203 bp, synthetic construct
  source 1..203: mol_type = other DNA
ggcgcgccagtcctctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctcgactcggaccgatg

SEQ ID NO: 80 - DNA, 203 bp, synthetic construct
  source 1..203: mol_type = other DNA
ggcgcgccagtcctagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccacgactcggaccgatg

SEQ ID NO: 81 - DNA, 203 bp, synthetic construct
  source 1..203: mol_type = other DNA
ggcgcgccagtcctacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctccgactcggaccgatg

SEQ ID NO: 82 - DNA, 203 bp, synthetic construct
  source 1..203: mol_type = other DNA
ggcgcgccagtcctcggcttgaggcagagaccaggaggcagctagaggagcagacgtctcactccgctcgcggaagggtgtgagaggggtgtgtgggggtcggcagcgaggggtgtgtgccatcagccaccggcgacgatctgagacagtcgcagcggctttccgagcggcgtccgcttcccgcccggcgactcggaccgatg

SEQ ID NO: 83 - DNA, 203 bp, synthetic construct
  source 1..203: mol_type = other DNA
ggcgcgccagtcctcgctcgcggaagggtgtgagaggggtgtgtgggggtcggcagcgaggggtgtgtgccatcagccaccggcgacgatctgagacagtcgcagcggctttccgagcggcgtccgcttcccgcccgggcagctcccgccagaggggtgaagcggcgactggagtggccgtgcttttgcgactcggaccgatg

SEQ ID NO: 84 - DNA, 203 bp, synthetic construct
  source 1..203: mol_type = other DNA
ggcgcgccagtcctgagcggcgtccgcttcccgcccgggcagctcccgccagaggggtgaagcggcgactggagtggccgtgcttttgtgccctgggtcccggtaccctcccctggtgcggcccgaggcaagcccaccgaggtgaccacccctcgacgccgcttggagatcccgggcatccaccctgccgactcggaccgatg

SEQ ID NO: 85 - DNA, 203 bp, synthetic construct
  source 1..203: mol_type = other DNA
ggcgcgccagtcctggtgcggcccgaggcaagcccaccgaggtgaccacccctcgacgccgcttggagatcccgggcatccaccctgcgccccgagcagctgatacccagggaggtgtcaggacctgcccggggcgcggggtcgccggaagccaggcgggagccccggctgctttctggcaatctagtcgactcggaccgatg

SEQ ID NO: 86 - DNA, 203 bp, synthetic construct
  source 1..203: mol_type = other DNA
ggcgcgccagtcctatgaaaccggctcggattccgcccgcgtgcgccatcccctcagctagcaggtgtgagcggctttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 87 - DNA, 203 bp, synthetic construct
  source 1..203: mol_type = other DNA
ggcgcgccagtcctaccttggggcgtccccaatctccacctctgggctccagtaacgaggactctgcaataccccctagccccctggccaagacaaccgaacttgttccgtggatatttgggatcctccacctgccaaacctgagcgattttttttgtactgcgcccccacccccaatgattctgccccgactcggaccgatg

SEQ ID NO: 88 - DNA, 203 bp, synthetic construct
  source 1..203: mol_type = other DNA
ggcgcgccagtccttgcaataccccctagccccctggccaagacaaccgaacttgttccgtggatatttgggatcctccacctgccaaacctgagcgattttttttgtactgcgcccccacccccaatgattctgcccctcctccagctgttgcagcgtggaaaaggggaaacaaatcaccgggggggcgactcggaccgatg

SEQ ID NO: 89 - DNA, 203 bp, synthetic construct
  source 1..203: mol_type = other DNA
ggcgcgccagtcctaggggaaacaaatcaccgggggggatttttttcgtctatttttatttttcgcacttgctgggaatggtgaagtgcttcttgtgaatgattctagccaaaggatgctcttcatttcctgctttctatggagacctcagtgttgagtttgcctctgctggaactgcgtctaccacccgactcggaccgatg

SEQ ID NO: 90 - DNA, 203 bp, synthetic construct
  source 1..203: mol_type = other DNA
ggcgcgccagtcctgatgctcttcatttcctgctttctatggagacctcagtgttgagtttgcctctgctggaactgcgtctaccaccttctctaccttccaaggtctttgcctctatctacaacctggcattgtctgtgggtccatgaaggcttggatgaccttagagggaaggtctgggagtccaccgactcggaccgatg

SEQ ID NO: 91 - DNA, 203 bp, synthetic construct
  source 1..203: mol_type = other DNA
ggcgcgccagtccttagagggaaggtctgggagtccaccctcatagactaagcagcaatggctgggcatattttaagccgcattttaacatgggtcaagccatcagtagaaggcaagtgctaagactaaagacttatttgaattttatttaaattagatggactgggccttggccaatttccatgcaacgactcggaccgatg

SEQ ID NO: 92 - DNA, 203 bp, synthetic construct
  source 1..203: mol_type = other DNA
ggcgcgccagtcctgggccttggccaatttccatgcaagaaaaagtatatttcattttctaggcacaacttctgagtgtcagatacttgctgtctttgagtcttgtggcgtcatcaccggacagcatcccagacagacttccagatttgaacatctaccccccaacacgtaggtgtatgggagaccaccgactcggaccgatg

SEQ ID NO: 93 - DNA, 203 bp, synthetic construct
  source 1..203: mol_type = other DNA
ggcgcgccagtcctacaacttctgagtgtcagatacttgctgtctttgagtcttgtggcgtcatcaccggacagcatcccagacagacttccagatttgaacatctaccccccaacacgtaggtgtatgggagaccacatcatttcatgacttatgtttgaggaacactaggctgttgtctagacgagcgactcggaccgatg

SEQ ID NO: 94 - DNA, 203 bp, synthetic construct
  source 1..203: mol_type = other DNA
ggcgcgccagtcctacacgtaggtgtatgggagaccacatcatttcatgacttatgtttgaggaacactaggctgttgtctagacgaggcaagctctggaaagcaacgccgagtctctgagaagagggagcataggctgtgctgatttaaaaacagaaaatgcaaagttggactgaaaatatcccacgcgactcggaccgatg

SEQ ID NO: 95 - DNA, 203 bp, synthetic construct
  source 1..203: mol_type = other DNA
ggcgcgccagtcctacactaggctgttgtctagacgaggcaagctctggaaagcaacgccgagtctctgagaagagggagcataggctgtgctgatttaaaaacagaaaatgcaaagttggactgaaaatatcccacgtcttctaagcaatctgcttaaggcttccaaacttaccttaatttggtaagcgactcggaccgatg

SEQ ID NO: 96 - DNA, 203 bp, synthetic construct
  source 1..203: mol_type = other DNA
ggcgcgccagtccttgtgctgatttaaaaacagaaaatgcaaagttggactgaaaatatcccacgtcttctaagcaatctgcttaaggcttccaaacttaccttaatttggtaagaaaataagctgccctatttttctttcttcttctcttacaactggaagcagccatttccccaaaccaccaccatcgactcggaccgatg

SEQ ID NO: 97 - DNA, 203 bp, synthetic construct
  source 1..203: mol_type = other DNA
ggcgcgccagtcctccctggcgtcccggccgaggcagcatcccagcctttaccctgtgggcccaacgtgaggagtgtgaggagcggcatgcggcgccccctggctggttcggtgtcttttgacctgctgttgactgctcccagggggccctgacgccctggggcacttttgctctgcacaggaccacgcgactcggaccgatg

SEQ ID NO: 98 - DNA, 203 bp, synthetic construct
  source 1..203: mol_type = other DNA
ggcgcgccagtcctgggtgtagaggaaggaaggagcaagaccagcctgtagactgtgcccctggctgggcaaaagggccaggggcccggagccttccctccactgccctcgaacgcctcacttcctaagtctctgcatttctcagtcagtggacagcttttgggactcttgtgtgaggactttgggggcgactcggaccgatg

SEQ ID NO: 99 - DNA, 203 bp, synthetic construct
  source 1..203: mol_type = other DNA
ggcgcgccagtcctctggctgggcaaaagggccaggggcccggagccttccctccactgccctcgaacgcctcacttcctaagtctctgcatttctcagtcagtggacagcttttgggactcttgtgtgaggactttgggggaccaggccaggctgggcctctgctgattgagatcttgggatccagacgactcggaccgatg

SEQ ID NO: 100 - DNA, 203 bp, synthetic construct
  source 1..203: mol_type = other DNA
ggcgcgccagtccttgccacccggcgtggaggacggggtccaccctggtgggctgagcgcgaggccggagggctgggaggctgcggctgggctgagcactgcggagggccgtcggcttatcccaggtcccggtcacgcagcggccacgctcggggagcgcgcggacctgagcgggcaccacgagccgccgactcggaccgatg

SEQ ID NO: 101 - DNA, 203 bp, synthetic construct
  source 1..203: mol_type = other DNA
ggcgcgccagtcctggacgcggcagggcccggggacagcggggacgccgcccactccaccgggtatgaagctaaaatacagtggttacaacacaggaggttgacaggcctgacctttgaatcccagttcatccacaaacggagctttgtaatctcggattgtaagggccaagcttgtggactttagtgcgactcggaccgatg

SEQ ID NO: 102 - DNA, 203 bp, synthetic construct
  source 1..203: mol_type = other DNA
ggcgcgccagtcctgggccaagcttgtggactttagtgacttctgatctaagaacctccaccagggctgagggagctcaagtttcagcctgaggcatgggccaggaggccatggtgacctgagacccgtggattctgtccagtacaccctgttgctccttctgcctcccctctcctgtattgaaagcgcgactcggaccgatg

SEQ ID NO: 103 - DNA, 203 bp, synthetic construct
  source 1..203: mol_type = other DNA
ggcgcgccagtcctggctgagggagctcaagtttcagcctgaggcatgggccaggaggccatggtgacctgagacccgtggattctgtccagtacaccctgttgctccttctgcctcccctctcctgtattgaaagcgtttgtgttcatcttatcagggacctgaccctaagagaatccttcccctgccgactcggaccgatg

SEQ ID NO: 104 - DNA, 203 bp, synthetic construct
  source 1..203: mol_type = other DNA
ggcgcgccagtccttgacctgagacccgtggattctgtccagtacaccctgttgctccttctgcctcccctctcctgtattgaaagcgtttgtgttcatcttatcagggacctgaccctaagagaatccttcccctgccaaggcagttccagcccccagaactcatcaccccatctcctgaggtggttcgactcggaccgatg

SEQ ID NO: 105 - DNA, 203 bp, synthetic construct
  source 1..203: mol_type = other DNA
ggcgcgccagtcctgaaaagaccgactccagctaagcaagaggcacagcagcagtggcagaagcagacaggagcagctggtattccggtgattaaatagttctcatagcctttttgctgtacccggtctgctccctggggtaaggcctcgtgtccgagaaggaagctgcattttaacggtgtgctgaacgactcggaccgatg

SEQ ID NO: 106 - DNA, 203 bp, synthetic construct
  source 1..203: mol_type = other DNA
ggcgcgccagtcctgctgcattttaacggtgtgctgaacagaggtctgaatcattccagctggctgcttgttttgaaaaggacaatgtgtgtataaataaaaagactgctggaagggtccagacaccggcaccggagctgaggagtgctctcagaatcctgttgaggcagatggcacgaactgaaagccgactcggaccgatg

SEQ ID NO: 107 - DNA, 203 bp, synthetic construct
  source 1..203: mol_type = other DNA
ggcgcgccagtcctgccacctccggtcggcgactgcggcgggctcgacgaggcggctgacggggcggcggcgggaagacggccgggtgcgccttggggtttagtggcggcttctccatgggtccagccagccgcttccctgtgctgtgagtgtttccaccactccaggagacagcattcagagttgaccgactcggaccgatg

SEQ ID NO: 108 - DNA, 203 bp, synthetic construct
  source 1..203: mol_type = other DNA
ggcgcgccagtcctcggcggcgggaagacggccgggtgcgccttggggtttagtggcggcttctccatgggtccagccagccgcttccctgtgctgtgagtgtttccaccactccaggagacagcattcagagttgaccttgtgagagctggccataatttaattccatctctaggttttctgtcttacgactcggaccgatg

SEQ ID NO: 109 - DNA, 203 bp, synthetic construct
  source 1..203: mol_type = other DNA
ggcgcgccagtcctttgtggagtcgcccttcccccgaggaggggagcgggcagcgccgggcgcgggatttctcccgcccagggccgaggaggagccctgggctcctcaaccgatcgggccacctccgggagcggcgccccttttctttcgggtcattcctgcagagggaaaactcctgcgtgcgcctgcgactcggaccgatg

SEQ ID NO: 110 - DNA, 203 bp, synthetic construct
  source 1..203: mol_type = other DNA
ggcgcgccagtcctcgggccacctccgggagcggcgccccttttctttcgggtcattcctgcagagggaaaactcctgcgtgcgcctgcccccaggctagcgtttggactgttttgtttttggcggaactaccgggcaggaagattgcacaagtcagggggcgtttccaatcgggtgtcaattttggacgactcggaccgatg

SEQ ID NO: 111 - DNA, 203 bp, synthetic construct
  source 1..203: mol_type = other DNA
ggcgcgccagtcctttccaatcgggtgtcaattttggatctccccccccccacccccctttggatcttgtcgggctttccacgtttcacttaaaaaaaattcttgtaacgtccaaggcaagctccccacgacccgaacacgcccagaggaaccttggggcctctggggacttggctagcaggtattcacgactcggaccgatg

SEQ ID NO: 112 - DNA, 203 bp, synthetic construct
  source 1..203: mol_type = other DNA
ggcgcgccagtcctgtcccgcgaagaaaaagataaagacatctcgtagaaatattaaaataaattcctaaagtcgttggtttctcgttcactttcgctgcctgctcaggacgagggccacaccaagaggcaagagaaacaaaaagagggaacataggaacaggaaccagataatagtgacataagcgacgactcggaccgatg

SEQ ID NO: 113 - DNA, 203 bp, synthetic construct
  source 1..203: mol_type = other DNA
ggcgcgccagtccttcctaaagtcgttggtttctcgttcactttcgctgcctgctcaggacgagggccacaccaagaggcaagagaaacaaaaagagggaacataggaacaggaaccagataatagtgacataagcgaccctttcgcaaatattttggcgcaaaatgagcgggcgccaagtgccgcgtcgactcggaccgatg

SEQ ID NO: 114 - DNA, 203 bp, synthetic construct
  source 1..203: mol_type = other DNA
ggcgcgccagtcctatgagcgggcgccaagtgccgcgtggtggagccgcctgaaaatgacatggaaaattcgccgaaaatcgcgcgttttggcagcatcaatcccaaagcacaaaattaatttctatcataatttctgggtgcaacacggacccataattgaatcgaatatagggcttatctgatagccgactcggaccgatg

SEQ ID NO: 115 - DNA, 203 bp, synthetic construct
  source 1..203: mol_type = other DNA
ggcgcgccagtcctaaaattcgccgaaaatcgcgcgttttggcagcatcaatcccaaagcacaaaattaatttctatcataatttctgggtgcaacacggacccataattgaatcgaatatagggcttatctgatagcccggcagcaacattgaactttccggctgcaaaggagacgacaccgagatccgactcggaccgatg

SEQ ID NO: 116 - DNA, 203 bp, synthetic construct
  source 1..203: mol_type = other DNA
ggcgcgccagtcctgggctccggcgataagaaatccatgctgataaggacaggaggacggtctgcggcaaattgaattcgattctgacctgtatgaaagccagcggagatacggatacctctgggtttatgggtagaaaacgcagagcgtcgcgccaacatcgaaattatttgcgtttgcatcttctccgactcggaccgatg

SEQ ID NO: 117 - DNA, 203 bp, synthetic construct
  source 1..203: mol_type = other DNA
ggcgcgccagtcctcggcaaattgaattcgattctgacctgtatgaaagccagcggagatacggatacctctgggtttatgggtagaaaacgcagagcgtcgcgccaacatcgaaattatttgcgtttgcatcttctcgtcctttcgtttatcgttctgattgccatcgtggtggcgcggtttctattcgactcggaccgatg

SEQ ID NO: 118 - DNA, 203 bp, synthetic construct
  source 1..203: mol_type = other DNA
ggcgcgccagtcctcatcgtggtggcgcggtttctattaattttgcttctgtatcgtttgcaaaatctcaaaagattcaaaaagttcgtcatcagcagccgcaacacaaaaaccaacgagtgtaaagccgagcatacaaatatcaataaaaacataaacatttacccaatctcaatctcaaaacattccgactcggaccgatg

SEQ ID NO: 119 - DNA, 203 bp, synthetic construct
  source 1..203: mol_type = other DNA
ggcgcgccagtcctaactagaggataaggctacttaaggatcaaaaaacaccaaggagacgagattttctaccaaatcgagagacgaggggcaggttaatttcgtcatttttggccaagacagcaaatagaggaacagcaaagcgaaaatcattttatacctcacacaacaactacacactaactaagcgactcggaccgatg

SEQ ID NO: 120 - DNA, 203 bp, synthetic construct
  source 1..203: mol_type = other DNA
ggcgcgccagtcctcttaagtgttcaaagtatatttagtttactttgtatataagaaaagtagctaaaagcacgcggacagggaggcaggagcaccacagtcactagccactaagcagagtcacagtcacgatcacgttcactccaggatcaggactcggggcgggatcagcagacgctgaggaagctcgactcggaccgatg

SEQ ID NO: 121 - DNA, 203 bp, synthetic construct
  source 1..203: mol_type = other DNA
ggcgcgccagtccttgttcaaagtatatttagtttactttgtatataagaaaagtagctaaaagcacgcggacagggaggcaggagcaccacagtcactagccactaagcagagtcacagtcacgatcacgttcactccaggatcaggactcggggcgggatcagcagacgctgaggaagctgccacgcgactcggaccgatg

SEQ ID NO: 122 - DNA, 203 bp, synthetic construct
  source 1..203: mol_type = other DNA
ggcgcgccagtcctctttaccgacaacgtccagcggtccagtcgagaagtaagtagtccgcgctgcgagcataactctaccagagaaacgcgcactttattggtcaagacagacggaagccggcggttggacgcaaaggttgactcggaagctgagagattgttgagtaacacgcagaagtcttgaaacgactcggaccgatg

SEQ ID NO: 123 - DNA, 203 bp, synthetic construct
  source 1..203: mol_type = other DNA
ggcgcgccagtcctttgttgagtaacacgcagaagtcttgaaagtatcaagtattgaacatatttcaagggacttggtttcggtgaagtcgtcaattccttttatcgtcaacgtttccacagccctcagaatagaaatttccaacaagccaaagcctacgtaatgaagcgccccaataaccggccgaccgactcggaccgatg

SEQ ID NO: 124 - DNA, 203 bp, synthetic construct
  source 1..203: mol_type = other DNA
ggcgcgccagtccttcactccagcaacaacaacaacaacggcagcagcagcaataacgacaacaacagcaacgacgacgcagcaagtagcagcaacagcaaaaacaacaacaccagcaacgagagcagccacagcaacaacaatactagtagcataattgcagaggcggccgccaagtttctactgaacgactcggaccgatg

SEQ ID NO: 125 - DNA, 203 bp, synthetic construct
  source 1..203: mol_type = other DNA
ggcgcgccagtcctggcggccgccaagtttctactgaaaaatggcctaaacggcagtagcagcaccagctacccccctctgccaccgcctctgcccgccaacttaagcaggacgaccacgcccacgacaacgacaacgccctcatcctccagctccaccgcctcaaatggctttttgccgcatgccaacgactcggaccgatg

SEQ ID NO: 126 - DNA, 203 bp, synthetic construct
  source 1..203: mol_type = other DNA
ggcgcgccagtccttaaaccccagttttatatcgtatatgctatctacaggtccactttacacttaataatataaaaatactactataaaggaaccagaaaaataaaaaagggtcattatttatttgagcagatcattatcaaacgcataggaagagaaaaaacacagttttattttttttccacacacgactcggaccgatg

SEQ ID NO: 127 - DNA, 203 bp, synthetic construct
  source 1..203: mol_type = other DNA
ggcgcgccagtcctttttgtgactctccctctttgtactattgctctctcactctgtcacacagtaaacggcgcactgttctcgttgcttcgagagagcgcgcctcgaatgttcgcgaaaagagcgccggagtataaatagaggagcttcgtcgacggagagtcaattctattcaaacaagtaaagtgcgactcggaccgatg

SEQ ID NO: 128 - DNA, 203 bp, synthetic construct
  source 1..203: mol_type = other DNA
ggcgcgccagtcctacgttcgttcgatggcaacggattggataacaggcgcgcgctttgttttattatccacattatcagctgcattattgttattattggccctcagcgctttaccgctcgcccacgcgtccgcccgtgaatgccgcgcggaaaagtcgctttccactagattggcgtccagattcgcgactcggaccgatg

SEQ ID NO: 129 - DNA, 203 bp, synthetic construct
  source 1..203: mol_type = other DNA
ggcgcgccagtcctttatccacattatcagctgcattattgttattattggccctcagcgctttaccgctcgcccacgcgtccgcccgtgaatgccgcgcggaaaagtcgctttccactagattggcgtccagattcgaggaaatccgtcagcagacgcattcgcgcccgttcggtcagcactatggccgactcggaccgatg

SEQ ID NO: 130 - DNA, 203 bp, synthetic construct
  source 1..203: mol_type = other DNA
ggcgcgccagtcctaaatccaaaggaggcaaaggaacagcacagaaagcgaggaaacactcaaataaaatccgccaaaaatcgcagatccctggaaaccaattcgtgtgaaatcggtcaagcccccaacgacttttagcccgtctcagacggagcaccgccaagattcttaccgccagcagcgcaatgcgactcggaccgatg

SEQ ID NO: 131 - DNA, 203 bp, synthetic construct
  source 1..203: mol_type = other DNA
ggcgcgccagtcctcactctggtatcacggtacctttgtgcgcctgttttataccccctcccccaactgtaacttagaagtaacacacaccgatcaacagtcagcgtggcacaccagccacgttttgatcaagcacttctgttaccccggactgagtatcaatagactgctcacgcggttgaaggagacgactcggaccgatg

SEQ ID NO: 132 - DNA, 203 bp, synthetic construct
  source 1..203: mol_type = other DNA
ggcgcgccagtcctcagccacgttttgatcaagcacttctgttaccccggactgagtatcaatagactgctcacgcggttgaaggagaaagcgttcgttatccggccaactacttcgaaaaacctagtaacaccgtggaagttgcagagtgtttcgctcagcactaccccagtgtagatcaggtcgatcgactcggaccgatg

SEQ ID NO: 133 - DNA, 203 bp, synthetic construct
  source 1..203: mol_type = other DNA
ggcgcgccagtccttaccccagtgtagatcaggtcgatgagtcaccgcattccccacgggcgaccgtggcggtggctgcgttggcggcctgcccatggggaaacccatgggacgctctaatacagacatggtgcgaagagtctattgagctagttggtagtcctccggcccctgaatgcggctaatcccgactcggaccgatg

SEQ ID NO: 134 - DNA, 203 bp, synthetic construct
  source 1..203: mol_type = other DNA
ggcgcgccagtcctctctaatacagacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcgactcggaccgatg

SEQ ID NO: 135 - DNA, 203 bp, synthetic construct
  source 1..203: mol_type = other DNA
ggcgcgccagtcctaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctccgactcggaccgatg

SEQ ID NO: 136 - DNA, 203 bp, synthetic construct
  source 1..203: mol_type = other DNA
ggcgcgccagtccttcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcgactcggaccgatg

SEQ ID NO: 137 - DNA, 203 bp, synthetic construct
  source 1..203: mol_type = other DNA
ggcgcgccagtccttctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaagcgactcggaccgatg

SEQ ID NO: 138 - DNA, 203 bp, synthetic construct
  source 1..203: mol_type = other DNA
ggcgcgccagtcctccagtcataccttgatcaagcacttctgtttccccggactgagtatcaataggctgctcgcgcggctgaaggagaaaacgttcgttacccgaccaactacttcgagaagcttagtaccaccatgaacgaggcagggtgtttcgctcagcacaaccccagtgtagatcaggctgacgactcggaccgatg

SEQ ID NO: 139 - DNA, 203 bp, synthetic construct
  source 1..203: mol_type = other DNA
ggcgcgccagtcctttcgagaagcttagtaccaccatgaacgaggcagggtgtttcgctcagcacaaccccagtgtagatcaggctgatgagtcactgcaacccccatgggcgaccatggcagtggctgcgttggcggcctgcccatggagaaatccatgggacgctctaattctgacatggtgtgaacgactcggaccgatg

SEQ ID NO: 140 - DNA, 203 bp, synthetic construct
  source 1..203: mol_type = other DNA
ggcgcgccagtccttccggcccctgaatgcggctaatcctaactgcggagcacatgctcacaaaccagtgggtggtgtgtcgtaacgggcaactctgcagcggaaccgactactttgggtgtccgtgtttccttttattcctatattggctgcttatggtgacaatcaaaaagttgttaccatatagccgactcggaccgatg

SEQ ID NO: 141 - DNA, 203 bp, synthetic construct
  source 1..203: mol_type = other DNA
ggcgcgccagtccttctttccaggtctagaggggtaacactttgtactgtgtttggctccacgctcgatccactggcgagtgttagtaacagcactgttgcttcgtagcggagcatgacggccgtgggaactcctccttggtaacaaggacccacggggccaaaagccacgcccacacgggcccgtcacgactcggaccgatg

SEQ ID NO: 142 - DNA, 203 bp, synthetic construct
  source 1..203: mol_type = other DNA
ggcgcgccagtcctgccccggacctcccaccgaggtggggggaaaggggccctggaccggccgggtggaaggcccggaaccggtccatcttcctcaaggttgaggaaggggtacgtctatgggtccggtgggtccgaaaggcgtctggatgcctagtgttagggttcgtaggtggtaaatcccagctacgactcggaccgatg

SEQ ID NO: 143 - DNA, 203 bp, synthetic construct
  source 1..203: mol_type = other DNA
ggcgcgccagtcctgtggaaggcccggaaccggtccatcttcctcaaggttgaggaaggggtacgtctatgggtccggtgggtccgaaaggcgtctggatgcctagtgttagggttcgtaggtggtaaatcccagctaggcgtgaaagcgctataggataggcttatcccggtgaccgctgccccggacgactcggaccgatg

SEQ ID NO: 144 - DNA, 203 bp, synthetic construct
  source 1..203: mol_type = other DNA
ggcgcgccagtcctgtctatgggtccggtgggtccgaaaggcgtctggatgcctagtgttagggttcgtaggtggtaaatcccagctaggcgtgaaagcgctataggataggcttatcccggtgaccgctgccccggaaccagccccgcggttctttggacacggtccacaggttgggggtaccggtgcgactcggaccgatg

SEQ ID NO: 145 - DNA, 203 bp, synthetic construct
  source 1..203: mol_type = other DNA
ggcgcgccagtccttatcccggtgaccgctgccccggaaccagccccgcggttctttggacacggtccacaggttgggggtaccggtgtgaataaccccccgactgaagcgtcagtcgttaaacggagacggtctcctgagatcgcaacgacgccccacgtacgggaacgccgccaaaaccttcgggacgactcggaccgatg

SEQ ID NO: 146 - DNA, 203 bp, synthetic construct
  source 1..203: mol_type = other DNA
ggcgcgccagtcctgtccacaggttgggggtaccggtgtgaataaccccccgactgaagcgtcagtcgttaaacggagacggtctcctgagatcgcaacgacgccccacgtacgggaacgccgccaaaaccttcgggacagctatgcgggttgacaatcccagtggggggccggggaccagctgattacgactcggaccgatg

SEQ ID NO: 147 - DNA, 203 bp, synthetic construct
  source 1..203: mol_type = other DNA
ggcgcgccagtcctggggggccggggaccagctgattacttgtcctgcgagttcctcttgagactggccgaaaggcagccacggggccaccaaggcggcgcagcgctgcatgcggcaaggggaaaaatccttcgggtgacccctggtggcaatcccttcccttaggagcatgagtgtggtcgacacatcgactcggaccgatg

SEQ ID NO: 148 - DNA, 203 bp, synthetic construct
  source 1..203: mol_type = other DNA
ggcgcgccagtccttggccgaaaggcagccacggggccaccaaggcggcgcagcgctgcatgcggcaaggggaaaaatccttcgggtgacccctggtggcaatcccttcccttaggagcatgagtgtggtcgacacattcaccatggcttggctgtggttgctggtttgcttccccctcgcgggggggcgactcggaccgatg

SEQ ID NO: 149 - DNA, 203 bp, synthetic construct
  source 1..203: mol_type = other DNA
ggcgcgccagtcctcactgggtgcaagccccagaaaccgacgcctactgaagtagacgtaatggccccggcccgaaccggcgaccggccaaaaggtggtggatgggtgatgacagggttggtaggtcgtaaatcccggtcatcctggtagccactataggtgggtcttaaggggaggctacggtccctcgactcggaccgatg

SEQ ID NO: 150 - DNA, 203 bp, synthetic construct
  source 1..203: mol_type = other DNA
ggcgcgccagtccttcttaaggggaggctacggtccctcttgcgcatatggaggaaaagcgcacggtccacaggtgttggtcctaccggtgtaataaggacccggcgctaggcacgccgttaaaccgagcccgttactcccctgggcaaacgacgcccacgtacggtccacgtcgcccttcaatgtctcgactcggaccgatg

SEQ ID NO: 151 - DNA, 203 bp, synthetic construct
  source 1..203: mol_type = other DNA
ggcgcgccagtcctggtccacgtcgcccttcaatgtctctcttgaccaataggcgtagccggcgagttgacaaggaccagtgggggccgggcgggagggggaaggacccccaccgctgcccttcccggggaggcgggaaatgcatggggccacccagctccgcggcggcctacagccggggtagcccacgactcggaccgatg

SEQ ID NO: 152 - DNA, 203 bp, synthetic construct
  source 1..203: mol_type = other DNA
ggcgcgccagtcctgctgcccttcccggggaggcgggaaatgcatggggccacccagctccgcggcggcctacagccggggtagcccaagaaccttcgggtgagggcgggtggcattttcttttcctataccgatcatggcagtccttctgctcctactcgtggtggaggccggggctattttagccccgactcggaccgatg

SEQ ID NO: 153 - DNA, 203 bp, synthetic construct
  source 1..203: mol_type = other DNA
ggcgcgccagtcctgcggcctacagccggggtagcccaagaaccttcgggtgagggcgggtggcattttcttttcctataccgatcatggcagtccttctgctcctactcgtggtggaggccggggctattttagccccggccacccatgcttgtagcgcgaaagggcaatatttcctcacaaactgtcgactcggaccgatg

SEQ ID NO: 154 - DNA, 203 bp, synthetic construct
  source 1..203: mol_type = other DNA
ggcgcgccagtcctctgtaggagtctaaattggggacacagatgtttggaacgtcaccttgcagtgttaacttggctttcatgaatctctttgatcttccacaaggggtaggctacgggtgaaacctcttaggctaatacttctatgaagagatgccttggatagggtaacagcggcggatattggtgcgactcggaccgatg

SEQ ID NO: 155 - DNA, 203 bp, synthetic construct
  source 1..203: mol_type = other DNA
ggcgcgccagtcctagggctgtctttaggcttaattccagacctctctgtgcttagggcaaacatcatttggccttaaatgggattctgtgagaggggatccctccattgacagctggactgttctttggggccttatgtggtgtttgcctctgaggtactcaggggcatttaggtttttcctcattccgactcggaccgatg

SEQ ID NO: 156 - DNA, 203 bp, synthetic construct
  source 1..203: mol_type = other DNA
ggcgcgccagtcctcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtcgactcggaccgatg

SEQ ID NO: 157 - DNA, 203 bp, synthetic construct
  source 1..203: mol_type = other DNA
ggcgcgccagtcctgataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaacccgactcggaccgatg

SEQ ID NO: 158 - DNA, 203 bp, synthetic construct
  source 1..203: mol_type = other DNA
ggcgcgccagtccttttagtcagtgtggaaaatctctagcagtggcgcccgaacagggacctgaaagcgaaagggaaaccagaggagctctctcgacgcaggactcggcttgctgaagcgcgcacggcaagaggcgaggggcggcgactggtgagtacgccaaaaattttgactagcggaggctagaacgactcggaccgatg

SEQ ID NO: 159 - DNA, 203 bp, synthetic construct
  source 1..203: mol_type = other DNA
ggcgcgccagtccttacggtaactttgtacgccagttttatctcccttcccccatgtaacttagaagtttttcacaaagaccaatagccggtaatcagccagattactgaaggtcaagcacttctgtttccccggtcaatgttgatatgctccaacagggcaaaaacaactgcgatcgttaaccgcaacgactcggaccgatg

SEQ ID NO: 160 - DNA, 203 bp, synthetic construct
  source 1..203: mol_type = other DNA
ggcgcgccagtcctaagtttttcacaaagaccaatagccggtaatcagccagattactgaaggtcaagcacttctgtttccccggtcaatgttgatatgctccaacagggcaaaaacaactgcgatcgttaaccgcaaagcgcctacgcaaagcttagtagcatctttgaaatcgtttggctggtcgacgactcggaccgatg

SEQ ID NO: 161 - DNA, 203 bp, synthetic construct
  source 1..203: mol_type = other DNA
ggcgcgccagtcctcaagcacttctgtttccccggtcaatgttgatatgctccaacagggcaaaaacaactgcgatcgttaaccgcaaagcgcctacgcaaagcttagtagcatctttgaaatcgtttggctggtcgatccgccatttcccctggtagacctggcagatgaggctagaaataccccaccgactcggaccgatg

SEQ ID NO: 162 - DNA, 203 bp, synthetic construct
  source 1..203: mol_type = other DNA
ggcgcgccagtcctaacaactgcgatcgttaaccgcaaagcgcctacgcaaagcttagtagcatctttgaaatcgtttggctggtcgatccgccatttcccctggtagacctggcagatgaggctagaaataccccactggcgacagtgttctagcctgcgtggctgcctgcacaccctatgggtgtgcgactcggaccgatg

SEQ ID NO: 163 - DNA, 203 bp, synthetic construct
  source 1..203: mol_type = other DNA
ggcgcgccagtcctgagccccgtgtgctcgctttgagtcctccggcccctgaatgtggctaaccttaaccctgcagctagagcacgtaacccaatgtgtatctagtcgtaatgagcaattgcgggatgggaccaactactttgggtgtccgtgtttcactttttcctttatatttgcttatggtgacacgactcggaccgatg

SEQ ID NO: 164 - DNA, 203 bp, synthetic construct
  source 1..203: mol_type = other DNA
ggcgcgccagtcctgagcctattgagctacataagaatcctccggcccctgaatgcggctaatcccaacctcggagcaggtggtcacaaaccagtgattggcctgtcgtaacgcgcaagtccgtggcggaaccgactactttgggtgtccgtgtttccttttattttattgtggctgcttatggtgaccgactcggaccgatg

SEQ ID NO: 165 - DNA, 203 bp, synthetic construct
  source 1..203: mol_type = other DNA
ggcgcgccagtcctgcgcctccgtgggcaagcactactgtttccccggtgaggccgcatagactgttcccacggttgaaagtggccgatccgttatccgctcatgtacttcgagaagcctagtatcgctctggaatcttcgacgcgttgcgctcagcactcaaccccggagtgtagcttgggccgatgcgactcggaccgatg

SEQ ID NO: 166 - DNA, 203 bp, synthetic construct
  source 1..203: mol_type = other DNA
ggcgcgccagtcctgttcccacggttgaaagtggccgatccgttatccgctcatgtacttcgagaagcctagtatcgctctggaatcttcgacgcgttgcgctcagcactcaaccccggagtgtagcttgggccgatgagtctggacagtccccactggcgacagtggtccaggctgcgctggcggcccgactcggaccgatg

SEQ ID NO: 167 - DNA, 203 bp, synthetic construct
  source 1..203: mol_type = other DNA
ggcgcgccagtcctcccggagtgtagcttgggccgatgagtctggacagtccccactggcgacagtggtccaggctgcgctggcggcccacctgtggcccaaagccacgggacgctagttgtgaacagggtgtgaagagcctattgagctacatgagagtcctccggcccctgaatgcggctaatcctcgactcggaccgatg

SEQ ID NO: 168 - DNA, 203 bp, synthetic construct
  source 1..203: mol_type = other DNA
ggcgcgccagtcctctagttgtgaacagggtgtgaagagcctattgagctacatgagagtcctccggcccctgaatgcggctaatcctaaccatggagcaggcagctgcaacccagcagccagcctgtcgtaacgcgcaagtccgtggcggaaccgactactttgggtgtccgtgtttccttttattccgactcggaccgatg

SEQ ID NO: 169 - DNA, 203 bp, synthetic construct
  source 1..203: mol_type = other DNA
ggcgcgccagtcctcggcccctgaatgcggctaatcctaaccatggagcaggcagctgcaacccagcagccagcctgtcgtaacgcgcaagtccgtggcggaaccgactactttgggtgtccgtgtttccttttattcttgaatggctgcttatggtgacaatcatagattgttatcataaagcgagtcgactcggaccgatg

SEQ ID NO: 170 - DNA, 203 bp, synthetic construct
  source 1..203: mol_type = other DNA
ggcgcgccagtcctggggtcgccgtcctacacattgttgtgacgtgcggcccagattcgaatctgtaataaaagctttttcttctatatcctcagattggcagtgagaggagattttgttcgtggtgttggctggcctactgggtggggtagggatccggactgaatccgtagtatttcggtacaacacgactcggaccgatg

SEQ ID NO: 171 - DNA, 203 bp, synthetic construct
  source 1..203: mol_type = other DNA
ggcgcgccagtcctgtaataaaagctttttcttctatatcctcagattggcagtgagaggagattttgttcgtggtgttggctggcctactgggtggggtagggatccggactgaatccgtagtatttcggtacaacatttgggggctcgtccgggattcctccccatcggcagaggtgcctactgttcgactcggaccgatg

SEQ ID NO: 172 - DNA, 203 bp, synthetic construct
  source 1..203: mol_type = other DNA
ggcgcgccagtccttttgttcgtggtgttggctggcctactgggtggggtagggatccggactgaatccgtagtatttcggtacaacatttgggggctcgtccgggattcctccccatcggcagaggtgcctactgtttcttcgaactccggcgccggtaagtaagtacttgattttggtacctcgcgcgactcggaccgatg

SEQ ID NO: 173 - DNA, 203 bp, synthetic construct
  source 1..203: mol_type = other DNA
ggcgcgccagtcctgacgctgccgggaagctccacctccgctcagcaggggacgccctggtctgagctctgtggtatctgattgttgttgaaccgtctctaagacggtgatactataagtcgtggtttgtgtgtttgtttgttaccttgtgtttgttcgtcacttgtcgacagcgccctgcgaattggcgactcggaccgatg

SEQ ID NO: 174 - DNA, 203 bp, synthetic construct
  source 1..203: mol_type = other DNA
ggcgcgccagtcctagctctgtggtatctgattgttgttgaaccgtctctaagacggtgatactataagtcgtggtttgtgtgtttgtttgttaccttgtgtttgttcgtcacttgtcgacagcgccctgcgaattggtgtacccacaccgcgcggcttgcgaataatactttggagagtcttttgcccgactcggaccgatg

SEQ ID NO: 175 - DNA, 203 bp, synthetic construct
  source 1..203: mol_type = other DNA
ggcgcgccagtcctagtcgtggtttgtgtgtttgtttgttaccttgtgtttgttcgtcacttgtcgacagcgccctgcgaattggtgtacccacaccgcgcggcttgcgaataatactttggagagtcttttgcctccagtgtcttccgtttgtactcgtcctcctctccctctccggccgggatgggcgactcggaccgatg

SEQ ID NO: 176 - DNA, 203 bp, synthetic construct
  source 1..203: mol_type = other DNA
ggcgcgccagtccttactggggggtgtgtgggaccgtacctggagtgcacggtatatatgcattcccgcatggcaagggcgtgctaccttgccccttgacgcatggtatgcgtcatcatttgccttggttaagccccatagaaacgaggcgtcacgtgccgaaaatccctttgcgtttcacagaaccacgactcggaccgatg

SEQ ID NO: 177 - DNA, 203 bp, synthetic construct
  source 1..203: mol_type = other DNA
ggcgcgccagtcctcccgcatggcaagggcgtgctaccttgccccttgacgcatggtatgcgtcatcatttgccttggttaagccccatagaaacgaggcgtcacgtgccgaaaatccctttgcgtttcacagaaccatcctaaccatgggtgtagtatgggaatcgtgtatggggatgattaggatccgactcggaccgatg

SEQ ID NO: 178 - DNA, 203 bp, synthetic construct
  source 1..203: mol_type = other DNA
ggcgcgccagtcctatcatttgccttggttaagccccatagaaacgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctggctccgactcggaccgatg

SEQ ID NO: 179 - DNA, 203 bp, synthetic construct
  source 1..203: mol_type = other DNA
ggcgcgccagtcctaaaggtctcgagatgccacgtggacgagggcatgcccaaagcacatcttaacctgagcgggggtcgcccaggtaaaagcagttttaaccgactgttacgaatacagcctgatagggtgctgcagaggcccactgtattgctactaaaaatctctgctgtacatggcacatggagcgactcggaccgatg

SEQ ID NO: 180 - DNA, 203 bp, synthetic construct
  source 1..203: mol_type = other DNA
ggcgcgccagtccttgcccatagtaggactagcaaaacggagggactagccatagtggcgagctccctgggtggtctaagtcctgagtacaggacagtcgtcagtagttcgacgtgagcagaagcccacctcgagatgctacgtggacgagggcatgccaagacacaccttaaccctagcgggggtcgcgactcggaccgatg

SEQ ID NO: 181 - DNA, 203 bp, synthetic construct
  source 1..203: mol_type = other DNA
ggcgcgccagtcctgttcgcaataagactggtcgtcacttggctgttctatcgtttcaggctttagcgcgcccttgcgcggcgggccgtcaagcccgtgcgctgtatagcgccaggtaaccggacagcggcgtgctggattttcccggtgccattgctctggatggtgtcaccaagctgacaaatgcgcgactcggaccgatg

SEQ ID NO: 182 - DNA, 203 bp, synthetic construct
  source 1..203: mol_type = other DNA
ggcgcgccagtcctggtaaccggacagcggcgtgctggattttcccggtgccattgctctggatggtgtcaccaagctgacaaatgcggagtgaacctcacaaagcgacacgcctgtggtagcgctgcccaaaagggagcggaactccccgccgaggcggtcctctctggccaaaagcccagcgttgacgactcggaccgatg

SEQ ID NO: 183 - DNA, 203 bp, synthetic construct
  source 1..203: mol_type = other DNA
ggcgcgccagtcctggtgtcaccaagctgacaaatgcggagtgaacctcacaaagcgacacgcctgtggtagcgctgcccaaaagggagcggaactccccgccgaggcggtcctctctggccaaaagcccagcgttgatagcgccttttgggatgcaggaaccccacctgccaggtgtgaagtggagtcgactcggaccgatg

SEQ ID NO: 184 - DNA, 203 bp, synthetic construct
  source 1..203: mol_type = other DNA
ggcgcgccagtcctctctggccaaaagcccagcgttgatagcgccttttgggatgcaggaaccccacctgccaggtgtgaagtggagtgagcggatctccaatttggtctgttctgaactacaccatttactgctgtgaagaatgccctggaggcaagctggttacagccctgaccaggccctgcccgcgactcggaccgatg

SEQ ID NO: 185 - DNA, 203 bp, synthetic construct
  source 1..203: mol_type = other DNA
ggcgcgccagtccttgaactacaccatttactgctgtgaagaatgccctggaggcaagctggttacagccctgaccaggccctgcccgtgactctcgaccggcgcagggtcaaaaattgtctaagcagcagcaggaacgcgggagcgtttcttttccttttgtactgacatgatggcggcgtctaaggcgactcggaccgatg

SEQ ID NO: 186 - DNA, 203 bp, synthetic construct
  source 1..203: mol_type = other DNA
ggcgcgccagtcctacagccctgaccaggccctgcccgtgactctcgaccggcgcagggtcaaaaattgtctaagcagcagcaggaacgcgggagcgtttcttttccttttgtactgacatgatggcggcgtctaaggtgtatagagtttgcgagcagactctgctggcaggtgccgttcgcatgatgcgactcggaccgatg

SEQ ID NO: 187 - DNA, 203 bp, synthetic construct
  source 1..203: mol_type = other DNA
ggcgcgccagtcctcgcagggtcaaaaattgtctaagcagcagcaggaacgcgggagcgtttcttttccttttgtactgacatgatggcggcgtctaaggtgtatagagtttgcgagcagactctgctggcaggtgccgttcgcatgatggacaaattcttgcaaaagagaactgtttttgtcccccacgactcggaccgatg

SEQ ID NO: 188 - DNA, 203 bp, synthetic construct
  source 1..203: mol_type = other DNA
ggcgcgccagtcctattgcttttcttccaactaaacccctattgatgtgttggtcgtttgccaatcggagggcgacaggcacaggtcgctccgagttctagtagtgtgggaacttgttactactgatgaaacgaggtagtgacactcagtacctgcgaacgaggtcggggccctcccttcttccttcacgactcggaccgatg

SEQ ID NO: 189 - DNA, 203 bp, synthetic construct
  source 1..203: mol_type = other DNA
ggcgcgccagtccttcggggccctcccttcttccttcacccaactttcacttttcgttccactttagcaggggtcttctttctatccccctggcggcattggaactagccgtcgcgtcttaacgcgcagccctgaaggccccacaccttgtggatcttgccgtgggtatgtttctggcatgtgtttctcgactcggaccgatg

SEQ ID NO: 190 - DNA, 203 bp, synthetic construct
  source 1..203: mol_type = other DNA
ggcgcgccagtccttagcaggggtcttctttctatccccctggcggcattggaactagccgtcgcgtcttaacgcgcagccctgaaggccccacaccttgtggatcttgccgtgggtatgtttctggcatgtgtttctcaagcctgcaaccgaagccgaacagccacatgaacagtttgagcgtggtacgactcggaccgatg

SEQ ID NO: 191 - DNA, 203 bp, synthetic construct
  source 1..203: mol_type = other DNA
ggcgcgccagtcctccctcgtggtaacacgagcccccgtggccaaaagcccagtgtttacagcacctctcacatccaggacgaccccatcctggcgctcactcttagtagtatggcttagtacgcattaggtggtaagccgagctctccctcggccttgttctgaatgcacacatgtctaggggctaacgactcggaccgatg

SEQ ID NO: 192 - DNA, 203 bp, synthetic construct
  source 1..203: mol_type = other DNA
ggcgcgccagtcctcctctcacatccaggacgaccccatcctggcgctcactcttagtagtatggcttagtacgcattaggtggtaagccgagctctccctcggccttgttctgaatgcacacatgtctaggggctaaggatgtcctacaggtacccgcacgtaaccttcagagagtgcggatctgagcgactcggaccgatg

SEQ ID NO: 193 - DNA, 203 bp, synthetic construct
  source 1..203: mol_type = other DNA
ggcgcgccagtcctgcttagtacgcattaggtggtaagccgagctctccctcggccttgttctgaatgcacacatgtctaggggctaaggatgtcctacaggtacccgcacgtaaccttcagagagtgcggatctgagtaggagaccgtggtgcactgctttacagatgcagcccggtttaaaaagcgcgactcggaccgatg

SEQ ID NO: 194 - DNA, 203 bp, synthetic construct
  source 1..203: mol_type = other DNA
ggcgcgccagtcctaatgcacacatgtctaggggctaaggatgtcctacaggtacccgcacgtaaccttcagagagtgcggatctgagtaggagaccgtggtgcactgctttacagatgcagcccggtttaaaaagcgtctatgcccctacagggtagcggtgggccgcgccctttccttttaaaactcgactcggaccgatg

SEQ ID NO: 195 - DNA, 203 bp, synthetic construct
  source 1..203: mol_type = other DNA
ggcgcgccagtcctaggtacccgcacgtaaccttcagagagtgcggatctgagtaggagaccgtggtgcactgctttacagatgcagcccggtttaaaaagcgtctatgcccctacagggtagcggtgggccgcgccctttccttttaaaactacttgttctatggtgacaatggcaggaaacatgatcgactcggaccgatg

SEQ ID NO: 196 - DNA, 203 bp, synthetic construct
  source 1..203: mol_type = other DNA
ggcgcgccagtcctaccagtgtttcaagaacacggatgcagcagcagctcttctggcctctcacgccatccaggggaccttgtcctaccctcttgtgtccgtcgtcagtgaatctctgactcgaaaaggtactcagcttctctatctacttgctgttgccgttgtcattatcctgtttattatcttgccgactcggaccgatg

SEQ ID NO: 197 - DNA, 203 bp, synthetic construct
  source 1..203: mol_type = other DNA
ggcgcgccagtcctaacacggatgcagcagcagctcttctggcctctcacgccatccaggggaccttgtcctaccctcttgtgtccgtcgtcagtgaatctctgactcgaaaaggtactcagcttctctatctacttgctgttgccgttgtcattatcctgtttattatcttgctgggagttatcatgcgactcggaccgatg

SEQ ID NO: 198 - DNA, 203 bp, synthetic construct
  source 1..203: mol_type = other DNA
ggcgcgccagtcctgcggacggagatcatcccccggttaccccctttcgacgcgggtactgcgatagtgccaccccagtctttcctactcccgactcccgaccctaacccaggttcctcggaacaggaacaccaatttactcatcccctggatgctgactaatcagaggaacgtcagcattttccggccgactcggaccgatg

SEQ ID NO: 199 - DNA, 203 bp, synthetic construct
  source 1..203: mol_type = other DNA
ggcgcgccagtccttcctcggaacaggaacaccaatttactcatcccctggatgctgactaatcagaggaacgtcagcattttccggcccaggctaagagaagtagataagttagaatccaaattgatttatcatccccttgacgaattcgcgttggaaaaacacctctcacttgccgctcttcacaccgactcggaccgatg

SEQ ID NO: 200 - DNA, 203 bp, synthetic construct
  source 1..203: mol_type = other DNA
ggcgcgccagtcctagaggaacgtcagcattttccggcccaggctaagagaagtagataagttagaatccaaattgatttatcatccccttgacgaattcgcgttggaaaaacacctctcacttgccgctcttcacacccattaatttaattcggcctctgtgttgagccccttgttgaagtgtttcccgactcggaccgatg

SEQ ID NO: 201 - DNA, 203 bp, synthetic construct
  source 1..203: mol_type = other DNA
ggcgcgccagtcctaagtcaaccgactccgacgaaactaccatcatgcctccccgattatgtgatgctttctgccctgctgggtggagcaccctcgggttgagaaaaccttcttcctttttccttggactccggtcccccggtctaagccgctcggaatatgacagggttattttcacctcttcttttcgactcggaccgatg

SEQ ID NO: 202 - DNA, 203 bp, synthetic construct
  source 1..203: mol_type = other DNA
ggcgcgccagtccttgctttctgccctgctgggtggagcaccctcgggttgagaaaaccttcttcctttttccttggactccggtcccccggtctaagccgctcggaatatgacagggttattttcacctcttcttttctactccacagtgttctatactgtggaagggtatgtgttgccccttccttcgactcggaccgatg

SEQ ID NO: 203 - DNA, 203 bp, synthetic construct
  source 1..203: mol_type = other DNA
ggcgcgccagtcctcctttttccttggactccggtcccccggtctaagccgctcggaatatgacagggttattttcacctcttcttttctactccacagtgttctatactgtggaagggtatgtgttgccccttccttcttggagaacgtgcgcggcggtctttccgtctctcgacaagcgcgcgtgccgactcggaccgatg

SEQ ID NO: 204 - DNA, 203 bp, synthetic construct
  source 1..203: mol_type = other DNA
ggcgcgccagtcctagggttattttcacctcttcttttctactccacagtgttctatactgtggaagggtatgtgttgccccttccttcttggagaacgtgcgcggcggtctttccgtctctcgacaagcgcgcgtgcaacatacagagtaacgcgaagaaagcagttctcggtctagctctagtgcccgactcggaccgatg

SEQ ID NO: 205 - DNA, 203 bp, synthetic construct
  source 1..203: mol_type = other DNA
ggcgcgccagtcctacaaaggcagcggaacccccctcctggtaacaggagcctctgcggccaaaagccacgtggataagatccacctttgtgtgcggtgcaaccccagcaccctggtttcttggtgacactctagtgaacccctgaatggcaatctcaagcgcctctgtagggaagccaagaatgtcccgactcggaccgatg

SEQ ID NO: 206 - DNA, 203 bp, synthetic construct
  source 1..203: mol_type = other DNA
ggcgcgccagtcctggtttcttggtgacactctagtgaacccctgaatggcaatctcaagcgcctctgtagggaagccaagaatgtccaggaggtaccccttcctctcggaagggatctgacctggagacacatcacacgtgctttacacctgtgcttgtgtttaaaaattgttacagcttccccgaacgactcggaccgatg

SEQ ID NO: 207 - DNA, 203 bp, synthetic construct
  source 1..203: mol_type = other DNA
ggcgcgccagtccttctagtgaacccctgaatggcaatctcaagcgcctctgtagggaagccaagaatgtccaggaggtaccccttcctctcggaagggatctgacctggagacacatcacacgtgctttacacctgtgcttgtgtttaaaaattgttacagcttccccgaaccaagtggtcttggttcgactcggaccgatg

SEQ ID NO: 208 - DNA, 203 bp, synthetic construct
  source 1..203: mol_type = other DNA
ggcgcgccagtcctcctaaagttgatctcgaaacttggtgctaaacacatcaaggattgggaacacttggaggagttcagaaggtctctttgtgatgttgctgtttcgttgaacaattgtgcgtattacacacagttggacgacgctgtatgggaggttcataagaccgcccctccaggttcgtttgtcgactcggaccgatg

SEQ ID NO: 209 - DNA, 203 bp, synthetic construct
  source 1..203: mol_type = other DNA
ggcgcgccagtcctacttggaggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagttcgactcggaccgatg

SEQ ID NO: 210 - DNA, 203 bp, synthetic construct
  source 1..203: mol_type = other DNA
ggcgcgccagtcctggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagtttgtttatcgactcggaccgatg

SEQ ID NO: 211 - DNA, 203 bp, synthetic construct
  source 1..203: mol_type = other DNA
ggcgcgccagtcctaattactaatttgatctttaggttataatgttaggactataaaaattagcttaatgcatttagtaatttaaggcttagttatttaactttacttatcaagatggccgttggcagccccacgaaatctagattagtccgaatgtcctattttgattaggtggtcagataggtcagcgactcggaccgatg

SEQ ID NO: 212 - DNA, 203 bp, synthetic construct
  source 1..203: mol_type = other DNA
ggcgcgccagtcctgcctcagcgccaggcatagctggatcgtcaatcccaagtttggacttagacttgctctatgttacaattgggaggagcgtgacttaccattggtcgttgatgacgttaattccaaacaaaaacaacaacaacaacttagtttaaataattccggtctttaagcatcagggtagacgactcggaccgatg

SEQ ID NO: 213 - DNA, 203 bp, synthetic construct
  source 1..203: mol_type = other DNA
ggcgcgccagtcctattagttagcccttgtggatacgccactgccgctcaggtacagtaggacataccccaaatattgggttccactcgtagagaagaaaattagtggcgaaacgtacggtttatgtcaaaggagaaggtgattttaattgcacctgaagcaaccctaggtcttccctttgatgtgagcgactcggaccgatg

SEQ ID NO: 214 - DNA, 203 bp, synthetic construct
  source 1..203: mol_type = other DNA
ggcgcgccagtcctttaaacatcattgttcttatttacaatcaaatcgctatcgccacaaggctagtgataataactaagggggcgaagtcaagccctccaacctaatctccataaacagtgtctaagacgaacctcagcgaaagaaggaagatctctagacctactggaaataacataactctggaccgactcggaccgatg

SEQ ID NO: 215 - DNA, 203 bp, synthetic construct
  source 1..203: mol_type = other DNA
ggcgcgccagtcctaaacagtgtctaagacgaacctcagcgaaagaaggaagatctctagacctactggaaataacataactctggacctattggaacttatataattggcgcccaaccaacaatctgaacccaccaatctaatttaacacactttgtcaggcgacaaacagggtagttaagttagaacgactcggaccgatg

SEQ ID NO: 216 - DNA, 203 bp, synthetic construct
  source 1..203: mol_type = other DNA
ggcgcgccagtcctgactaagtgtgaacttgcctctctcaacaaaaagccaccgacattaagagagagagtattgctgcttagttaactgcaggccctatttagggttaccgcccaggatctgcaacagcattcctgtatcatccagggcaccggtggacttggtgaggattgagttgacctcatcatcgactcggaccgatg

SEQ ID NO: 217 - DNA, 203 bp, synthetic construct
  source 1..203: mol_type = other DNA
ggcgcgccagtcctcattctatggttacccatcattagaggaaatttccaataaactctggtgtaaggcttagagtgatggtcgaggtgccctatttagggtgaggagcctcggtggcagccccaccaaatcctctattggataggaacagctgtactgggcagttacagcagtcgtatggtaacacacgactcggaccgatg

SEQ ID NO: 218 - DNA, 203 bp, synthetic construct
  source 1..203: mol_type = other DNA
ggcgcgccagtcctattcaaaataaaatcccgtgcggtcggaaacaaaaattaatttaaattttttaattccgaaacttaaaaccaagtttaaagaaaacttaaaatcaagaaaacttaaaaccaagtttaaagaaaacttaaaatcaagaaaacttaaaaccaagtttaaagaaaacttaaaatcaacgactcggaccgatg

SEQ ID NO: 219 - DNA, 203 bp, synthetic construct
  source 1..203: mol_type = other DNA
ggcgcgccagtcctcactgtttcatggttacccatcatttgaggaaatttccaataaacttgaatgtaaggcttgaaacagtggtctaggtgccctatttagggtgaggagcctagctggcagccccagtgaatcctctattggatagaaaccgctatatcgggtagctatagcagtcggatagtaatcgactcggaccgatg

SEQ ID NO: 220 - DNA, 203 bp, synthetic construct
  source 1..203: mol_type = other DNA
ggcgcgccagtcctaaattagtggcaataacatatatatgtcaaccctgctcattggtttaattgagcgcatttagtgttgtgtgatcttgcgcgataaatgctgacgtgaaaacgttgcgtattgctacaacacttggttagctatttagctttactaatcaagacgccgtcgtgcagcccacaaaacgactcggaccgatg

SEQ ID NO: 221 - DNA, 203 bp, synthetic construct
  source 1..203: mol_type = other DNA
ggcgcgccagtcctggaaattgtcgttgaactacatgttgtaaggctttagagaaataagggagtgtcctatttaggatgaggtgctccggtggcagccccaccaaaacctctagcgactaggaacagctatatcgggttgctatagcagtcaggatgtcattctggcgttccgaaatacccaaacctcgactcggaccgatg

SEQ ID NO: 222 - DNA, 203 bp, synthetic construct
  source 1..203: mol_type = other DNA
ggcgcgccagtccttgtgaaaagggtaaagtatgaaagctactctcagaaaagtacttatgtattgatgagagccttaaaatgactttatattcacaaaactgctggaagacaatgatctggggtatcacattccctcttaggttaagtttcgcactactaggaatttttgcgaaaattcttaattcccgactcggaccgatg

SEQ ID NO: 223 - DNA, 203 bp, synthetic construct
  source 1..203: mol_type = other DNA
ggcgcgccagtccttgatgagagccttaaaatgactttatattcacaaaactgctggaagacaatgatctggggtatcacattccctcttaggttaagtttcgcactactaggaatttttgcgaaaattcttaattccattcttatggtgtagtgtttgttcttttcaattggggcgtatctctctttcgactcggaccgatg

SEQ ID NO: 224 - DNA, 203 bp, synthetic construct
  source 1..203: mol_type = other DNA
ggcgcgccagtcctaaactctccgaacactaggtgcagtaaggctttcatggagtggtttgctatttagcgtacgtgtaccataggcagccccaaaaacacgtgtgaggagaaagtcccagtcactttgggcaaagtagacagccgcgcttgcgtggtgggacttaattaatgcctgctaacccagttcgactcggaccgatg

SEQ ID NO: 225 - DNA, 203 bp, synthetic construct
  source 1..203: mol_type = other DNA
ggcgcgccagtcctaggctttcatggagtggtttgctatttagcgtacgtgtaccataggcagccccaaaaacacgtgtgaggagaaagtcccagtcactttgggcaaagtagacagccgcgcttgcgtggtgggacttaattaatgcctgctaacccagttgaaattgataattttgatacaacaaccgactcggaccgatg

SEQ ID NO: 226 - DNA, 203 bp, synthetic construct
  source 1..203: mol_type = other DNA
ggcgcgccagtcctcccgagctgcctgtgggttgcacccacccacagggcccactgggcgctagcactctggtactgaggtacctttgtgcgcctgtttttactccccttcccccgaagtaacttagaagctgtaaatcaacgatcaatagcaggtgtggcacaccagtcataccttgatcaagcactcgactcggaccgatg

SEQ ID NO: 227 - DNA, 203 bp, synthetic construct
  source 1..203: mol_type = other DNA
ggcgcgccagtcctttcatgttggctgcgctggcggcccacctgtggcccaaagccacgggacgctagttgtgaacagggtgtgaagagcctattgagctacatgagagtcctccggcccctgaatgcggctaatcctaaccatggagcaggcagctgcaacccagcagccagcctgtcgtaacgcgccgactcggaccgatg

SEQ ID NO: 228 - DNA, 203 bp, synthetic construct
  source 1..203: mol_type = other DNA
ggcgcgccagtccttgttcgcaggtagtcgtcagtggttcgacgccttggaataaaggtctcgagatgccacgtggacgagggcatgcccaaagcacatcttaacctgagcgggggtcgcccaggtaaaagcagttttaaccgactgttacgaatacagcctgatagggtgctgcagaggcccactgtcgactcggaccgatg

SEQ ID NO: 229 - DNA, 203 bp, Homo sapiens
  source 1..203: mol_type = genomic DNA
ggcgcgccagtcctcgcatttccggcgacgcctcggtactgacctctgcagagccgggtggagcccattgacgtccagcgaagcgaggagcagcgatggacggtcgggtgcagctgataaaggccctcctggccttgccgatccggcctgcgacgcgtcgctggaggaacccgattccctttcccgagcgactcggaccgatg

SEQ ID NO: 230 - DNA, 203 bp, Homo sapiens
  source 1..203: mol_type = other DNA
ggcgcgccagtccttcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtaccgactcggaccgatg

SEQ ID NO: 231 - DNA, 203 bp, Homo sapiens
  source 1..203: mol_type = other DNA
ggcgcgccagtcctcatccagctcctctccacagcccaacccacaccagcctcagacaccaccatgaccggctcctgctgcggctccaccttctcctccctgagctacgggggaggctgctgccagccctgctgctgccgcgacccctgctgctgccgccccgtgacctgccagaccaccgtgtgccgcgactcggaccgatg

SEQ ID NO: 232 - DNA, 203 bp, Homo sapiens
  source 1..203: mol_type = other DNA
ggcgcgccagtccttggcggtgggcgggagcggtcggcggcctcagccccttcagagagcgactttcaaactcgcgcccgcgtcgcggcagcacctgggcagccccgcacgccgtgcgcgtcccgagcccgcggggcagctaccgctcgaatctccctggggtgccctccccaggcagcaatgccaggcgactcggaccgatg

SEQ ID NO: 233 - DNA, 203 bp, Homo sapiens
  source 1..203: mol_type = other DNA
ggcgcgccagtccttgtgtcacttccggcctccctttagctgccatcttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaaccgactcggaccgatg

SEQ ID NO: 234 - DNA, 203 bp, Homo sapiens
  source 1..203: mol_type = other DNA
ggcgcgccagtcctggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctccgactcggaccgatg

SEQ ID NO: 235 - DNA, 203 bp, Homo sapiens
  source 1..203: mol_type = other DNA
ggcgcgccagtcctcggggctcgcggacaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtccgactcggaccgatg

SEQ ID NO: 236 - DNA, 203 bp, Homo sapiens
  source 1..203: mol_type = other DNA
ggcgcgccagtccttccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattcgactcggaccgatg

SEQ ID NO: 237 - DNA, 203 bp, Homo sapiens
  source 1..203: mol_type = other DNA
ggcgcgccagtcctctcctagtcgcagcaagcgcggaactggggttgcggcgtctaagtgtttccggtggattcccagggactgtcggaggtgtggactctgcctgcctacctggtctgggaagatgttctaccatatctccctagagcacgaaatcctgctgcacccgcgctacttcggccccaactcgactcggaccgatg

SEQ ID NO: 238 - DNA, 203 bp, Homo sapiens
  source 1..203: mol_type = other DNA
ggcgcgccagtcctgctgtcgtatcgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagcgactcggaccgatg

SEQ ID NO: 239 - DNA, 203 bp, Homo sapiens
  source 1..203: mol_type = other DNA
ggcgcgccagtcctgactacaaggagacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagcgactcggaccgatg

SEQ ID NO: 240 - DNA, 203 bp, Homo sapiens
  source 1..203: mol_type = other DNA
ggcgcgccagtcctagaggagtcaaccctgaggaggaaaaagtagtatgatttgctggcgtcacccctctgctccgtgcgggcgcggcgaatggcaggtcccgaggtcgcagcttccactggcgcgggttgagttccctgttgcccttggtctcggggtcgctgtaggcgctgaggctgcagctatcacgactcggaccgatg

SEQ ID NO: 241 - DNA, 203 bp, Homo sapiens
  source 1..203: mol_type = other DNA
ggcgcgccagtcctcgacttcacgcagggtccgtggggtccccgcggcgcgcagcggctgaaggaggccccagggccttggcgaccgcagcggcggctttagcgtcagtgactaggcagcagggggtcaggatgcggcgaagctcccgcccgggctcggcctcgtcctcgcgcaagcacacgcccaaccgactcggaccgatg

SEQ ID NO: 242 - DNA, 203 bp, Homo sapiens
  source 1..203: mol_type = other DNA
ggcgcgccagtcctgattcacgcccccttccggcgcctagagcaccgctgccgccatgttgagggggggaccgcgaccagctgggcccctggctcagggaggggccacgtcagtgctgccagagacgtcacaatgccggcccagccgttcggcagagaagaggcgatggcggcgatggcatctctcggcgactcggaccgatg

SEQ ID NO: 243 - DNA, 203 bp, Homo sapiens
  source 1..203: mol_type = other DNA
ggcgcgccagtcctgggaggtgaaaggtcatagtcctgtttggcggccatttctcttgaaactgcggctcgggacctgcggtacctgctgtagtcacgagggacgggcggcggcctggtcggcagagagtagcctgcaacattcggccgtggttacgatgagtttacccctcaatcccaaacctttcccgactcggaccgatg

SEQ ID NO: 244 - DNA, 203 bp, Homo sapiens
  source 1..203: mol_type = other DNA
ggcgcgccagtcctaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggaagatgtagattccttcatgacgactcggaccgatg

SEQ ID NO: 245 - DNA, 203 bp, Homo sapiens
  source 1..203: mol_type = other DNA
ggcgcgccagtcctcccttgcgcgccaccgtcccttctctcttcctcggcgctgcctacggaggtggcagccatctccttctcgctggcgattggaagacactctgcgacagtgttcagtccctgggcaggaaagcctccttccaggattcttcctcacctggggccgcttcttccccaaaaggcatccgactcggaccgatg

SEQ ID NO: 246 - DNA, 203 bp, Homo sapiens
  source 1..203: mol_type = other DNA
ggcgcgccagtcctcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggcgactcggaccgatg

SEQ ID NO: 247 - DNA, 203 bp, Homo sapiens
  source 1..203: mol_type = other DNA
ggcgcgccagtcctgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagccgactcggaccgatg

SEQ ID NO: 248 - DNA, 203 bp, Homo sapiens
  source 1..203: mol_type = other DNA
ggcgcgccagtcctgctacgcagagttagagaagccagagtccaagccaagaactctgactccacatccagtcccttctctcctttataactcaagtttccttgcgccacactgccctccacgttatgctgtacatgacaacttgggtgaggcaacagggaagctgaaaagagatcatacggtgctgacgactcggaccgatg

SEQ ID NO: 249 - DNA, 203 bp, Homo sapiens
  source 1..203: mol_type = other DNA
ggcgcgccagtcctagacacgggcgaggggaggaagaaggcgcctcgggctccggtctcctgcgctcctgctgggcgccagcggctggaccttggcagccgtctgaggcttcggggagcccaaggccaccggcagcgcttgttagaatgcagattcccggggttcgactggaatgagaccccggggagcgactcggaccgatg

SEQ ID NO: 250 - DNA, 203 bp, Homo sapiens
  source 1..203: mol_type = other DNA
ggcgcgccagtcctttgtcctcagccaattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagcgactcggaccgatg

SEQ ID NO: 251 - DNA, 203 bp, Homo sapiens
  source 1..203: mol_type = other DNA
ggcgcgccagtccttccctagcaaggcgtttctctgggcgcgctctgtggccaccctcacactcggtgcccggaaatcgagccctttgcccacggctacttcacgggaccaccctcccgggttaggcataggccctcccggatcttccgcggtgcggtaaccagcgtgagctcgcccgccagaagaatcgactcggaccgatg

SEQ ID NO: 252 - DNA, 203 bp, Homo sapiens
  source 1..203: mol_type = other DNA
ggcgcgccagtcctgcagtctccgcctaagactttccaagtcctgtagtttcgagcccgctgccctttgcctcctgggcggagaagctgcttcctcctgggaacaaccgcctcccgctcctagcaggttgctactgccccgaacccgcgctgcagggaacagcggggcaaacaaaaccaatagagccacgactcggaccgatg

SEQ ID NO: 253 - DNA, 203 bp, Homo sapiens
  source 1..203: mol_type = other DNA
ggcgcgccagtcctagaaacagcctatagacgccacgagtcggcggcgctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgcgactcggaccgatg

SEQ ID NO: 254 - DNA, 203 bp, Homo sapiens
  source 1..203: mol_type = other DNA
ggcgcgccagtcctcggggcgccgctgagccaagtgggccacccgggcacggccacgctcccgggtcacgtgacacggagggggccgaattctgctggaggcagcgccatatcctggaggtgaaggtaccacctcatggagacccccgcggccgccgcccccgctgggagcttattcccctccttcctcgactcggaccgatg

SEQ ID NO: 255 - DNA, 203 bp, Homo sapiens
  source 1..203: mol_type = other DNA
ggcgcgccagtccttatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcgactcggaccgatg

SEQ ID NO: 256 - DNA, 203 bp, Homo sapiens
  source 1..203: mol_type = other DNA
ggcgcgccagtcctagagcgtcttctcgggcctgggcggcgcagacgaggcctgaggcggcggcgcgaggcagttccagctattcttcagatgctctggattttgagacggagcacaaattggaccctgtatttgattctccacggatgtcccgccgtagtttgcgcctggccacgacagcatgcacccgactcggaccgatg

SEQ ID NO: 257 - DNA, 203 bp, Homo sapiens
  source 1..203: mol_type = other DNA
ggcgcgccagtccttgtggtctctccatgctgcccaggtcggactcctaggctcaagcgatcccctcgccccagcctgcctggaggcgcgcgcgtggtctccgcgccctgttgcgccttcaaagtgcccagaatggtgtctggtgcaaaataagcagcggcggggaacaccttgccactgtcaccgtccgactcggaccgatg

SEQ ID NO: 258 - DNA, 203 bp, Homo sapiens
  source 1..203: mol_type = other DNA
ggcgcgccagtcctgggcaaaggaggaagagccagaggatccagacgccttggaggacttggaacacctgtaacaggacaaggagttctgctcaggcacgtggccacagaaaactacttaggaagcctgtggtgagaacaacaacagtgcctgagaatcccacggctctggggaagtgagccccgaggcgactcggaccgatg

SEQ ID NO: 259 - DNA, 203 bp, Homo sapiens
  source 1..203: mol_type = other DNA
ggcgcgccagtcctgccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccgcgactcggaccgatg

SEQ ID NO: 260 - DNA, 203 bp, Homo sapiens
  source 1..203: mol_type = other DNA
ggcgcgccagtccttagtcccagagccaggaatcaggggcagccgggcgagtcccagggcaggggtcctccgccgccttgcacctgccctgctgggcggcaccgggtcagtgccctgccccctcctgcgggtcccaactctctctttcccatcgtgcgtcctctggagaagtgcgcgcgtgagctgaccgactcggaccgatg

SEQ ID NO: 261 - DNA, 203 bp, Homo sapiens
  source 1..203: mol_type = other DNA
ggcgcgccagtcctatcgtgcgtcctctggagaagtgcgcgcgtgtaagtgtggcgagtgtggccaagggtgccggaggcagggttcgggagctgacatggacccaaatcctcgggccgccctggagcgccagcagctccgccttcgggagcggcaaaaattcttcgaggacattttacagccagagacgactcggaccgatg

SEQ ID NO: 262 - DNA, 203 bp, Homo sapiens
  source 1..203: mol_type = other DNA
ggcgcgccagtcctccttcactgctcagttaaaggttccagggattccactttgtctggacccatccagctgagtgaacccagggtggtggtgtatctggggagagtgaggagtgggttgtccaaacaccagggaaagagccctttggggcctcagacagcggagtgaagctggaaccatcagggaaccgactcggaccgatg

SEQ ID NO: 263 - DNA, 203 bp, Homo sapiens
  source 1..203: mol_type = other DNA
ggcgcgccagtcctcccttcccaccccgcgtcgctcggcgttagccaaggcccgggcggcgccaccctccgggggcactaggtctggggccgcagtgcccagcacagagcagcgtttatcgggacgaagatgaatggaaagaattggagcaaaaagaggttgattacagcggcctcagggttcaggcacgactcggaccgatg

SEQ ID NO: 264 - DNA, 203 bp, Homo sapiens
  source 1..203: mol_type = other DNA
ggcgcgccagtcctcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagcgactcggaccgatg

SEQ ID NO: 265 - DNA, 203 bp, Homo sapiens
  source 1..203: mol_type = other DNA
ggcgcgccagtcctgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacacccgactcggaccgatg

SEQ ID NO: 266 - DNA, 203 bp, Homo sapiens
  source 1..203: mol_type = other DNA
ggcgcgccagtcctgctccgcaggctgccggctccacccctcagggactggctggcttcgagcagggcatcggaaccaggcctcctggcactggcctgggtagagccagggcgagcaccagctgacccccagtggaaccctgtgacagtcctgccagggcccaggccatcccaaccgacttccatctccgactcggaccgatg

SEQ ID NO: 267 - DNA, 203 bp, Homo sapiens
  source 1..203: mol_type = other DNA
ggcgcgccagtcctgcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggcgactcggaccgatg

SEQ ID NO: 268 - DNA, 203 bp, Homo sapiens
  source 1..203: mol_type = other DNA
ggcgcgccagtcctagttccggtggctggcggaaacgggaacgtgcagccgcgggtgcaggagtcctggggcatggcgggggcggggcagggggaggcgcgcacagaacaggctggggcatccctcgccctggctctttgagcccggaccagacagagatgtgataatggatcatcatgtttctaccacgactcggaccgatg

SEQ ID NO: 269 - DNA, 203 bp, Homo sapiens
  source 1..203: mol_type = other DNA
ggcgcgccagtccttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaacgactcggaccgatg

SEQ ID NO: 270 - DNA, 203 bp, Homo sapiens
  source 1..203: mol_type = other DNA
ggcgcgccagtcctctcaggtgcttgcgaggtgatcagaaggcaaagatgtcggagcgaaaagtattaaacaaatactacccgccggactttgacccatcaaagatccccaaactcaagctccccaaagaccggcagtacgtggtgcggctgatggcccccttcaacatgaggtgtaagacgtgcggacgactcggaccgatg

SEQ ID NO: 271 - DNA, 203 bp, Homo sapiens
  source 1..203: mol_type = other DNA
ggcgcgccagtcctacacaccctgacccgcatcgccctgggtctctcgagcctgctgcctgctcccccgccccaccagccatggtggtttctggagcgcccccagccctgggtgggggctgtctcggcaccttcacctccctgctgctgctggcgtcgacagccatcctcaatgcggccaggatacctcgactcggaccgatg

SEQ ID NO: 272 - DNA, 203 bp, Homo sapiens
  source 1..203: mol_type = other DNA
ggcgcgccagtcctagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgccgactcggaccgatg

SEQ ID NO: 273 - DNA, 203 bp, Homo sapiens
  source 1..203: mol_type = other DNA
ggcgcgccagtcctcacttccctctgtggctctgctcagaactggcggtttttcccagctccttgcccagaccaatacttccatgctgtcttcaagccctgcttcctgcacatctcccagcccagatggggagaacccatgtaagaaggtccactgggcttctgggaggagaaggacatcatccacagcgactcggaccgatg

SEQ ID NO: 274 - DNA, 203 bp, Homo sapiens
  source 1..203: mol_type = other DNA
ggcgcgccagtcctattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccacccgactcggaccgatg

SEQ ID NO: 275 - DNA, 203 bp, Homo sapiens
  source 1..203: mol_type = other DNA
ggcgcgccagtcctgaagccggaagagaccggaccctgaacagaatcgcagattgccagcccttttcccgacccctacggaaagacgagtccaggggccgtcctggcgaggtcaaaacatttagtctggtcttttcagcgtggaccctgccagcagccaggccatggagctctctgatgtcaccctcacgactcggaccgatg

SEQ ID NO: 276 - DNA, 203 bp, Homo sapiens
  source 1..203: mol_type = other DNA
ggcgcgccagtcctcttccgcctgcgcctgcgcaggcccgctccccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcgactcggaccgatg

SEQ ID NO: 277 - DNA, 203 bp, Homo sapiens
  source 1..203: mol_type = other DNA
ggcgcgccagtcctacaccccaagaacgctgtcatttcctgggccaagttgggacccggacggcctcaccatgatgaaacgggcagctgctgctgcagtgggaggagccctggcagtgggggctgtgcccgtggtgctcagtgccatgggcttcactggggcaggaatcgccgcgtcctccatagcagcgactcggaccgatg

SEQ ID NO: 278 - DNA, 203 bp, Homo sapiens
  source 1..203: mol_type = other DNA
ggcgcgccagtcctgggtcacatggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgagaaatgtctttcctccacgactcggaccgatg

SEQ ID NO: 279 - DNA, 203 bp, Homo sapiens
  source 1..203: mol_type = other DNA
ggcgcgccagtcctttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaaggtggatttcagtgtgttctttggcgactcggaccgatg

SEQ ID NO: 280 - DNA, 203 bp, Homo sapiens
  source 1..203: mol_type = other DNA
ggcgcgccagtcctgcggggtcaggggccgagcggagagggtagagacggggtttcaccgtgttagccaagatggtctcgatctcctgacctcgtgatccgcccgcctcggcctcccaaagtgctgggattacaggcgtgagccactgcgcccggcctgttgtacagttattaaagttatcatttaaccgactcggaccgatg

SEQ ID NO: 281 - DNA, 203 bp, Homo sapiens
  source 1..203: mol_type = other DNA
ggcgcgccagtcctgagcccgtcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacgaacaagaaggaaaactctgacgactcggaccgatg

SEQ ID NO: 282 - DNA, 203 bp, Homo sapiens
  source 1..203: mol_type = other DNA
ggcgcgccagtccttggctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgacgactcggaccgatg

SEQ ID NO: 283 - DNA, 203 bp, Homo sapiens
  source 1..203: mol_type = other DNA
ggcgcgccagtcctgtggcgcctgcgggattccgtaccggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggcgactcggaccgatg

SEQ ID NO: 284 - DNA, 203 bp, Homo sapiens
  source 1..203: mol_type = other DNA
ggcgcgccagtcctatgcgccgcccgtggccatcttgtaggcggggacacgccgaggtaacttccagggtgcgccttcgttgtcttctccaagctgtagttctacgtcccgacctccctatcataccacactcttcagcgaccacgcaggcactttcccggtccccagtataccataattgaagaaaacgactcggaccgatg

SEQ ID NO: 285 - DNA, 203 bp, Homo sapiens
  source 1..203: mol_type = other DNA
ggcgcgccagtcctcacactttcagtgccagggcattgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctctcgactcggaccgatg

SEQ ID NO: 286 - DNA, 203 bp, Homo sapiens
  source 1..203: mol_type = other DNA
ggcgcgccagtcctaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggcgactcggaccgatg

SEQ ID NO: 287 - DNA, 203 bp, Homo sapiens
  source 1..203: mol_type = other DNA
ggcgcgccagtcctgtggggctggcggccggcgggagaggcggccggcctggactggcccgagagggatcccggttcccagaacagacctaggaggcggcctcgagggcggacggcagggagggccagcatgccccgactgctgcaccccgccctgccgctgctcctgggcgccacgctgaccttccgcgactcggaccgatg

SEQ ID NO: 288 - DNA, 203 bp, Homo sapiens
  source 1..203: mol_type = other DNA
ggcgcgccagtcctacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggcgactcggaccgatg

SEQ ID NO: 289 - DNA, 203 bp, Homo sapiens
  source 1..203: mol_type = other DNA
ggcgcgccagtcctgggataaacggagctggacgactcagtctcttggtctgtggctgctgcggttacctggatgggcgagcacctctgaggctggctttgttacctgggcaataagggactagcagttcagccgttttctatgcctgctggatttgtttgtatttgttcccagccactgctcatgtacgactcggaccgatg

SEQ ID NO: 290 - DNA, 203 bp, Homo sapiens
  source 1..203: mol_type = other DNA
ggcgcgccagtcctctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacacgactcggaccgatg

SEQ ID NO: 291 - DNA, 203 bp, Homo sapiens
  source 1..203: mol_type = other DNA
ggcgcgccagtcctctcgctacgcaatgccaacccgaggctgaagaactacttcaaggagaactacattcctcaggtctgcgaggcactgttatgtggtatacttgttacatgtcctgaggatccgctgaggtatttagagggaatgatcatggttataatcaaaagtggtcttcagaatcttctttgcgactcggaccgatg

SEQ ID NO: 292 - DNA, 203 bp, Homo sapiens
  source 1..203: mol_type = other DNA
ggcgcgccagtcctgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttacgactcggaccgatg

SEQ ID NO: 293 - DNA, 203 bp, Homo sapiens
  source 1..203: mol_type = other DNA
ggcgcgccagtcctgctcggtctctcggtgctcgctccatcgggtctggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtcccgactcggaccgatg

SEQ ID NO: 294 - DNA, 203 bp, Homo sapiens
  source 1..203: mol_type = other DNA
ggcgcgccagtcctgccgccggatggcgtaggatcggccgctggtggtggtgataccgggtacccgggctatggcgccggcgcagcgctgccctctgtgccgccagaccttcttctgtggtcgcgggcacgtttacagccgcaagcaccagcggcagctgaaggaggctttggagaggctcctgcccccgactcggaccgatg

SEQ ID NO: 295 - DNA, 203 bp, Homo sapiens
  source 1..203: mol_type = other DNA
ggcgcgccagtcctatggtcgatgatgctggtgccgctgagtcccagcggggcaaacagactccggcccactccctggagcagctgcgtaggttaccacttccgccgccacagattcgcatccggccctggtggtttccggtgcaggaactgagagaccctttggtgttctacctagaggcatggctgcgactcggaccgatg

SEQ ID NO: 296 - DNA, 203 bp, Homo sapiens
  source 1..203: mol_type = other DNA
ggcgcgccagtcctaccatagtctgtgtccgcgttcttttttccgggactgcagagttcggggaagctgtacgccgcctttcgctacgcggaatttgcagatcttcccctggacctcaggcctctccggctggagtagggtggacgcttcacataagcttctctggtcgaacttacccgaatctccagcgactcggaccgatg

SEQ ID NO: 297 - DNA, 203 bp, Homo sapiens
  source 1..203: mol_type = other DNA
ggcgcgccagtcctgtcgggttaccagcgcgggggctacagttagcctcgagaacctttgctttcagccggactccggactcctccggggacagcgcagcgcccgccagagccctcggcgctccctcccgctggcggcttccgcagccttcaaggatggcgctggcggctttgatgatcgccctcggccgactcggaccgatg

SEQ ID NO: 298 - DNA, 203 bp, Homo sapiens
  source 1..203: mol_type = other DNA
ggcgcgccagtcctgggggtccgcgggcgacactctcgggctcgcgcacctccccaagatggcggcgcccgaggcctcgcgcgcccggagttgctggttctgtgaggtagcggcggcaacgaccatggaggccacgtcccgggaggcggcgccagcgaagagctcggcctcgggccccaacgctcccccgactcggaccgatg

SEQ ID NO: 299 - DNA, 203 bp, Homo sapiens
  source 1..203: mol_type = other DNA
ggcgcgccagtccttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggcgactcggaccgatg

SEQ ID NO: 300 - DNA, 203 bp, Homo sapiens
  source 1..203: mol_type = other DNA
ggcgcgccagtccttttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagcccgactcggaccgatg

SEQ ID NO: 301 - DNA, 203 bp, Homo sapiens
  source 1..203: mol_type = other DNA
ggcgcgccagtcctcccgcgcgctgcccttcgcttgaggcaaaaggactcttgtggaagatggaactcattgtccattttccagaatgtatttccaagcccatcaatgggacctgatactgctgttctgtgttgaaatgcttgaagaactcctgcatctctgcttgcatcttccatcctactgaaacccgactcggaccgatg

SEQ ID NO: 302 - DNA, 203 bp, Homo sapiens
  source 1..203: mol_type = other DNA
ggcgcgccagtcctcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagcgactcggaccgatg

SEQ ID NO: 303 - DNA, 203 bp, Homo sapiens
  source 1..203: mol_type = other DNA
ggcgcgccagtcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtccgactcggaccgatg

SEQ ID NO: 304 - DNA, 203 bp, Homo sapiens
  source 1..203: mol_type = other DNA
ggcgcgccagtcctctccgctccaatcccggaagtgcgcgcggccccgcccccgccggttcgcgtctctctgctgcggcgcggggaccgctgtgctctcggaaacggggtctctgggggatccagtgacgtgcccaaccacagagaccagacccctcctcctgtagagagtggtgctgccctctcgggcgactcggaccgatg

SEQ ID NO: 305 - DNA, 203 bp, Homo sapiens
  source 1..203: mol_type = other DNA
ggcgcgccagtcctccaatcccggaagcgcgcgcggccccgcccccgaaagtcggctcggctccgctccaatcccggaagtgcgcgcggccccgcccccgccggttcgcgtctctctgctgcggcgcggggaccgctgtgctctcgacccctcctcctgtagagagtggtgctgccctctcgggatgtcgactcggaccgatg

SEQ ID NO: 306 - DNA, 203 bp, Homo sapiens
  source 1..203: mol_type = other DNA
ggcgcgccagtcctgcgctgaggagagttcgccgccgtcgccgcccgtgaggatctgagagccatgtcggccagcagcctcttggagcagtacaaaatggatctgtacatcaaaaggatggattaaacgatgatgattttgaaccttacttgagtccacaggcaaggcccaataatgcatatactgcccgactcggaccgatg

SEQ ID NO: 307 - DNA, 203 bp, Homo sapiens
  source 1..203: mol_type = other DNA
ggcgcgccagtccttgccgttatcgcccggctagtcagtcgtccaactcaccacagagaagtccggatcgtggtagagcgccgcgtcgcacccatgtgacgtcacggcggcgccactcgcttgaggctttccccgcccaccccagcccgttctctctttccggacctggccgagcaggaggcgccatccgactcggaccgatg

SEQ ID NO: 308 - DNA, 203 bp, Homo sapiens
  source 1..203: mol_type = other DNA
ggcgcgccagtcctgctcacccctggatatacttctttgtcaagagaagcagaggtgtggacgctgtgtatgaaatgtctttcctccaggacccaagtttcttcaccatggggatgtggtccattggtgcaggagccctgggggctgctgccttggcattgctgcttgccaacacagacgtgtttctgcgactcggaccgatg

SEQ ID NO: 309 - DNA, 203 bp, Homo sapiens
  source 1..203: mol_type = other DNA
ggcgcgccagtccttgcccagactggtcttgaactcctgggctcaagcgatcctcccaaagccctgagattacaggcgtgagccagcgcgccggacacaacctcctactttcatgaaagagtgggcacttccaacaggaggaaaatgtctttcctccaggacccaagtttcttcaccatggggatgtgcgactcggaccgatg

SEQ ID NO: 310 - DNA, 203 bp, Homo sapiens
  source 1..203: mol_type = other DNA
ggcgcgccagtccttggtggcagcaggtgcttagcagcccttgtccagtctcgcctgtgacactgctgctcccttcccctgtcctgacctcctggttggctgtcctgccagagccttgcctggaagatgaaattccagctaccctgtgggagcagtaacgccttcttccttcttctcaatctccagaacgactcggaccgatg

SEQ ID NO: 311 - DNA, 203 bp, Homo sapiens
  source 1..203: mol_type = other DNA
ggcgcgccagtcctaaagtctatacgcaataagtaagcccaaagaggcatgtttgcttggcgatgcccagcagataagccaggcaaacctcggtgtgatcgaagaagccaatttgagactcagcctagtccaggcaagctactggcacctgctgctctcaactaacctccacacaatggtgttcgcatcgactcggaccgatg

SEQ ID NO: 312 - DNA, 203 bp, Homo sapiens
  source 1..203: mol_type = other DNA
ggcgcgccagtcctgtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaacgactcggaccgatg

SEQ ID NO: 313 - DNA, 203 bp, Homo sapiens
  source 1..203: mol_type = other DNA
ggcgcgccagtcctaccgagtccttggctgcctgtggagctcctgtgccagcagctgcgccccggctgcgctccggatacccccatccccgccaccgccgacctcccgctccaccgactgctgctcacgcccgacgggttcacgccgcccctgccccgtgaaggaccgcgctgcggtgcggaggcaggcgactcggaccgatg

SEQ ID NO: 314 - DNA, 203 bp, Homo sapiens
  source 1..203: mol_type = other DNA
ggcgcgccagtccttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggaggccaggcaggcgactcggaccgatg

SEQ ID NO: 315 - DNA, 203 bp, Homo sapiens
  source 1..203: mol_type = other DNA
ggcgcgccagtccttcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgcccgactcggaccgatg

SEQ ID NO: 316 - DNA, 203 bp, Homo sapiens
  source 1..203: mol_type = other DNA
ggcgcgccagtcctgcgtgctgtgggcggtgccgcgcggacccccgggaagtgtctctgtgggcggccgccgggttgagctgcggcacacgtgcgacggccgtgatgaagttcgcttaccggttttcaaatttgctgggtacggtgtaccggcgtgggaacctaaattttacctgcgatggaaattcacgactcggaccgatg

SEQ ID NO: 317 - DNA, 203 bp, Homo sapiens
  source 1..203: mol_type = other DNA
ggcgcgccagtcctaatcagagctggttccgcgccgcggccgccgcgacaggtgcagcagagccgagccggccgcgctccgaacggcgcctcccgccccaccatgggcaacagcgcgagccgcagcgacttcgagtgggtctacaccgaccagccgcacacgcagcggcgcaaggagatactggccaacgactcggaccgatg

SEQ ID NO: 318 - DNA, 203 bp, Homo sapiens
  source 1..203: mol_type = other DNA
ggcgcgccagtcctgcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcacgactcggaccgatg

SEQ ID NO: 319 - DNA, 203 bp, Homo sapiens
  source 1..203: mol_type = other DNA
ggcgcgccagtcctggggcggggctgggctcccggggtaggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgcgactcggaccgatg

SEQ ID NO: 320 - DNA, 203 bp, Homo sapiens
  source 1..203: mol_type = other DNA
ggcgcgccagtcctttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaacgactcggaccgatg

SEQ ID NO: 321 - DNA, 203 bp, Homo sapiens
  source 1..203: mol_type = other DNA
ggcgcgccagtcctcgcgcaagtactgtcaaggacagttttcgggacgggggacgcggctccaggcacccaacagcactgacggcgaacacttcacgggcgcgcgatgcctcgacaaggcggccgccaccaccacctcagctgccctcgcgggcagcacggcgcggcaaaagcgcacgtcgcctagcgcgactcggaccgatg

SEQ ID NO: 322 - DNA, 203 bp, Homo sapiens
  source 1..203: mol_type = other DNA
ggcgcgccagtccttgtcctggggtcgcggagacccgcgcgcctgccctgcacgccgggcggcaacctttgcagtcgcgttggctgctgcgatcggccggcgggtccctgccgaaggctcggctgcttctgtccacctcttacacttcttcatttatcggtggatcatttcgagagtccgtcttgtaacgactcggaccgatg

SEQ ID NO: 323 - DNA, 203 bp, Homo sapiens
  source 1..203: mol_type = other DNA
ggcgcgccagtcctggccgcctccttgaggtagtatccgcacatggaattctagggccgcaggtgtatttacggtaactgtcgccactagatttcagcgcctttggactctcctgttttcactttcttttgttgactcccgtgtggccctcgtgggagcctgttttggctgcagcggtgtctggggtgcgactcggaccgatg

SEQ ID NO: 324 - DNA, 203 bp, Homo sapiens
  source 1..203: mol_type = other DNA
ggcgcgccagtcctcagccgcgtctgggccaggagaaaaggtacaggaagaaggaatggaatcggaaggaagaaaattcattccagagacaaaatagctcccctcctctgttgtagctgttcctctggcaatacaaactttctgctttcaggttctgcagcattccagaccttgagcactgaatcaggcgactcggaccgatg

SEQ ID NO: 325 - DNA, 203 bp, Homo sapiens
  source 1..203: mol_type = other DNA
ggcgcgccagtcctggcatagcaagatggcctgccctcaggtacaggaagaaggaatggaatcggaaggaagaaaattcattccagagacaaaatagctcccctcctctgttgtagctgttcctctggcaatacaaactttctgctttcaggttctgcagcattccagaccttgagcactgaatcaggcgactcggaccgatg

SEQ ID NO: 326 - DNA, 203 bp, Homo sapiens
  source 1..203: mol_type = other DNA
ggcgcgccagtcctcaacaggctccttactcaagctcgggttcttctcctaggcggaagccagaccagagagcgtgcgtgtttttcccagggtgccccgcgctgctgttatggccgcctccttgagagagtggatctttcctacaattgctgctggaagggaactatgaagccatattcttaaattcacgactcggaccgatg

SEQ ID NO: 327 - DNA, 203 bp, Homo sapiens
  source 1..203: mol_type = other DNA
ggcgcgccagtccttcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagccgactcggaccgatg

SEQ ID NO: 328 - DNA, 203 bp, Homo sapiens
  source 1..203: mol_type = other DNA
ggcgcgccagtccttccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatccgactcggaccgatg

SEQ ID NO: 329 - DNA, 203 bp, Homo sapiens
  source 1..203: mol_type = other DNA
ggcgcgccagtcctagaaggctatttccgtttccgtacggaagcaaaggagccaagaccatggcgaaagccggggataagagcagcagcagcgggaagaaaagtctaaaacggaaagccgctgccgaagaacttcaggaggctgcaggcgctggggatggggcgacggaaaacggggtccaacccccgcgactcggaccgatg

SEQ ID NO: 330 - DNA, 203 bp, Homo sapiens
  source 1..203: mol_type = other DNA
ggcgcgccagtcctatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacaccgactcggaccgatg

SEQ ID NO: 331 - DNA, 203 bp, Homo sapiens
  source 1..203: mol_type = other DNA
ggcgcgccagtcctccccggcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagaggcacacagccgactcggaccgatg

SEQ ID NO: 332 - DNA, 203 bp, Homo sapiens
  source 1..203: mol_type = other DNA
ggcgcgccagtcctgggaactacttccgggggagcggcgcggcggcgcgggagttggttctaaagagtggtgagtcagaagagacgtcaggcagcaagcgacttgggccatggcctctgacctagacttctcacctccggaggtgcccgagcccactttcctggagaacctgctacggtacggactctcgactcggaccgatg

SEQ ID NO: 333 - DNA, 203 bp, Homo sapiens
  source 1..203: mol_type = other DNA
ggcgcgccagtcctgattcctgtgcaaagagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcacccgactcggaccgatg

SEQ ID NO: 334 - DNA, 203 bp, Homo sapiens
  source 1..203: mol_type = other DNA
ggcgcgccagtcctattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggccgactcggaccgatg

SEQ ID NO: 335 - DNA, 203 bp, Homo sapiens
  source 1..203: mol_type = other DNA
ggcgcgccagtcctcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgcccgactcggaccgatg

SEQ ID NO: 336 - DNA, 203 bp, Homo sapiens
  source 1..203: mol_type = other DNA
ggcgcgccagtcctggggcaggcccgctttctgtcaaaatggcagcgcccagcgtgcgcgggtatctctgaagttggggtttaagattcttgcccgtgagagcgaacgagcctgccgtacttctgattttgaaacacctgggtctgggcttcccgggcgagcggtggaacctgtgagaagtttctacacgactcggaccgatg

SEQ ID NO: 337 - DNA, 203 bp, Homo sapiens
  source 1..203: mol_type = other DNA
ggcgcgccagtcctatctttaggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaagggacagaagatgagcctgtcggtcgactcggaccgatg

SEQ ID NO: 338 - DNA, 203 bp, Homo sapiens
  source 1..203: mol_type = other DNA
ggcgcgccagtcctccaagatgcaccggggagtaggtccggcctttcgggtggtcaggaagatggcggcctctggggcggagccgcaggtcctggtacaatacttggtgttacgaaaggatctatcacaagctccgttctcctggccggcgggcgcactggtagcgcaggcttgtcacgcggccaccgcgactcggaccgatg

SEQ ID NO: 339 - DNA, 203 bp, Homo sapiens
  source 1..203: mol_type = other DNA
ggcgcgccagtccttccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctcgactcggaccgatg

SEQ ID NO: 340 - DNA, 203 bp, Homo sapiens
  source 1..203: mol_type = other DNA
ggcgcgccagtcctccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaagttgaaaattgagaaaacccgactcggaccgatg

SEQ ID NO: 341 - DNA, 203 bp, Homo sapiens
  source 1..203: mol_type = other DNA
ggcgcgccagtcctacggctcagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacacccgactcggaccgatg

SEQ ID NO: 342 - DNA, 203 bp, Homo sapiens
  source 1..203: mol_type = other DNA
ggcgcgccagtcctttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagcgactcggaccgatg

SEQ ID NO: 343 - DNA, 203 bp, Homo sapiens
  source 1..203: mol_type = other DNA
ggcgcgccagtcctgcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcacgactcggaccgatg

SEQ ID NO: 344 - DNA, 203 bp, Homo sapiens
  source 1..203: mol_type = other DNA
ggcgcgccagtcctgagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatcgactcggaccgatg

SEQ ID NO: 345 - DNA, 203 bp, Homo sapiens
  source 1..203: mol_type = other DNA
ggcgcgccagtcctcaggcctccatctccaggtccctctccgaggcttcctcgctgccagctgagtcgtgggcacctgagggactacctaccactgctcccggctgtgccatcgccaccagctcccagcctcctgctcagacccgggacagcccctccatggcccccgagatggaccagttttacaggcgactcggaccgatg

SEQ ID NO: 346 - DNA, 203 bp, Homo sapiens
  source 1..203: mol_type = other DNA
ggcgcgccagtcctagactatgatgaattcgaatgggacacatttgcttctgtggagttacgattcaaactgaatgtccaatataggaaggcaacatatacaacaagcaaaagtgattttagaaataacagaacgcgggagaaaattcacacacggaaaatgatacggataacaaaagcagattcacacgactcggaccgatg

SEQ ID NO: 347 - DNA, 203 bp, Homo sapiens
  source 1..203: mol_type = other DNA
ggcgcgccagtcctccaaggaattgaaagggctgtagggggaggcagtgcgagccagccccgactgctcctcctcttcctcctcctcctccaaactcgcgagccccagagctcgctcagccgccgggagcacccagagggacgggaggcagccgcgcagccccgagctgggcagtgtccccagccgcccgactcggaccgatg

SEQ ID NO: 348 - DNA, 203 bp, Homo sapiens
  source 1..203: mol_type = other DNA
ggcgcgccagtcctagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgaccgactcggaccgatg

SEQ ID NO: 349 - DNA, 203 bp, Homo sapiens
  source 1..203: mol_type = other DNA
ggcgcgccagtcctgaggagcctgaggaagagggcggcgacggtggtggtgactgagcggagcccggtgacaggatggctgggcacagattggtgttggtattaggagatctgcacatcccacaccggtgcaacagtttgccagctaaattcaaaaaactcctggtgccaggaaaaattcagcacattcgactcggaccgatg

SEQ ID NO: 350 - DNA, 203 bp, Homo sapiens
  source 1..203: mol_type = other DNA
ggcgcgccagtcctgacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcaggcgactcggaccgatg

SEQ ID NO: 351 - DNA, 203 bp, Homo sapiens
  source 1..203: mol_type = other DNA
ggcgcgccagtcctcggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagcccgactcggaccgatg

SEQ ID NO: 352 - DNA, 203 bp, Homo sapiens
  source 1..203: mol_type = other DNA
ggcgcgccagtcctcgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggatgaaattgattctgcagtaaagcgactcggaccgatg

SEQ ID NO: 353 - DNA, 203 bp, Homo sapiens
  source 1..203: mol_type = other DNA
ggcgcgccagtcctaatgcgcacgccgtgggcgggccccgagccggaattgggggtgaagcgatagcgttttgcccgcattcggggcgcgcggagctggggggtccctgtggggctcccggagttaagatggcgtcctcagcggagggggacgaggggactgtggtggcgctggcgggggttctgcagcgactcggaccgatg

SEQ ID NO: 354 - DNA, 203 bp, Homo sapiens
  source 1..203: mol_type = other DNA
ggcgcgccagtccttcgctttgtgattcttgatccggaacttgtcacccaggaaccccggaagaggtagctcacgcgatagaaacgtgttcgctgcccagaagaagggaaggcgcgagtgaggaaaggaggtactgtagatgccctccaaatccttggttatggaatatttggctcatcccagtacaccgactcggaccgatg

SEQ ID NO: 355 - DNA, 203 bp, Homo sapiens
  source 1..203: mol_type = other DNA
ggcgcgccagtcctcgtcacttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaaccgactcggaccgatg

SEQ ID NO: 356 - DNA, 203 bp, Homo sapiens
  source 1..203: mol_type = other DNA
ggcgcgccagtcctccaatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtccccgactcggaccgatg

SEQ ID NO: 357 - DNA, 203 bp, Homo sapiens
  source 1..203: mol_type = other DNA
ggcgcgccagtcctagccgccacgccccgggagaggaccgaccgcccagaccgccggtcccggggccccctgggccacgccgatcacggggagcccctcgactgcctcccagaacaaagtgggaaagggaagcttagcccgccgctgccgcctccgagcagcccgccaggactctggctactggagatcgactcggaccgatg

SEQ ID NO: 358 - DNA, 203 bp, Homo sapiens
  source 1..203: mol_type = other DNA
ggcgcgccagtcctctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactcgactcggaccgatg

SEQ ID NO: 359 - DNA, 203 bp, Homo sapiens
  source 1..203: mol_type = other DNA
ggcgcgccagtcctgtgctgccctaggctgcatgagtcgaagcaagcgtgtttccttcccgccaggcaagtgcccttagaaaccgggccccgcccccttcctggcctgcattcccatcccctctcccggggcggaggtgaggacctccttggttcctttggttctgtcagtgagccccttccttggcccgactcggaccgatg

SEQ ID NO: 360 - DNA, 203 bp, Homo sapiens
  source 1..203: mol_type = other DNA
ggcgcgccagtcctgtggccggcatgtcgggggcggggggcgcctttgcctcgccgagggaggtcttgctggagcggccgtgctggctggacgggggctgcgagccggcccgcaggggctacctctaccagcagctgtgctgcgtagatgagcgggatcgtgtgcagaagaaaaccttcaccaagtggcgactcggaccgatg

SEQ ID NO: 361 - DNA, 203 bp, Homo sapiens
  source 1..203: mol_type = other DNA
ggcgcgccagtccttgagctgagcctgtgccgagtgagcgtctcgtggggccgccagccttcagctgcctgtgtgccacacggggctgcccagagcaccgtgcctgaggccgagggtccgggcgacgaaggtgtgggggcagcatgtctcagcaccagctccgcgtgccgcagcccgagggcctgggccgactcggaccgatg

SEQ ID NO: 362 - DNA, 203 bp, Homo sapiens
  source 1..203: mol_type = other DNA
ggcgcgccagtcctggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggacgactcggaccgatg

SEQ ID NO: 363 - DNA, 203 bp, Homo sapiens
  source 1..203: mol_type = other DNA
ggcgcgccagtcctccagccatgggctcggggcgcgtacccgggctctgcctgcttgtcctgctggtccacgcccgcgccgcccagtacagcaaagccgcgcaagatgtggatgagtgtgtggaggggactgacaactgccacatcgatgctatctgccagaacaccccgaggtcatacaagtgcatccgactcggaccgatg

SEQ ID NO: 364 - DNA, 203 bp, Homo sapiens
  source 1..203: mol_type = other DNA
ggcgcgccagtcctcaggccacaggagtaaaatctctctgcccgtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagccgactcggaccgatg

SEQ ID NO: 365 - DNA, 203 bp, Homo sapiens
  source 1..203: mol_type = other DNA
ggcgcgccagtcctggggctttcagtagaaacaagcaaaccgcaggtccctgtggggggactctccaggaagaagggtaatttcctgcctccttaaattggctgctactgtcagttattttgctcccaaccccagagcttcacttgctccttcacttcccagttccgcaagaaccgtgggcgacagttcgactcggaccgatg

SEQ ID NO: 366 - DNA, 203 bp, Homo sapiens
  source 1..203: mol_type = other DNA
ggcgcgccagtcctcgccgctctgggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagcccgactcggaccgatg

SEQ ID NO: 367 - DNA, 203 bp, Homo sapiens
  source 1..203: mol_type = other DNA
ggcgcgccagtcctatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcggcgactcggaccgatg

SEQ ID NO: 368 - DNA, 203 bp, Homo sapiens
  source 1..203: mol_type = other DNA
ggcgcgccagtcctgcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagccgactcggaccgatg

SEQ ID NO: 369 - DNA, 203 bp, Homo sapiens
  source 1..203: mol_type = other DNA
ggcgcgccagtccttgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgcgactcggaccgatg

SEQ ID NO: 370 - DNA, 203 bp, Homo sapiens
  source 1..203: mol_type = other DNA
ggcgcgccagtcctacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgagaatcagccgactcggaccgatg

SEQ ID NO: 371 - DNA, 203 bp, Homo sapiens
  source 1..203: mol_type = other DNA
ggcgcgccagtcctgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccggaatcagccgactcggaccgatg

SEQ ID NO: 372 - DNA, 203 bp, Homo sapiens
  source 1..203: mol_type = other DNA
ggcgcgccagtcctgctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaaccgactcggaccgatg

SEQ ID NO: 373 - DNA, 203 bp, Homo sapiens
  source 1..203: mol_type = other DNA
ggcgcgccagtcctctcttacaacattggctgccggcgtgactttgaccgcttcccggtgcgttaccggcagctgaacccacccggcgccacgggactttgacgcgtgctctgcgcttgccatgagactcctgggagctgcagccgtcgcggctctggggcgcggaagggcccccgcctccctaggctcgactcggaccgatg

SEQ ID NO: 374 - DNA, 203 bp, Homo sapiens
  source 1..203: mol_type = other DNA
ggcgcgccagtcctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagcgactcggaccgatg

SEQ ID NO: 375 - DNA, 203 bp, Homo sapiens
  source 1..203: mol_type = other DNA
ggcgcgccagtcctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctggatgagcgactcggaccgatg

SEQ ID NO: 376 - DNA, 203 bp, Homo sapiens
  source 1..203: mol_type = other DNA
ggcgcgccagtccttgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttcgactcggaccgatg

SEQ ID NO: 377 - DNA, 203 bp, Homo sapiens
  source 1..203: mol_type = other DNA
ggcgcgccagtcctatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccacgactcggaccgatg

SEQ ID NO: 378 - DNA, 203 bp, Homo sapiens
  source 1..203: mol_type = other DNA
ggcgcgccagtcctcggggcgccgagacagggcgtgttcgctgttcagtgccggtgttgcagggagtgagggcagctggagtgcgttctgccgaagcttgtggttgcacgcccatcgtcttaggggctaccttccgtgttaccttatcccatatcacacaactggtcctcagccataacaagctaacacgactcggaccgatg

SEQ ID NO: 379 - DNA, 203 bp, Homo sapiens
  source 1..203: mol_type = other DNA
ggcgcgccagtcctgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggcgactcggaccgatg

SEQ ID NO: 380 - DNA, 203 bp, Homo sapiens
  source 1..203: mol_type = other DNA
ggcgcgccagtcctagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggcgactcggaccgatg

SEQ ID NO: 381 - DNA, 203 bp, Homo sapiens
  source 1..203: mol_type = other DNA
ggcgcgccagtcctaactactcctctcctcctcctcctcctcttcctcctcctcctccccaccaccaccatctccatcacccaccaacaacaccacaataatccacagccaaggccacttggtcattctggcattttatggtagagaatacgttgagtttggctctggaaggaatatgagagaccatccgactcggaccgatg

SEQ ID NO: 382 - DNA, 203 bp, Homo sapiens
  source 1..203: mol_type = other DNA
ggcgcgccagtcctggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacacgactcggaccgatg

SEQ ID NO: 383 - DNA, 203 bp, Homo sapiens
  source 1..203: mol_type = other DNA
ggcgcgccagtcctcatccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggcgactcggaccgatg

SEQ ID NO: 384 - DNA, 203 bp, Homo sapiens
  source 1..203: mol_type = other DNA
ggcgcgccagtcctccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaagcagatcgtgacaagagcgactcggaccgatg

SEQ ID NO: 385 - DNA, 203 bp, Homo sapiens
  source 1..203: mol_type = other DNA
ggcgcgccagtcctgtgctcgtggggagctggccgagtggaaaacgtccacattgacccaaccgcagtgaagggagagcgcctccagtggtgtggtgcgtggagaaatgggaaggagagagttctgatgagaccctttttgctcttcctgctgcatctgagcctgtgatacgctcctctgcagaaaatcgactcggaccgatg

SEQ ID NO: 386 - DNA, 203 bp, Homo sapiens
  source 1..203: mol_type = other DNA
ggcgcgccagtcctaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagcccgactcggaccgatg

SEQ ID NO: 387 - DNA, 203 bp, Homo sapiens
  source 1..203: mol_type = other DNA
ggcgcgccagtcctgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactcgactcggaccgatg

SEQ ID NO: 388 - DNA, 203 bp, Homo sapiens
  source 1..203: mol_type = other DNA
ggcgcgccagtcctgtctttaaagggcaattgtcgacactctgcaaacataccgatttgttgtctgcccactttggagtcttcaatctgggcagtaactatttaccctttttcctgctagcctgtccccctctctggattgaagtcacctgctaagacaatggactaccgaccagactcccggaaatccgactcggaccgatg

SEQ ID NO: 389 - DNA, 203 bp, Homo sapiens
  source 1..203: mol_type = other DNA
ggcgcgccagtcctttagccagccacgaagttctcgcgagagtcgtctcctcgataccaagcgcctgtgtctggcagagctggtgtgagacgagacaatcctgccccgccgccgggataatcaagagttttggccggacctttgagcatacaccgagagagtgaggagccagacgacaagcacacactcgactcggaccgatg

SEQ ID NO: 390 - DNA, 203 bp, Homo sapiens
  source 1..203: mol_type = other DNA
ggcgcgccagtcctcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggacgactcggaccgatg

SEQ ID NO: 391 - DNA, 203 bp, Homo sapiens
  source 1..203: mol_type = other DNA
ggcgcgccagtcctcactcagggcaagggtgtccgacggctggagcgttctgttttgaacccaaagtggatgatgctgtcagagctgaactactgaaaggaggctgtgaaaatttcccatcttctcattggccatcagttgagataagatggaagactcttacaaggataggacttcactgatgaaggcgactcggaccgatg

SEQ ID NO: 392 - DNA, 203 bp, Homo sapiens
  source 1..203: mol_type = other DNA
ggcgcgccagtcctgtctgacttgagtccctgctgctgcagtgcacgccccttcggcagccagggtggggcccagacccaacctggcccctcctgcccccaccccgcctttgggtcgctgacccccaggctgtggtgagggtctgagagctggtaccacggagcctgggcaacctcctccgcccaccccgactcggaccgatg

SEQ ID NO: 393 - DNA, 203 bp, Homo sapiens
  source 1..203: mol_type = other DNA
ggcgcgccagtcctaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaaccgactcggaccgatg

SEQ ID NO: 394 - DNA, 203 bp, Homo sapiens
  source 1..203: mol_type = other DNA
ggcgcgccagtcctgaaaagcggccagggtggcccctagctttccttttccggttgcggcgccgcgcggtgaggttgtctagtccacgctcggagccatgccgtccaagggcccgctgcagtctgtgcaggtcttcggacgcaagaagacagcgacagctgtggcgcactgcaaacgcggcaatggtccgactcggaccgatg

SEQ ID NO: 395 - DNA, 203 bp, Homo sapiens
  source 1..203: mol_type = other DNA
ggcgcgccagtcctgggggcaacggtcacctgatctgcggctgtcgaggccgctgaggcagtggaggctgaggctatgatggcggccatggcgacggctcgagtgcggatggggccgcgatgcgcccaggcgctctggcgcatgccgtggctgccggtgtttttgtcgttggcggcggcggcggcggccgactcggaccgatg

SEQ ID NO: 396 - DNA, 203 bp, Homo sapiens
  source 1..203: mol_type = other DNA
ggcgcgccagtccttgtcgtaagattttttcttttcattttctccagggagggtaaatcaatataacctcttctctagagaggaggtggttaggttggtcttaagcagtgttagaagatctattttttttcaaaccaggtgtctgagctgggtgaattccagcctggggagaggactttgatcaccagcgactcggaccgatg

SEQ ID NO: 397 - DNA, 203 bp, Homo sapiens
  source 1..203: mol_type = other DNA
ggcgcgccagtcctgcaactcttttaccatccctttgtatttttgcagttcctccctataccagcttccttacagctgttctgatttcctgtcgtgtctgagctgggtgaattccagcctggggagaggactttgatcaccagatgtttttttggtgtgcgtgctgtcttatggttgcgtggcgagttcgactcggaccgatg

SEQ ID NO: 398 - DNA, 203 bp, Homo sapiens
  source 1..203: mol_type = other DNA
ggcgcgccagtcctatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggcccccgactcggaccgatg

SEQ ID NO: 399 - DNA, 203 bp, Homo sapiens
  source 1..203: mol_type = other DNA
ggcgcgccagtcctgaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagcgactcggaccgatg

SEQ ID NO: 400 - DNA, 203 bp, Homo sapiens
  source 1..203: mol_type = other DNA
ggcgcgccagtcctattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtacgactcggaccgatg

SEQ ID NO: 401 - DNA, 203 bp, Homo sapiens
  source 1..203: mol_type = other DNA
ggcgcgccagtcctcaggaactgggccagctccggtcccttccttttggggctctcactctggaggatggggtggatgggagaaaaaaccgggaagatcctgacggagttcctccagttctatgaagaccagtatggcgtggctctcttcaacagcatgcgccatgagattgagggcacggggctgcccgactcggaccgatg

SEQ ID NO: 402 - DNA, 203 bp, Homo sapiens
  source 1..203: mol_type = other DNA
ggcgcgccagtcctacgaggctagatggcttcacaagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgccgactcggaccgatg

SEQ ID NO: 403 - DNA, 203 bp, Homo sapiens
  source 1..203: mol_type = other DNA
ggcgcgccagtcctggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttgcgactcggaccgatg

SEQ ID NO: 404 - DNA, 203 bp, Homo sapiens
  source 1..203: mol_type = other DNA
ggcgcgccagtcctgggcttgggcgccagaggcggagtcggggaggaggtggctccagagatggcagtgagcgagaggagggggctcggccgcgggagccccgcggagtgggggcagcggctacttctggtgctgctgctgggtggctgctccgggcgcatccaccagctggcgctgacgggggagaacgactcggaccgatg

SEQ ID NO: 405 - DNA, 203 bp, Homo sapiens
  source 1..203: mol_type = other DNA
ggcgcgccagtcctgagtaggatggagtctccctcccgagctgggggtgtgggcctaggaaaggctgcttcgccgctgtgttcggagagctctggatactgcggggcttttccgcggaggagcgcccgccggcatctgcatctgggaccgacctcctgggctggctgatcaaagaggaagcagcagcacgactcggaccgatg

SEQ ID NO: 406 - DNA, 203 bp, Homo sapiens
  source 1..203: mol_type = other DNA
ggcgcgccagtcctacaaagcccagcccagcggaaggaacggtttcggagttgtttttctttgatacgggagttcctccttgctctcgcccctactctttctggtgttagatcgagctaccctctaaaagcagtttagagtggtaaaaaaaaaaaaaaacacaccaaacgctcgcagccacaaaagggcgactcggaccgatg

SEQ ID NO: 407 - DNA, 203 bp, Homo sapiens
  source 1..203: mol_type = other DNA
ggcgcgccagtcctctctgggctgctcgggcgccaccactactgtccccatcccgccccgccagctgggccaaagggtgacttgactcacgacgctgccaccagcccacggcttgcccgaggcgtataaaggctgccagggccgcaggctgccaagccctgccctgcccaaggcgcatagagcatggccgactcggaccgatg

SEQ ID NO: 408 - DNA, 203 bp, Homo sapiens
  source 1..203: mol_type = other DNA
ggcgcgccagtcctagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactcgactcggaccgatg

SEQ ID NO: 409 - DNA, 203 bp, Homo sapiens
  source 1..203: mol_type = other DNA
ggcgcgccagtccttccagagccaagcgccccgcccctgcccgggcgcgctccctccttagccctgcccctctctgaccccacctccgacgcaagagtggggcggggcagctgccggtggcgtcccgaacccagactcgccccgccccagagactgcgcctgcgcgggcacgagacaacctctccgcgcgactcggaccgatg

SEQ ID NO: 410 - DNA, 203 bp, Homo sapiens
  source 1..203: mol_type = other DNA
ggcgcgccagtcctgcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagacgactcggaccgatg

SEQ ID NO: 411 - DNA, 203 bp, Homo sapiens
  source 1..203: mol_type = other DNA
ggcgcgccagtcctgtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagacgactcggaccgatg

SEQ ID NO: 412 - DNA, 203 bp, Homo sapiens
  source 1..203: mol_type = other DNA
ggcgcgccagtcctgagtcacgtgggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctcgactcggaccgatg

SEQ ID NO: 413 - DNA, 203 bp, Homo sapiens
  source 1..203: mol_type = other DNA
ggcgcgccagtcctacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagcgactcggaccgatg

SEQ ID NO: 414 - DNA, 203 bp, Homo sapiens
  source 1..203: mol_type = other DNA
ggcgcgccagtcctcgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggcccgactcggaccgatg

SEQ ID NO: 415 - DNA, 203 bp, Homo sapiens
  source 1..203: mol_type = other DNA
ggcgcgccagtcctgacatttcttaacagcagggccaccaggcagagcgggacagccaggaggaagggcagcttggcagagcctcaggatggacccccttggggacacgctgcggcgactgcgggaggccttccacgcggggcgcacgcggccagctgagttccgggctgcgcagctccaaggcctggcgactcggaccgatg

SEQ ID NO: 416 - DNA, 203 bp, Homo sapiens
  source 1..203: mol_type = other DNA
ggcgcgccagtcctagaacccccctccctgccctatcctccgccaccccttctgttgcggggcgcgcgccagcctgggtgtctgtatgcgctcgaggcgggggcgcgggttgcggacggaggcgcgggaggcggttctgcgcggcgggggccgtacccgcggcggagcgaggaggcgagaatggatcacgactcggaccgatg

SEQ ID NO: 417 - DNA, 203 bp, Homo sapiens
  source 1..203: mol_type = other DNA
ggcgcgccagtcctcttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccgactcggaccgatg

SEQ ID NO: 418 - DNA, 203 bp, Homo sapiens
  source 1..203: mol_type = other DNA
ggcgcgccagtcctggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggcgactcggaccgatg

SEQ ID NO: 419 - DNA, 203 bp, Homo sapiens
  source 1..203: mol_type = other DNA
ggcgcgccagtcctcacagaaagcctggaaaaggtttccaggggtgtcaatacgccctgtcaactgagaattaagaggatccggctggtcacttgcctggagaggatcctgcatgctgatagtgctgaggcacctgccagctaagaaccaccgggaggaactgggccattctaacacccgttgctacccgactcggaccgatg

SEQ ID NO: 420 - DNA, 203 bp, Homo sapiens
  source 1..203: mol_type = other DNA
ggcgcgccagtcctgtgactgggtggggctgcctcacttctgcctgatttgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccgactcggaccgatg

SEQ ID NO: 421 - DNA, 203 bp, Homo sapiens
  source 1..203: mol_type = other DNA
ggcgcgccagtcctccgctgttatacgtcacttccacggctcagcgtcagggaggagagagaatgtcttttcgaggcggaggtcgtggaggctttaatcgaggtggtggaggtggcggcttcaaccgaggtggcagcagcaaccacttccgaggtggaggcggcggtggaggcggcggcaatttcagacgactcggaccgatg

SEQ ID NO: 422 - DNA, 203 bp, Homo sapiens
  source 1..203: mol_type = other DNA
ggcgcgccagtcctgcttgggtaggggccaggctagcctgagtgcacccagatgcgcttctgtcagctctccctagtgcttcaaccactgctctccctgctctactttttttgctccagctcagggatgggggtgggcagggaaatcctgccaccctcacttctccccttcccatctccaggggggcccgactcggaccgatg

SEQ ID NO: 423 - DNA, 203 bp, Homo sapiens
  source 1..203: mol_type = other DNA
ggcgcgccagtccttcgacgggcgtggcgggggaggggacgctgagggcccatgtgctgaaaatccgaagtgccgcggaaagtggaggtgagggccgcccgccctagaggtgcccgtccgagaggcagagctgacaaggaaggtttcgagcgttttgctggcaaagggatttcttacaacctccaggccgactcggaccgatg

SEQ ID NO: 424 - DNA, 203 bp, Homo sapiens
  source 1..203: mol_type = other DNA
ggcgcgccagtcctagaaagtcgacgggcgtggcgggggaggggacgctgagggcccatgtgctgaaaatccgaagtgccgcggaaagtggagagctgacaaggaaggtttcgagcgttttgctggcaaagggatttcttacaacctccaggcatgcgtctttctgccctgctggccttggcatccaacgactcggaccgatg

SEQ ID NO: 425 - DNA, 203 bp, Homo sapiens
  source 1..203: mol_type = other DNA
ggcgcgccagtcctagaactgagctcatctttgcggggttagctagccgttgagtccaagtctccttggcaagacagtagcttagagaaacgagatcgaatgcacccggaaggtggccaatttgtgcctcaactccttggccatctcctggctaccaaactcaagcgtttcctccttagcaaaggcggcgactcggaccgatg

SEQ ID NO: 426 - DNA, 203 bp, Homo sapiens
  source 1..203: mol_type = other DNA
ggcgcgccagtcctcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagaccgactcggaccgatg

SEQ ID NO: 427 - DNA, 203 bp, Homo sapiens
  source 1..203: mol_type = other DNA
ggcgcgccagtcctcgccggcctgcagtctagccgtagtgcgcctgcgcgcggctaggaggggccgtcaggcggggatacagcctggaaggtaatgcatgtccatggtacacaaattcacaagtttggagaccctgacacacccaccttctcacctgggctctgcgtatcccccagccttgagggaagcgactcggaccgatg

SEQ ID NO: 428 - DNA, 203 bp, Homo sapiens
  source 1..203: mol_type = other DNA
ggcgcgccagtccttgaaatccggttctaacgggtccggggctcccagcgctataaaaactttataaaccccccggagcccgagcagtgtgaagaagaggcgagaacgaccccgggaccgaccaaagcccgcgcgccgctgcatcccgcgtccagcacctacgtcccgctgccgtcgccgccgccacccgactcggaccgatg

SEQ ID NO: 429 - DNA, 203 bp, Homo sapiens
  source 1..203: mol_type = other DNA
ggcgcgccagtcctgatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtgcgactcggaccgatg

SEQ ID NO: 430 - DNA, 203 bp, Homo sapiens
  source 1..203: mol_type = other DNA
ggcgcgccagtcctcccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgcccgactcggaccgatg

SEQ ID NO: 431 - DNA, 203 bp, Homo sapiens
  source 1..203: mol_type = other DNA
ggcgcgccagtcctgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgagcgactcggaccgatg

SEQ ID NO: 432 - DNA, 203 bp, Homo sapiens
  source 1..203: mol_type = other DNA
ggcgcgccagtcctcggggcggtgcgctgggctgcacctccctccccgcgccccgtcctctcccgccctacaggccctagcagggcaggcgggaggtgagcgcggccatcccgctcccggagttccgggatcctggagtccgtagttcgtggtccttcgccggtgtccccggagcccagcggctgtggcgactcggaccgatg

SEQ ID NO: 433 - DNA, 203 bp, Homo sapiens
  source 1..203: mol_type = other DNA
ggcgcgccagtcctctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtcccgactcggaccgatg

SEQ ID NO: 434 - DNA, 203 bp, Homo sapiens
  source 1..203: mol_type = other DNA
ggcgcgccagtcctccgggccagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagcgactcggaccgatg

SEQ ID NO: 435 - DNA, 203 bp, Homo sapiens
  source 1..203: mol_type = other DNA
ggcgcgccagtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgcccgactcggaccgatg

SEQ ID NO: 436 - DNA, 203 bp, Homo sapiens
  source 1..203: mol_type = other DNA
ggcgcgccagtcctgcacgcgcaaacctcctgtgatgcctgcgcctcctggccccgccttccgctcgtgggagttccggatgtttagcgttaccatggatcctggaggtgcccgcgaacactgcttgtcgcctgggcaaccggagaggacgaagcaggacctaggtggcggcggtggtaccggctgcacgactcggaccgatg

SEQ ID NO: 437 - DNA, 203 bp, Homo sapiens
  source 1..203: mol_type = other DNA
ggcgcgccagtcctttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaaccgactcggaccgatg

SEQ ID NO: 438 - DNA, 203 bp, Homo sapiens
  source 1..203: mol_type = other DNA
ggcgcgccagtcctttggtccaagcaagaaggcagtggtctactccatcggcaacatgctggtcctttatggacacagcacccaggaccttccggaaaccaatgcccgcgtagtcggagggactgaggccgggaggaattcctggccctctcagatttccctccagtaccggtctggaggttcccggtcgactcggaccgatg

SEQ ID NO: 439 - DNA, 203 bp, Homo sapiens
  source 1..203: mol_type = other DNA
ggcgcgccagtcctcagtgcctgggccgctgggagccgttattggctgccgttaaggaccgttacgtttcccgggtccttctggcactcctctggtggaccgcccccatcggccacacttgccctgctctccagtgattctgtagctcctggctccgtagtctcgcggacagctctctttcctggaagcgactcggaccgatg

SEQ ID NO: 440 - DNA, 203 bp, Homo sapiens
  source 1..203: mol_type = other DNA
ggcgcgccagtcctgtaagcgctgcggagattgggctagaggcggaggcctgggccacggcggaggcgctgggtccttctggcactcctctggtggaccgcccccatcggccacacttgccctgctctccagtgattctgtagctcctggctccgtagtctcgcggacagctctctttcctggaagatcgactcggaccgatg

SEQ ID NO: 441 - DNA, 203 bp, Homo sapiens
  source 1..203: mol_type = other DNA
ggcgcgccagtcctgcaatgctaggcgatggggaatccgaagacgcacaggagtccaagggttggctgactgcagaccctcatcataagtctagagccggagaagatggggagacgccggcctgcgccctttcgtgccctcgtgaggctggcatgcaggatggcaggacagcccggccacatgccccacgactcggaccgatg

SEQ ID NO: 442 - DNA, 203 bp, Homo sapiens
  source 1..203: mol_type = other DNA
ggcgcgccagtcctatagagtagcggaagtggtccgttctcttcctctcccggcccaagcttctgggtatttctattgcgcgaggcattgtgggttgctgggcggcccggtctcggagaagaggggagagtggcgggccgctgaataagcttccaaaatgatgcccacaccagttatcctattgaaagcgactcggaccgatg

SEQ ID NO: 443 - DNA, 203 bp, Homo sapiens
  source 1..203: mol_type = other DNA
ggcgcgccagtcctggcgcttccgcaggaagaaggaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattcgactcggaccgatg

SEQ ID NO: 444 - DNA, 203 bp, Homo sapiens
  source 1..203: mol_type = other DNA
ggcgcgccagtcctagtacagcagttgagagtaaggcctctggagctacactgaatgcctagcccacaccagttatcctattgaaagaggggactgatagctcccaaggcatcccccagcttgtgagtaacatcagtgcctgccaggtgattgctgaggctgtaagaactaccctgggtccccgtggccgactcggaccgatg

SEQ ID NO: 445 - DNA, 203 bp, Homo sapiens
  source 1..203: mol_type = other DNA
ggcgcgccagtcctggggagggccgcgcagtgggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattcgactcggaccgatg

SEQ ID NO: 446 - DNA, 203 bp, Homo sapiens
  source 1..203: mol_type = other DNA
ggcgcgccagtccttttcctgcgcggccgagcctgtcgccgccggatccggcctgcgggggtagttacggtgtttgctaggccggccgccctcttggagcttctgccctccgctgaggaagcggcgccgcctgacgcgggacggtcgggcgggcgccatgttgtgaaccgcctcggcggagctgtaagcgactcggaccgatg

SEQ ID NO: 447 - DNA, 203 bp, Homo sapiens
  source 1..203: mol_type = other DNA
ggcgcgccagtcctgtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatcgactcggaccgatg

SEQ ID NO: 448 - DNA, 203 bp, Homo sapiens
  source 1..203: mol_type = other DNA
ggcgcgccagtcctataaggccctctcctccaccctgccaggctcactctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgactcggaccgatg

SEQ ID NO: 449 - DNA, 203 bp, Homo sapiens
  source 1..203: mol_type = other DNA
ggcgcgccagtcctattatgcattttccacatagggaaactgaggctcaggggtgttaagtgactcacccaaggtcacacggctaggaagttgctgcacgctcctatgctccatttcctctgggagcctatcaacccagataaagcgggacctcctctctggtagaggtgcagggggcagtactcaaccgactcggaccgatg

SEQ ID NO: 450 - DNA, 203 bp, Homo sapiens
  source 1..203: mol_type = other DNA
ggcgcgccagtcctgtcacagggacagaccaacgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactggggaccgactcggaccgatg

SEQ ID NO: 451 - DNA, 203 bp, Homo sapiens
  source 1..203: mol_type = other DNA
ggcgcgccagtccttcacacctgccaagcatcacacctgcgatgcctgcacgagctgggtggggtccgcgcagctgcagtaagggggcgacccggcgtctgttagtcggcggttcatctccttcgtgcctcgatgagctttaacgccattttcctccattctctttcttcacctcttgagtttccaagcgactcggaccgatg

SEQ ID NO: 452 - DNA, 203 bp, Homo sapiens
  source 1..203: mol_type = other DNA
ggcgcgccagtcctagtctggctgcggcggcagagctgaagtgagcggagccaccaggaggccatgtcgggtgaggacgctgaggtccgggcagtctctgaagatgtctccaatggaagcagtggctcgcccagccctggggacacactgccctggaaccttgggaaaacgcagcggagccggcgcagcgactcggaccgatg

SEQ ID NO: 453 - DNA, 203 bp, Homo sapiens
  source 1..203: mol_type = other DNA
ggcgcgccagtcctcgcggccgactggaggcccggagcaggggcggagtttccggcggcagcgccactcgggcgtcgggtgacgctaggcggacggaccatcatgtgacacggaagtagctccgaacaggaagaggacgaaaaaaataaccgtccgcgacgccgagacaaaccggacccgcaaccacccgactcggaccgatg

SEQ ID NO: 454 - DNA, 203 bp, Homo sapiens
  source 1..203: mol_type = other DNA
ggcgcgccagtcctattgcggaagtttctctacccatgcggtgtctctatggtcgggtgggtggggccaggaggaagatggcggcgtccgcagctgccgctgagctccaggcttctgggggtccgcggcacccagtgtgtctgttggtgttgggaatggcgggatccgggaaaaccacttttgtacagcgactcggaccgatg

SEQ ID NO: 455 - DNA, 203 bp, Homo sapiens
  source 1..203: mol_type = other DNA
ggcgcgccagtcctgtcctccagtggctccgctccccgttctctgtgggctcaaaatgacagaggctcacaggacacctgcatgcccaaggcactccaccgtatgtgatcaacctggatccagcagtacatgaagttccctttcctgccaatattgatattcgtgatactgtaaagtataaagaagtacgactcggaccgatg

SEQ ID NO: 456 - DNA, 203 bp, Homo sapiens
  source 1..203: mol_type = other DNA
ggcgcgccagtcctgattatttttctcctcttccttttttaatctatcctcttttcaccacattttagtgagaaagcaattttttttttacaaatggagcttatattgatttttatttcataaataattgaaagagggtagaaaaatctgcccttcatttaaaaattgaatgtttcactatgtatttacgactcggaccgatg

SEQ ID NO: 457 - DNA, 203 bp, Homo sapiens
  source 1..203: mol_type = other DNA
ggcgcgccagtcctgcggaacggcgggctgtctgctcgcgctccccgcgcacaacacttcaccctctcgcctcgggtctcgggggccgctctgggatcccggccaccagcaattgtccggaaataatgcaaaaggtgtcccaaggctcctgaccagtgaacaaagatttgagaaagacagccaagctccgactcggaccgatg

SEQ ID NO: 458 - DNA, 203 bp, Homo sapiens
  source 1..203: mol_type = other DNA
ggcgcgccagtcctcgcagaagaaccacaaaccccagaagccctcgcgcccactcttctccctcccctccagaagtcggagtgctgtttttgttgttggtgaaaggtgaggggaacagctgatccgtctgttgggaggacagatatctcaaggccaggatggaagaatcaccactaagccgggcaccacgactcggaccgatg

SEQ ID NO: 459 - DNA, 203 bp, Homo sapiens
  source 1..203: mol_type = other DNA
ggcgcgccagtccttcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggcccccgactcggaccgatg

SEQ ID NO: 460 - DNA, 203 bp, Homo sapiens
  source 1..203: mol_type = other DNA
ggcgcgccagtccttccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctcgcgcgcccacgtctgaagagcgcgactcggaccgatg

SEQ ID NO: 461 - DNA, 203 bp, Homo sapiens
  source 1..203: mol_type = other DNA
ggcgcgccagtcctggattcatttaccttgttttgtggggactggagagacaagtaaactctcagagtaactgtcccctctgactaccatttctaaggcaagccccctgtttctactcttgcgccccctgctggtttcctgccctgtctgatgccccggaggcccagctagccccagacttcggcccccgactcggaccgatg

SEQ ID NO: 462 - DNA, 203 bp, Homo sapiens
  source 1..203: mol_type = other DNA
ggcgcgccagtccttccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaacgactcggaccgatg

SEQ ID NO: 463 - DNA, 203 bp, Homo sapiens
  source 1..203: mol_type = other DNA
ggcgcgccagtcctaaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacacgactcggaccgatg

SEQ ID NO: 464 - DNA, 203 bp, Homo sapiens
  source 1..203: mol_type = other DNA
ggcgcgccagtcctacagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatgcgactcggaccgatg

SEQ ID NO: 465 - DNA, 203 bp, Homo sapiens
  source 1..203: mol_type = other DNA
ggcgcgccagtcctcggcgaccgcgggctgacgtggcggggctggcgtgtgggtctcgcagcgttgctcacagaacagagtagaggcggcggcggcggcggccggacccagactggtagtgaggctttggaccccgagccgctgcaatgccgctggagctggagctgtgtcccgggcgctgggtgggccgactcggaccgatg

SEQ ID NO: 466 - DNA, 203 bp, Homo sapiens
  source 1..203: mol_type = other DNA
ggcgcgccagtcctccgcggtggttacaaagggggtcaagagtgccggacccagccgcgcggagcccaccattgcggcccgagggggacccgacgggggcccgacggtgtggcgtggcgcaaggagcgcgcctgccttctctcgccgccgggaacgggctgcaccaatggccagattccagcaagattcgactcggaccgatg

SEQ ID NO: 467 - DNA, 203 bp, Homo sapiens
  source 1..203: mol_type = other DNA
ggcgcgccagtcctgcgacgtcacgctcggctataaaaggcgcggctcggggcccttgcggcgctggaggagctcgaggctgaggctgccggggggctgtgggctaccgggccgccggcgcctcagcgatgttttactcagggctcctcactgagggcggccgcaaggagaccgacatgcgggaggcgcgactcggaccgatg

SEQ ID NO: 468 - DNA, 203 bp, Homo sapiens
  source 1..203: mol_type = other DNA
ggcgcgccagtcctgccccctcccctgactatcaaagcagcggccggctgttggggtccaccacgccttccacctgccccactgcttcttcgcttctctcttggaaagtccagtctctcctcggcttgcaatggaccccaactgctcctgcgccgctggtgtctcctgcacctgcgctggttcctgcacgactcggaccgatg

SEQ ID NO: 469 - DNA, 203 bp, Homo sapiens
  source 1..203: mol_type = other DNA
ggcgcgccagtcctggacccggatgcaagcgtgctatataagcgttgctcaagtcccacccctttctttttgaggaagacgcggtcgtaagggctgaggatttttggtccgcacgctcctgctcctgactcaccgctgttcgctctcgccgaggaacaagtcggtcaggaagcccgcgcgcaacagcccgactcggaccgatg

SEQ ID NO: 470 - DNA, 203 bp, Homo sapiens
  source 1..203: mol_type = other DNA
ggcgcgccagtcctatcgtcgtgatccacctccccaggaccttggagccacgtttacaaataggaatagggtacgtgggagggatagaacgtacagccaataaaatcatgtggcgccgatgggcgtgttgaggccgctgcctggcttagggcggaaacagattctctgcataagaaggggaacgaaagcgactcggaccgatg

SEQ ID NO: 471 - DNA, 203 bp, Homo sapiens
  source 1..203: mol_type = other DNA
ggcgcgccagtcctccacctctggacagtcccactcagccccttcttcactctctgggcctcccaaaagacagtcagccttgtcctcaggcccgcacccagttgtcagcctctgactcctctcccctcaaaggattcttaccttggctcctcctcttagccctaacctgcctcctttgcctgtgagtccgactcggaccgatg

SEQ ID NO: 472 - DNA, 203 bp, Homo sapiens
  source 1..203: mol_type = other DNA
ggcgcgccagtcctaaagcaggatgccctcccagttcctcctgcctctaggttcctctttccctgctgattccaggagcctatcaacccagataaagcgggacctcctctctggtagaggtgcagggggcagtactcaacatgatcacagagggagcgcaggcccctcgattgttgctgccgccgctgcgactcggaccgatg

SEQ ID NO: 473 - DNA, 203 bp, Homo sapiens
  source 1..203: mol_type = other DNA
ggcgcgccagtcctcgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactgcgactcggaccgatg

SEQ ID NO: 474 - DNA, 203 bp, Homo sapiens
  source 1..203: mol_type = other DNA
ggcgcgccagtcctcccggcgtccctgcccctgggcggggacaggcggcggccaagcggggagtcgaggcggcgagcgcgcagctggcctagtctgcggtccccaactcctggagtcccctgggagctgccgctgcaggcccccgagccgctaggccccgccgccaggccaccgctgctgcggcagcccgactcggaccgatg

SEQ ID NO: 475 - DNA, 203 bp, Homo sapiens
  source 1..203: mol_type = other DNA
ggcgcgccagtcctgttaagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggccccgactcggaccgatg

SEQ ID NO: 476 - DNA, 203 bp, Homo sapiens
  source 1..203: mol_type = other DNA
ggcgcgccagtcctgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaacgactcggaccgatg

SEQ ID NO: 477 - DNA, 203 bp, Homo sapiens
  source 1..203: mol_type = other DNA
ggcgcgccagtccttccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagcgactcggaccgatg

SEQ ID NO: 478 - DNA, 203 bp, Homo sapiens
  source 1..203: mol_type = other DNA
ggcgcgccagtccttcgcctaacctcgcgcccgggccgcgcctcctcctcctcctgctccccgccgcttccgtttctcgagggaaaggctgctgcctcctgctctgtcctcatccccggcttagctgacggcccagagggtgggtgccaattccaccagcagctgcaactgaaaagcaaggttcagaacgactcggaccgatg

SEQ ID NO: 479 - DNA, 203 bp, Homo sapiens
  source 1..203: mol_type = other DNA
ggcgcgccagtcctcagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaacgactcggaccgatg

SEQ ID NO: 480 - DNA, 203 bp, Homo sapiens
  source 1..203: mol_type = other DNA
ggcgcgccagtcctccccacgcgctgtgaccccatttgttgcacgtgcatgttcaggtcgagagagggatgcgacgtgttcggggagcagcccaccttgtgggtggccaatccgggacgggaatcttaaacttttaactcttggtgcaaagactgatccactggcggctttacgggagcgggaaaaaacgactcggaccgatg

SEQ ID NO: 481 - DNA, 203 bp, Homo sapiens
  source 1..203: mol_type = other DNA
ggcgcgccagtcctagtcggagccgggcttgcccgggcatgtgggagctgccggctttccggacgccacgtgcagaccggaagagacacgcggggcttcaggctgctgccccattggaagattactccccaggcttcccttgccccaagcagtgagctgactggaatggtaccccgggaggcccctgacgactcggaccgatg

SEQ ID NO: 482 - DNA, 203 bp, Homo sapiens
  source 1..203: mol_type = other DNA
ggcgcgccagtcctgtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgcgactcggaccgatg

SEQ ID NO: 483 - DNA, 203 bp, Homo sapiens
  source 1..203: mol_type = other DNA
ggcgcgccagtcctctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagcccgactcggaccgatg

SEQ ID NO: 484 - DNA, 203 bp, Homo sapiens
  source 1..203: mol_type = other DNA
ggcgcgccagtcctgagccccacctccctcctcttcgcccccgcacgccgaaaacaggggcctctcacgtgacccctgcgcgctcccgcgggggagcgtagtctcggaggcggcgccgcaggggattgaggggttgactgagcgttgcgagccttagctttctcccgaacgccagcgctgaggacacgcgactcggaccgatg

SEQ ID NO: 485 - DNA, 203 bp, Homo sapiens
  source 1..203: mol_type = other DNA
ggcgcgccagtcctcgcgggcaatccctcaacctgattggtcccctcgcccgtcactccagtgcgcccccaacctaccacgcagtaaaagccacccccgcctcggcccggacggtttccaagctggttttgaagtcgcggcagctgttcctgggacgtccggttgaccgcgcgtctgctgcagagacccgactcggaccgatg

SEQ ID NO: 486 - DNA, 203 bp, Homo sapiens
  source 1..203: mol_type = other DNA
ggcgcgccagtcctctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacaggtgagaagcagcccagaaattttcgactcggaccgatg

SEQ ID NO: 487 - DNA, 203 bp, Homo sapiens
  source 1..203: mol_type = other DNA
ggcgcgccagtcctggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacagaaattttatgaataagcatcgactcggaccgatg

SEQ ID NO: 488 - DNA, 203 bp, Homo sapiens
  source 1..203: mol_type = other DNA
ggcgcgccagtcctggcgtcgcgggggcggggctcgggaaagacccgtgccagcgggcgtgtggccgcgggtttcgcacggtccaataagggagggcggcgtggcccggcctggtagcgacgaggacgcgcctgcgcagaggcggcagcaccaccggggttgactccgggggcgcggcgaggagagaccgactcggaccgatg

SEQ ID NO: 489 - DNA, 203 bp, Homo sapiens
  source 1..203: mol_type = other DNA
ggcgcgccagtcctgggtgagcaaaggggcgggtccctggctgctgtggcctcccctgaccccctccccccgctgctggggtcctcggccaagcccccttctcactggactgagacatgaggctgagctggttccgggtcctgacagtactgtccatctgcctgagcgccgtggccacggccacggggcgactcggaccgatg

SEQ ID NO: 490 - DNA, 203 bp, Homo sapiens
  source 1..203: mol_type = other DNA
ggcgcgccagtcctgtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcacgactcggaccgatg

SEQ ID NO: 491 - DNA, 203 bp, Homo sapiens
  source 1..203: mol_type = other DNA
ggcgcgccagtcctggccttgttctccagctgagaggacgatcgtccttataggagaggccgagtctccgagggcaatttcagaggtctggtgcgagggaagcagagactttcaaggaacaaggaaatgcatactatgccaagaaagattacaatgaagcttataattattatacaaaagccatagatcgactcggaccgatg

SEQ ID NO: 492 - DNA, 203 bp, Homo sapiens
  source 1..203: mol_type = other DNA
ggcgcgccagtcctaccccgggggcggggcttccggcgcgctgccttgtgggcacggtagttccgccgggtctggcttccgcctgccgagcggcccgggaccgcaggccggactacacttcccgtcggcccgcctgctctcccgatgccgccttggcgcgagacgttggcaagcagagtgtctccaagcgactcggaccgatg

SEQ ID NO: 493 - DNA, 203 bp, Homo sapiens
  source 1..203: mol_type = other DNA
ggcgcgccagtcctacgtgagggggcgaggggcgggatgcccctccgcgggccccgccaatgatgagctggattgcgtgggacgaagggtcgtcattggacaaccgccgcgggcgccctggtctctgctacctgtagctgagggcgctgttgatgggcagcgcggcgcgctgggaaggctcgttctcgcgactcggaccgatg

SEQ ID NO: 494 - DNA, 203 bp, Homo sapiens
  source 1..203: mol_type = other DNA
ggcgcgccagtcctgtcattttccctctactgctggaaaagaaggctcaagaggaagaatccaggttttgaggttttgctgaagatattcctgaagaatcatcccaggtgccacactaaaaaaatgatccagttgacagctacccctgtgagtgcacttgttgatgagccagtgcatatccgagctaccgactcggaccgatg

SEQ ID NO: 495 - DNA, 203 bp, Homo sapiens
  source 1..203: mol_type = other DNA
ggcgcgccagtccttgtcacccaggctggagtgcagtggcgcgatctcagctcactgccacctttgcctcctgggttcaagcgattcttctgcctcagcctcccgagtagctgggattacagggtgaagagggaacagaaatctttgccccctgactttggaaatctcgtttaaccttcaaactggcgcgactcggaccgatg

SEQ ID NO: 496 - DNA, 203 bp, Homo sapiens
  source 1..203: mol_type = other DNA
ggcgcgccagtcctgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgcgactcggaccgatg

SEQ ID NO: 497 - DNA, 203 bp, Homo sapiens
  source 1..203: mol_type = other DNA
ggcgcgccagtcctcgcgcctgcgcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatacgactcggaccgatg

SEQ ID NO: 498 - DNA, 203 bp, Homo sapiens
  source 1..203: mol_type = other DNA
ggcgcgccagtcctagggacgggaagtgggcggggccggccggcagcagcttgcgggacacggagccgcgaggagacagctgaggcccgcggagaccagggggtgaagcctggagaccctcttgccctggcctagctgcaggcccccgggatgctttgggcatgtcctctggagccccacagaagagccgactcggaccgatg

SEQ ID NO: 499 - DNA, 203 bp, Homo sapiens
  source 1..203: mol_type = other DNA
ggcgcgccagtcctggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgacgactcggaccgatg

SEQ ID NO: 500 - DNA, 203 bp, Homo sapiens
  source 1..203: mol_type = other DNA
ggcgcgccagtcctgatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctcgactcggaccgatg

SEQ ID NO: 501 - DNA, 203 bp, Homo sapiens
  source 1..203: mol_type = other DNA
ggcgcgccagtcctttttgtctgccccttcctgcctgtgggaaggagagaaaattaggggaggccacgggcttgaaagctttccctgcatggaggccactggatgggattctagatgctcgcctgggacccaggttcgtgccctcgtgaggctggcatgcaggatggcaggacagcccggccacatgccgactcggaccgatg

SEQ ID NO: 502 - DNA, 203 bp, Homo sapiens
  source 1..203: mol_type = other DNA
ggcgcgccagtcctggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccacccgactcggaccgatg

SEQ ID NO: 503 - DNA, 203 bp, Homo sapiens
  source 1..203: mol_type = other DNA
ggcgcgccagtcctcttcagggctgggggccgcgctatgccccgccccctccccagccccagacacggaccccgcaggccaactggctccctgcccctgcccccgccccttgacatcccagactccctggctatttaaacagagatgggtgcccccatccgcacactgtcctttggccaccggacatccgactcggaccgatg

SEQ ID NO: 504 - DNA, 203 bp, Homo sapiens
  source 1..203: mol_type = other DNA
ggcgcgccagtcctggaggcccaggcacctcatgtctgccctcaacccagagtggagcagaccttccctggagcttctcaggagccacttcaaaaggagaagaagacacatgaattagagacagcacgggggagcaggctgtggagctgggagtgacggggtgagtccaggaaggctgcctggaggagcgactcggaccgatg

SEQ ID NO: 505 - DNA, 203 bp, Homo sapiens
  source 1..203: mol_type = other DNA
ggcgcgccagtcctcgccgggtgactgacgttgaggcccaaccagggagaggcggggccaaggccagggcctgactaaacctggagactcgggtggccgaggggcttcataccagctgaagagcgacaagccgctggcagccgcggatctcaccgccgctcagggtttttagaacttcagccataaaacgactcggaccgatg

SEQ ID NO: 506 - DNA, 203 bp, Homo sapiens
  source 1..203: mol_type = other DNA
ggcgcgccagtccttccatttcctgttttgtatgtatatcgattccgctcctcttctttccgccagtttttgtagagacagcatcttgttgcccaggctggtctcgaactctggggctgaagtgattctccctcttcagcctcccagagttctgggattataggcacgagccaccatgcccagccttacgactcggaccgatg

SEQ ID NO: 507 - DNA, 203 bp, Homo sapiens
  source 1..203: mol_type = other DNA
ggcgcgccagtcctacgccccgcctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcgactcggaccgatg

SEQ ID NO: 508 - DNA, 203 bp, Homo sapiens
  source 1..203: mol_type = other DNA
ggcgcgccagtcctactcggcttccgtccattcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatgcgactcggaccgatg

SEQ ID NO: 509 - DNA, 203 bp, Homo sapiens
  source 1..203: mol_type = other DNA
ggcgcgccagtcctctgactgaggggtcagtggttccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgcgactcggaccgatg

SEQ ID NO: 510 - DNA, 203 bp, Homo sapiens
  source 1..203: mol_type = other DNA
ggcgcgccagtcctcggaaatgcgtgttctagctttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgactcggaccgatg

SEQ ID NO: 511 - DNA, 203 bp, Homo sapiens
  source 1..203: mol_type = other DNA
ggcgcgccagtcctagctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagccgactcggaccgatg

SEQ ID NO: 512 - DNA, 203 bp, Homo sapiens
  source 1..203: mol_type = other DNA
ggcgcgccagtcctgacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcacgactcggaccgatg

SEQ ID NO: 513 - DNA, 203 bp, Homo sapiens
  source 1..203: mol_type = other DNA
ggcgcgccagtcctgagaggaagcgcacctgagggagcacagcgaaggccgggacgcagggagctggatggagagcgagcctgggcggcgaaaggttgccgaggcgggggctgggcgcctgggaacaaaggaaagcaatagaagaactgcttaaggaggcaaaacgtgggaaaactagagctgaaacacgactcggaccgatg

SEQ ID NO: 514 - DNA, 203 bp, Homo sapiens
  source 1..203: mol_type = other DNA
ggcgcgccagtcctcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggcgactcggaccgatg

SEQ ID NO: 515 - DNA, 203 bp, Homo sapiens
  source 1..203: mol_type = other DNA
ggcgcgccagtcctgccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtggcttgtgagaaggttggccgactcggaccgatg

SEQ ID NO: 516 - DNA, 203 bp, Homo sapiens
  source 1..203: mol_type = other DNA
ggcgcgccagtcctcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgcgactcggaccgatg

SEQ ID NO: 517 - DNA, 203 bp, Homo sapiens
  source 1..203: mol_type = other DNA
ggcgcgccagtcctgggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatccgactcggaccgatg

SEQ ID NO: 518 - DNA, 203 bp, Homo sapiens
  source 1..203: mol_type = other DNA
ggcgcgccagtcctgggtgccggtggagtcgtgttggtcctcagaatccccgcgtagccgctgcctcctcctaccctcgccatgtttcttacccggtctgagtacgacagcttggttctacagccattgggatccagacatcagagggtgtgtgcctagctgtggagaagagaattacttccccactgcgactcggaccgatg

SEQ ID NO: 519 - DNA, 203 bp, Homo sapiens
  source 1..203: mol_type = other DNA
ggcgcgccagtcctctgcggccgtgtgggtgagttggctgccggggcgtgaatactttttctcccgaaggaagattatttcaagtggaatatgccattgaggctatcaagcttggttctacagccattgggatccagacatcagagggtgtgtgcctagctgtggagaagagaattacttccccactgcgactcggaccgatg

SEQ ID NO: 520 - DNA, 203 bp, Homo sapiens
  source 1..203: mol_type = other DNA
ggcgcgccagtcctagaaaggggcgggaggggtactgacccgaggagcggtcccgcgactctgtactccctgctgcccagtcccggccaggacgctgcccggcttagctggggcgcccctcgagaccaggatggagggttcagccgactcctacaccagccgcccatctctggactcagacgtctccccgactcggaccgatg

SEQ ID NO: 521 - DNA, 203 bp, Homo sapiens
  source 1..203: mol_type = other DNA
ggcgcgccagtcctagttggtccttagtactgcggccgtgtgggggcgtgaatactttttctcccgaaggaagattatttcaagtggaatatgccattgaggctatcaagcttggttctacagccattgggatccagacatcagagggtgtgtgcctagctgtggagaagagaattacttccccactgcgactcggaccgatg

SEQ ID NO: 522 - DNA, 203 bp, Homo sapiens
  source 1..203: mol_type = other DNA
ggcgcgccagtcctaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtcgactcggaccgatg

SEQ ID NO: 523 - DNA, 203 bp, Homo sapiens
  source 1..203: mol_type = other DNA
ggcgcgccagtcctaggaagggcgggtcagcgcgccggcgcagtgcggcggtcacaggctgagtgctgcggcgcgatccttgcttccctgagcgttggcccgggaggaaagaagatggtgctggatctggatttgtttcgggtggataaaggaggggacccagccctcatccgagagacgcaggagaacgactcggaccgatg

SEQ ID NO: 524 - DNA, 203 bp, Homo sapiens
  source 1..203: mol_type = other DNA
ggcgcgccagtcctacctttcagggagatttgagagaaagactccagaagcccgcggggagagcaggggttctggggaagataaagcccttcatccaggatccctctgtgaccataagatgagatggaccaaacgcccccggcgcgtcctgaatatctggtctcagggattcgaactccccctgtgagcgactcggaccgatg

SEQ ID NO: 525 - DNA, 203 bp, Homo sapiens
  source 1..203: mol_type = other DNA
ggcgcgccagtcctaaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagccgactcggaccgatg

SEQ ID NO: 526 - DNA, 203 bp, Homo sapiens
  source 1..203: mol_type = other DNA
ggcgcgccagtcctgaggtgggactgggcgggtcaggccgcagcggctgacggcaggggaggagccgggtccactgccgggtggaggggcaaggcgagtgtgtgtccttatcctagcaattggggcgcgggcctgtgagccagttggagttgcggcggcgggaacgattgggctgagcagaggacgaccgactcggaccgatg

SEQ ID NO: 527 - DNA, 203 bp, Homo sapiens
  source 1..203: mol_type = other DNA
ggcgcgccagtcctcagcagggaggcgagcagagggcccccagagggagccgcggaggtgcaggtcgaagaggccgggctacgtcgtgccctgcgcgtgagcagctgcagaggcagaggcagcatccagcggcggcgccagcagttccagtccgttgctttactttttgcttcaccgacatagtcattcgactcggaccgatg

SEQ ID NO: 528 - DNA, 203 bp, Homo sapiens
  source 1..203: mol_type = other DNA
ggcgcgccagtcctatagaaactacggcactctggccgtggccgacgttgctcctccgaagcatggcgccggcgggagttgtaacccgggctgtccggagcggggagctgcccctcacaagcatggcgtcagctgaaaatgaagcctgtgctgtgcggagcgtcgcctgcccctcacaagcatggcgtcgactcggaccgatg

SEQ ID NO: 529 - DNA, 203 bp, Homo sapiens
  source 1..203: mol_type = other DNA
ggcgcgccagtcctgccttccgctccgccccttcaggcaggaagtgtcggcgccgccactgtccggccacagcctaacgctcttcgctgtcgtttgtggtctcgcgcagggcggccccggttctggtgtttggcgtcggaattaaacaaccaccatgtcgagcaaaaaggcaaagaccaagaccaccacgactcggaccgatg

SEQ ID NO: 530 - DNA, 203 bp, Homo sapiens
  source 1..203: mol_type = other DNA
ggcgcgccagtcctggaggacggagtcccagagaactacaactcccatcaagcacttgggggatcgccgcggctgagggagagactatggcttaggaaccaccattcgcgtgaggctctgctccccgcgcctgcgcagagtgcagggccacgtcgcttttgctgtaccggggaccacgcgtctcatcccgactcggaccgatg

SEQ ID NO: 531 - DNA, 203 bp, Homo sapiens
  source 1..203: mol_type = other DNA
ggcgcgccagtccttggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagccgactcggaccgatg

SEQ ID NO: 532 - DNA, 203 bp, Homo sapiens
  source 1..203: mol_type = other DNA
ggcgcgccagtcctagccaattctgaccgtgtcaacgaatcatccacgcacctgcagctctgctgagagagtgcaagccgtgggggttttgagctcatcttcatcattcatatgaggaaataagtggtaaaatccttggaaatacaatgagactcatcagaaacatttacatattttgtagtattgttcgactcggaccgatg

SEQ ID NO: 533 - DNA, 203 bp, Homo sapiens
  source 1..203: mol_type = other DNA
ggcgcgccagtcctccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcacgactcggaccgatg

SEQ ID NO: 534 - DNA, 203 bp, Homo sapiens
  source 1..203: mol_type = other DNA
ggcgcgccagtcctgtcacttccggtcgacggcggaaggcggaaggcggagcggtccctgcaacccggccggcgggaactgccttctagtttttagtctcagaccagaccaccgggcgcaccccgatgccgagcccgcagcttctggtgctcttcggcagccagacaggcacggctcaggatgtgtcgcgactcggaccgatg

SEQ ID NO: 535 - DNA, 203 bp, Homo sapiens
  source 1..203: mol_type = other DNA
ggcgcgccagtcctcttcagtggcctcctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcacccgactcggaccgatg

SEQ ID NO: 536 - DNA, 203 bp, Homo sapiens
  source 1..203: mol_type = other DNA
ggcgcgccagtcctgaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaaccgactcggaccgatg

SEQ ID NO: 537 - DNA, 203 bp, Homo sapiens
  source 1..203: mol_type = other DNA
ggcgcgccagtccttgcgcagggggtagcagaggcgcggacaaaccgcggggtgaccagggcgcatgcgtaacagggcttgacagcgcgcggaagaaaaaccagcaagaaggcggcgggggaagatggcggtcctggggtagagtttgcaagctttctgactaggctagtcgagtaactattcgggtccgactcggaccgatg

SEQ ID NO: 538 - DNA, 203 bp, Homo sapiens
  source 1..203: mol_type = other DNA
ggcgcgccagtcctctattgatgggcccaagcgtaaccaggctcttctgattggccggtgtacttcagtttccgtccaaggtccgcctcctacctccttctgcttcggtccttaggataagaccatggccttgagagcatgtggcttgatcatcttccgaagatgcctcattcccaaagtggacaacacgactcggaccgatg

SEQ ID NO: 539 - DNA, 203 bp, Homo sapiens
  source 1..203: mol_type = other DNA
ggcgcgccagtcctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtccgactcggaccgatg

SEQ ID NO: 540 - DNA, 203 bp, Homo sapiens
  source 1..203: mol_type = other DNA
ggcgcgccagtcctacagggtataaaagctgtccgcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccacccgactcggaccgatg

SEQ ID NO: 541 - DNA, 203 bp, Homo sapiens
  source 1..203: mol_type = other DNA
ggcgcgccagtccttggttgcgtcgggtcacgtgggcgcgcaggcgcagcgcggtgcagcccgttcgctcacacaaagcccagacgcggagaaaatggcggcaggggtcgaagcggcggcggaggtggcggcgacggagatcaaaatggaggaagagagccgcgcgcccggcgtgccgagcggcaacgcgactcggaccgatg

SEQ ID NO: 542 - DNA, 203 bp, Homo sapiens
  source 1..203: mol_type = other DNA
ggcgcgccagtcctggttggaattttggcgggttcagctgtgaacgaagaaggcgtcccggcatcggccaagattctacattgctcatctgggcatctgagcctccttcgaagtttcctgtcacaactgtcctcttgacagcatggatgaggaggaagacaatctgtctctgctgaccgcactgctggcgactcggaccgatg

SEQ ID NO: 543 - DNA, 203 bp, Homo sapiens
  source 1..203: mol_type = other DNA
ggcgcgccagtcctagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttccccgactcggaccgatg

SEQ ID NO: 544 - DNA, 203 bp, Homo sapiens
  source 1..203: mol_type = other DNA
ggcgcgccagtccttgtggcaaaggaaggagctgactgggggagttcgaggcggcgggcggcggtgaccccggcctggaactgccccggtacggaagtgttccggggtccgtggggagcaggagagggaggcgggggaccgtcccgcgcggggcacgatgttgaacatgtggaagcaccaatgttgttcgactcggaccgatg

SEQ ID NO: 545 - DNA, 203 bp, Homo sapiens
  source 1..203: mol_type = other DNA
ggcgcgccagtcctcgccctcccgccgcgcgctcgggatcccgaccagtcctgaccgcacgggggccgcggccacggggcgcaggggccatggtgcgcggcaggatctcccggctctgggtccgggacgtgcgcttccccacgtcgcttgggggccacggcgcggacgccatgcacacggaccctgaccgactcggaccgatg

SEQ ID NO: 546 - DNA, 203 bp, Homo sapiens
  source 1..203: mol_type = other DNA
ggcgcgccagtccttaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatccgactcggaccgatg

SEQ ID NO: 547 - DNA, 203 bp, Homo sapiens
  source 1..203: mol_type = other DNA
ggcgcgccagtcctgcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactcgactcggaccgatg

SEQ ID NO: 548 - DNA, 203 bp, Homo sapiens
  source 1..203: mol_type = other DNA
ggcgcgccagtcctgagccgaaaggaaccggcgctttgtgacgtcacgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtgcgactcggaccgatg

SEQ ID NO: 549 - DNA, 203 bp, Homo sapiens
  source 1..203: mol_type = other DNA
ggcgcgccagtcctttccgcccgcgacccccttccagacccgctcccgaaaccttgtcgaaggaccaaaggcgaccggtgcaggtgcacgacgccagctcccttctggggggccggggcctgggggttgccatggcccccagccacctgtcagtgcgggagatgagggaagatgagaagcccctggtgcgactcggaccgatg

SEQ ID NO: 550 - DNA, 203 bp, Homo sapiens
  source 1..203: mol_type = other DNA
ggcgcgccagtcctagcgccgccgccacctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagccgactcggaccgatg

SEQ ID NO: 551 - DNA, 203 bp, Homo sapiens
  source 1..203: mol_type = other DNA
ggcgcgccagtccttcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagcgactcggaccgatg

SEQ ID NO: 552 - DNA, 203 bp, Homo sapiens
  source 1..203: mol_type = other DNA
ggcgcgccagtcctgacattctttgaagtgaagcattctatgaatgtgagctgaagaaatgaatgaaatgaaataatgcaggtcattttacctgggacaaatacctaaaagaaacatgttcagtcccagcgcctgtccattgcttcaagcagtcctacacacctccaagcaacgagttcaagatcagtcgactcggaccgatg

SEQ ID NO: 553 - DNA, 203 bp, Homo sapiens
  source 1..203: mol_type = other DNA
ggcgcgccagtcctcacaaatatggtcacctatcagagtctgcatcccaatatcaagaagctgctgacatcctggatctaggtcattttacctgggacaaatacctaaaagaaacatgttcagtcccagcgcctgtccattgcttcaagcagtcctacacacctccaagcaacgagttcaagatcagtcgactcggaccgatg

SEQ ID NO: 554 - DNA, 203 bp, Homo sapiens
  source 1..203: mol_type = other DNA
ggcgcgccagtccttcgcgccctttggcaagctcggactcatcttctggggattgccgcagtgacccagtaatgggaagggattgatttccaccttgcggggtatggggcgctcttaggaggactctggagaagtagttgtcctgggagaggagcgatcttaatcctgctgcatgacgggaggacaaacgactcggaccgatg

SEQ ID NO: 555 - DNA, 203 bp, Homo sapiens
  source 1..203: mol_type = other DNA
ggcgcgccagtcctgcgcatgagcagtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggtgttggtagccttcgactcggaccgatg

SEQ ID NO: 556 - DNA, 203 bp, Homo sapiens
  source 1..203: mol_type = other DNA
ggcgcgccagtcctttgcgctccccaagtctctctcgtgcgcagagcccaggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgccgactcggaccgatg

SEQ ID NO: 557 - DNA, 203 bp, Homo sapiens
  source 1..203: mol_type = other DNA
ggcgcgccagtcctgttattggttggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaacgactcggaccgatg

SEQ ID NO: 558 - DNA, 203 bp, Homo sapiens
  source 1..203: mol_type = other DNA
ggcgcgccagtcctgtcccttccctgggcaccaagagatgggctccccttgcctggcagagaaacagctggaaactggctccctgagacaagaagactggtaaacccagcgcttcctacctggtggtcttcagcaatgcccatgccttccagagacgggggcctgcatcccagacaccaccactatggcgactcggaccgatg

SEQ ID NO: 559 - DNA, 203 bp, Homo sapiens
  source 1..203: mol_type = other DNA
ggcgcgccagtcctagccagcggacgtccaggaaccgggatgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttacgactcggaccgatg

SEQ ID NO: 560 - DNA, 203 bp, Homo sapiens
  source 1..203: mol_type = other DNA
ggcgcgccagtcctacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgcgactcggaccgatg

SEQ ID NO: 561 - DNA, 203 bp, Homo sapiens
  source 1..203: mol_type = other DNA
ggcgcgccagtcctagagggcgagggcgagggcagagggcgctggcggcagcggccgcggaagatgagcagcagctgctcagggctgagcagggtcctggtggccgtggctacagccctggtgtctgcctcctccccctgcccccaggcctggggccccccaggggtccagtatgggcagccaggcagcgactcggaccgatg

SEQ ID NO: 562 - DNA, 203 bp, Homo sapiens
  source 1..203: mol_type = other DNA
ggcgcgccagtcctgacgtcgcggtgacgtcacggagttgccatggcgtcgctgagcggcctggcgtcggcgctggagtcgtacaggggccgggaccgcctgatccgagtgctggggtactgctgccagctggttggtggagttctggttgaacagtgtcccgccaggtccgaagtggggacacgtctcgactcggaccgatg

SEQ ID NO: 563 - DNA, 203 bp, Homo sapiens
  source 1..203: mol_type = other DNA
ggcgcgccagtcctgcggaggaaggagactagagcaggaagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcccgactcggaccgatg

SEQ ID NO: 564 - DNA, 203 bp, Homo sapiens
  source 1..203: mol_type = other DNA
ggcgcgccagtcctcggcctcgggacgccgtgacgttgcgttcctccagtcccttgccacctccctctttcttcccctctggggaagctcagtgctggacttccgaagaccttttacgacattgagtctcggagttggtctcagcgccggatccacttttcggcaaagtgacgtggacgtcaacagcacgactcggaccgatg

SEQ ID NO: 565 - DNA, 203 bp, Homo sapiens
  source 1..203: mol_type = other DNA
ggcgcgccagtcctacgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgacgactcggaccgatg

SEQ ID NO: 566 - DNA, 203 bp, Homo sapiens
  source 1..203: mol_type = other DNA
ggcgcgccagtcctcagacttgggtttgaaatccacgtatgaccctggcccgttggcctctctgagcccggcttcctcctctacaaaatggagatcgcaaccgtccccacccgatagcgagagggcgcacacccgcattccaggctggacgggtctctgggcagcgggctcctccccgcccagggcgccgactcggaccgatg

SEQ ID NO: 567 - DNA, 203 bp, Homo sapiens
  source 1..203: mol_type = other DNA
ggcgcgccagtcctgaatgaatgacttccgtctgggacttggttgcaaataaagccgagctgcatcttagggaggggtggagactttgcccctgtttgtgccttgaagccagcagggccttgccctaggatacctccacccaccctcctgcccagcaagtggaggcccgcagcccgagtgtcgccgcccgactcggaccgatg

SEQ ID NO: 568 - DNA, 203 bp, Homo sapiens
  source 1..203: mol_type = other DNA
ggcgcgccagtcctatctccccaccctctcttctccaccagccaacgtccgggaaaaacgagtttttcacgactgaaaacaacatagcaaaataagccaagatgtctgtggatccaatgacctacgaggcccagttctttggcttcacgccacaaacgtgcatgcttcggatctacattgcatttcaacgactcggaccgatg

SEQ ID NO: 569 - DNA, 203 bp, Homo sapiens
  source 1..203: mol_type = other DNA
ggcgcgccagtcctcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagccgactcggaccgatg

SEQ ID NO: 570 - DNA, 203 bp, Homo sapiens
  source 1..203: mol_type = other DNA
ggcgcgccagtccttttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcacgactcggaccgatg

SEQ ID NO: 571 - DNA, 203 bp, Homo sapiens
  source 1..203: mol_type = other DNA
ggcgcgccagtcctgacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgcgactcggaccgatg

SEQ ID NO: 572 - DNA, 203 bp, Homo sapiens
  source 1..203: mol_type = other DNA
ggcgcgccagtcctgccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgacccccccgactcggaccgatg

SEQ ID NO: 573 - DNA, 203 bp, Homo sapiens
  source 1..203: mol_type = other DNA
ggcgcgccagtcctcaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcacgactcggaccgatg

SEQ ID NO: 574 - DNA, 203 bp, Homo sapiens
  source 1..203: mol_type = other DNA
ggcgcgccagtcctctcgaccctgaaacttggagcagggtgggggttcagtatgaagccccgggaccgccccgcccctggccgcactgaccggatactgggggtcatggggggcatgctgcgcgcatgcgccctccctgggcaggaggggcccccaaggagaagccctctagggttggtgggtaccgacgactcggaccgatg

SEQ ID NO: 575 - DNA, 203 bp, Homo sapiens
  source 1..203: mol_type = other DNA
ggcgcgccagtcctgcagtcagccggggacctcgtccgagcccacccgcctttggaggctccatctccattctgggttctgatgatgccactacttgtcacattgtggtcctgaggcacacaggtaatggggccacctgcttgacacattgtgacggaaccgacaccaaagctgaggtccccttgatccgactcggaccgatg

SEQ ID NO: 576 - DNA, 203 bp, Homo sapiens
  source 1..203: mol_type = other DNA
ggcgcgccagtcctgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcacgactcggaccgatg

SEQ ID NO: 577 - DNA, 203 bp, Homo sapiens
  source 1..203: mol_type = other DNA
ggcgcgccagtcctcagaagattgtgggtgtagtggccacagccttacaggcaggcaggggtggttggtgtcaacaggggggccaacagggtaccagagccaagaccctcggcctcctcccccgccgccttcctgcagatctgcttggctttgaggaagagtggcagtactgcctcactgcataagggcgactcggaccgatg

SEQ ID NO: 578 - DNA, 203 bp, Homo sapiens
  source 1..203: mol_type = other DNA
ggcgcgccagtcctaaaccatgggggcggaagaggtgctgggcaggaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgccgactcggaccgatg

SEQ ID NO: 579 - DNA, 203 bp, Homo sapiens
  source 1..203: mol_type = other DNA
ggcgcgccagtcctcctcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctcgactcggaccgatg

SEQ ID NO: 580 - DNA, 203 bp, Homo sapiens
  source 1..203: mol_type = other DNA
ggcgcgccagtcctcggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaacgactcggaccgatg

SEQ ID NO: 581 - DNA, 203 bp, Homo sapiens
  source 1..203: mol_type = other DNA
ggcgcgccagtcctctcctcctcgtatttccccctcggtcctttacgccgcctttccccctcatttgcagatgctgcatcccctttttggaattgctcaaccaggtggtaaccggcgccgcttcctggccttgggaggtggttcctttcttaacccacaagaacctctcccaagagaacttggtcctgcgactcggaccgatg

SEQ ID NO: 582 - DNA, 203 bp, Homo sapiens
  source 1..203: mol_type = other DNA
ggcgcgccagtcctgcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctcgactcggaccgatg

SEQ ID NO: 583 - DNA, 203 bp, Homo sapiens
  source 1..203: mol_type = other DNA
ggcgcgccagtcctccctgagttcagggaatttccccagcatcccaaagcttgagtttcctgccagtcgggagggatgaatgcagataaagggagtgcagaaggcacgaggaaaccaaagtgctctgtatcctccagtctccgcgcctccacccagctcaggaacccgcgaaccctctcttgaccactcgactcggaccgatg

SEQ ID NO: 584 - DNA, 203 bp, Homo sapiens
  source 1..203: mol_type = other DNA
ggcgcgccagtcctagttcacccactagaggcaaagacgtaagagagctaccagcgtattgagaggagatacacaggcactacgagaatggagtttagaagaaggtcagagccctgggcagtgttgggccaggctttagggcctcaggagtgcaagtagctgatgaagtatgtcgcattttttatgaccgactcggaccgatg

SEQ ID NO: 585 - DNA, 203 bp, Homo sapiens
  source 1..203: mol_type = other DNA
ggcgcgccagtcctcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctcccgactcggaccgatg

SEQ ID NO: 586 - DNA, 203 bp, Homo sapiens
  source 1..203: mol_type = other DNA
ggcgcgccagtcctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagcgactcggaccgatg

SEQ ID NO: 587 - DNA, 203 bp, Homo sapiens
  source 1..203: mol_type = other DNA
ggcgcgccagtcctgcaaggcgggtggctccaccctgcgtcgggcctcagtcagcccccgggggaggccatgaacgccacggggaccccggtggcccccgagtcctgccaacagctggcggccggcgggcacagccggctcattgttctgcactacaaccactcgggccggctggccgggcgcgggggcgactcggaccgatg

SEQ ID NO: 588 - DNA, 203 bp, Homo sapiens
  source 1..203: mol_type = other DNA
ggcgcgccagtccttgtgacttcacctcagttttgtgatccgtaaaatggacaaattcgaagctacttcacagtgctgttgagaggattaaatgaaacaatgcttgtaaagctctttgcaggagggagcctcggaagcagggcctggccggcagagcacacctgctgtcaccagggaccacaggcagccgactcggaccgatg

SEQ ID NO: 589 - DNA, 203 bp, Homo sapiens
  source 1..203: mol_type = other DNA
ggcgcgccagtcctagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagcccgactcggaccgatg

SEQ ID NO: 590 - DNA, 203 bp, Homo sapiens
  source 1..203: mol_type = other DNA
ggcgcgccagtcctccgggagcccgcgcaccctctctgggctccacccaggctgagagctggggtcgtggcggcgggggtggagagcgcgcccctagaggacctggggacacgggtgactcagacgtgactcaggaaggctcaggtcctgctggcatccgcggaggtgagacggtgatcagagctgggcgactcggaccgatg

SEQ ID NO: 591 - DNA, 203 bp, Homo sapiens
  source 1..203: mol_type = other DNA
ggcgcgccagtccttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggcgactcggaccgatg

SEQ ID NO: 592 - DNA, 203 bp, Homo sapiens
  source 1..203: mol_type = other DNA
ggcgcgccagtccttcgcaacgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagcgactcggaccgatg

SEQ ID NO: 593 - DNA, 203 bp, Homo sapiens
  source 1..203: mol_type = other DNA
ggcgcgccagtcctgattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactccgactcggaccgatg

SEQ ID NO: 594 - DNA, 203 bp, Homo sapiens
  source 1..203: mol_type = other DNA
ggcgcgccagtcctatgccgaacttctgcgctgcccccaactgcacgcggaagagcacgcagtccgacttggccttcttcaggttcccgcgggaccctgccagatgccagaagtgggtggagaactgtaggagagcagacttagaagataaaacacctgatcagctaaataaacattatcgattatgtcgactcggaccgatg

SEQ ID NO: 595 - DNA, 203 bp, Homo sapiens
  source 1..203: mol_type = other DNA
ggcgcgccagtccttgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggcccgactcggaccgatg

SEQ ID NO: 596 - DNA, 203 bp, Homo sapiens
  source 1..203: mol_type = other DNA
ggcgcgccagtcctaaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagacgactcggaccgatg

SEQ ID NO: 597 - DNA, 203 bp, Homo sapiens
  source 1..203: mol_type = other DNA
ggcgcgccagtcctggtcggtgcgcgcttctcccgaggtggaacgggcggcagtcaagcgccggcgttctctgccgtcaccctttccttgccggccggcacttcggctgcagagttttgcccacgcttcgagacttagggagcagtgcctttcagaatttgcccactcatctggtataactggttctgcgactcggaccgatg

SEQ ID NO: 598 - DNA, 203 bp, Homo sapiens
  source 1..203: mol_type = other DNA
ggcgcgccagtcctgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgcccgactcggaccgatg

SEQ ID NO: 599 - DNA, 203 bp, Homo sapiens
  source 1..203: mol_type = other DNA
ggcgcgccagtcctgggcgtgcacgcgggcgcggctgcgtgagaggcgcgcggcggcgcagtaaacagtctccttccacaaaaccatggcgtcgctcaaatgtagcaccgtcgtctgcgtgatctgcttggagaagcccaaataccgctgtccagcctgccgcgtgccctactgctcggtagtctgctcgactcggaccgatg

SEQ ID NO: 600 - DNA, 203 bp, Homo sapiens
  source 1..203: mol_type = other DNA
ggcgcgccagtcctccagcaggcatgcctccttggtctcatgttgaccttagagtttgggattctggaattcgatccttcatggataggcagctggacacagaggtcgtgggtgagctggaggagcaggcccggatgtgagctgttctccatagtggtgttcggctccatcgtgaacgagggctacctcgactcggaccgatg

SEQ ID NO: 601 - DNA, 203 bp, Homo sapiens
  source 1..203: mol_type = other DNA
ggcgcgccagtcctaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggctacagcaggagctgcgactcggaccgatg

SEQ ID NO: 602 - DNA, 203 bp, Homo sapiens
  source 1..203: mol_type = other DNA
ggcgcgccagtcctaaacaatgcctgatatgtggagtaaagtcctcctccttggcctttgtcaagtcatcccctcttctcctcaggaactgctcaaacctgtgccccaaagatgagggcccaggaggacctcgagggccggacacagcatgaaaccaccagggacccctcgaccccgctacccacagacgactcggaccgatg

SEQ ID NO: 603 - DNA, 203 bp, Homo sapiens
  source 1..203: mol_type = other DNA
ggcgcgccagtcctccgttcccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaaacgactcggaccgatg

SEQ ID NO: 604 - DNA, 203 bp, Homo sapiens
  source 1..203: mol_type = other DNA
ggcgcgccagtcctcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgcccgactcggaccgatg

SEQ ID NO: 605 - DNA, 203 bp, Homo sapiens
  source 1..203: mol_type = other DNA
ggcgcgccagtcctgcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccacccgactcggaccgatg

SEQ ID NO: 606 - DNA, 203 bp, Homo sapiens
  source 1..203: mol_type = other DNA
ggcgcgccagtcctacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggcccgactcggaccgatg

SEQ ID NO: 607 - DNA, 203 bp, Homo sapiens
  source 1..203: mol_type = other DNA
ggcgcgccagtcctagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttccccgactcggaccgatg

SEQ ID NO: 608 - DNA, 203 bp, Homo sapiens
  source 1..203: mol_type = other DNA
ggcgcgccagtcctcggaggctcggccacaacgccactggattggtggtagggcggggcgggccacagtctccagcctgaagcggaagtggaggaaagatggaggaccatcagcacgtgcccatcgacatccagaccagcaagctgctcgattggctggtggacagaaggcactgcagcctgaaatggcgactcggaccgatg

SEQ ID NO: 609 - DNA, 203 bp, Homo sapiens
  source 1..203: mol_type = other DNA
ggcgcgccagtcctgggtcggccggcagggggcggggccgggcatggtaacggctcggaagcctaggaggctgggccggagggaggcggaggaaccggtgttcgccgccgccgctgcttcagcttattccttgtggcctctgcgggtcctgcctcagccatgatgatccacggcttccagagcagccacgactcggaccgatg

SEQ ID NO: 610 - DNA, 203 bp, Homo sapiens
  source 1..203: mol_type = other DNA
ggcgcgccagtccttggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggcccgactcggaccgatg

SEQ ID NO: 611 - DNA, 203 bp, Homo sapiens
  source 1..203: mol_type = other DNA
ggcgcgccagtccttcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaacgactcggaccgatg

SEQ ID NO: 612 - DNA, 203 bp, Homo sapiens
  source 1..203: mol_type = other DNA
ggcgcgccagtcctatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcatcgactcggaccgatg

SEQ ID NO: 613 - DNA, 203 bp, Homo sapiens
  source 1..203: mol_type = other DNA
ggcgcgccagtcctcttcccgccagtcccctaaccctgaggctgccgcgcggcggtcactgcgccggggtagtgggccccagtgttgcgctctctggccgttccttacactctgcttcaggctccagtgcaggggcgtagtgggatatggccaactcgggctgcaaggacgtcacgggtccagatgagcgactcggaccgatg

SEQ ID NO: 614 - DNA, 203 bp, Homo sapiens
  source 1..203: mol_type = other DNA
ggcgcgccagtccttctctccacgaggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagaggacagacgttgacgactcggaccgatg

SEQ ID NO: 615 - DNA, 203 bp, Homo sapiens
  source 1..203: mol_type = other DNA
ggcgcgccagtcctccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccgactcggaccgatg

SEQ ID NO: 616 - DNA, 203 bp, Homo sapiens
  source 1..203: mol_type = other DNA
ggcgcgccagtcctttgggaaggggccagattgcatcagacagggcctgatgggctggagccagactgtggtctgaggaggagacacagccttataagctgagggagtggagaggcccggggccaggaaagcagagacagacaaagcgttaggagaagaagagaggcagggaagacaagccaggcacgcgactcggaccgatg

SEQ ID NO: 617 - DNA, 203 bp, Homo sapiens
  source 1..203: mol_type = other DNA
ggcgcgccagtccttgggctacagtgggccgctctgcctcgctcccgcccgcctgcctcagtctccccagctctctgccacccccctcggaccagtgcctcttagatgtcgccctctggtcgcctgtgtcttctcaccatcgttggcctgattctccccaccagaggacagacgttgaaagataccaccgactcggaccgatg

SEQ ID NO: 618 - DNA, 203 bp, Homo sapiens
  source 1..203: mol_type = other DNA
ggcgcgccagtcctagggaggggcagctctgcatggcctgattcctgcaccccacctttgccccctcacacctcctctcatctcccgtttttgaagaggaggaccctgtcacatctggacaattctgcaagaactctgtagaactgacttcactgtgaaccaggctccagaagtcaacagaaacaaaacgactcggaccgatg

SEQ ID NO: 619 - DNA, 203 bp, Homo sapiens
  source 1..203: mol_type = other DNA
ggcgcgccagtcctcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatcgactcggaccgatg

SEQ ID NO: 620 - DNA, 203 bp, Homo sapiens
  source 1..203: mol_type = other DNA
ggcgcgccagtccttcaaatcaaatcagaaagacatccttcggaatgtgttcagaaccaattagtgacaacactgaagaccagaaaggcaagctgaagacaccagacttcgcttgaagggcaaacaagaaatccaaacatcatgtcaatggcaacagaacagtcgaacctttcccagagggaacacagcgactcggaccgatg

SEQ ID NO: 621 - DNA, 203 bp, Homo sapiens
  source 1..203: mol_type = other DNA
ggcgcgccagtccttggagcagcgcgcgcaagcgaggccaggggaaggtgggcgcaggactttagccggttgagaaggatcaagcaggcatttggagcacaggtgtctagaaacttttaaggggccggttcaagaaggaaaagttcccttctgctgtgaaactatttggcaagaggctggagggcccacgactcggaccgatg

SEQ ID NO: 622 - DNA, 203 bp, Homo sapiens
  source 1..203: mol_type = other DNA
ggcgcgccagtccttggactctcttgcagccaacttcccatcagatcaccctgctggacttgcagaccggaatggggctcgcctaaggagccgagcgctgcggaggctgctgcgtgttggatgggagtgggagggggctggagcgagatttccagggcgcagtcctccggggcgttacgccgggcatacgactcggaccgatg

SEQ ID NO: 623 - DNA, 203 bp, Homo sapiens
  source 1..203: mol_type = other DNA
ggcgcgccagtccttgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctcgactcggaccgatg

SEQ ID NO: 624 - DNA, 203 bp, Homo sapiens
  source 1..203: mol_type = other DNA
ggcgcgccagtcctcgcactcactgctcgcgccgggcgcgctccgccagctccgtgctccccgcgccaccctcctccgggccgcgctccctaagggatggtactgaatttcgccgccacaggagaccggctggagcgcccgccccgcggcctcgcctctcctccgagcagccagcgcctcgggacgcgcgactcggaccgatg

SEQ ID NO: 625 - DNA, 203 bp, Homo sapiens
  source 1..203: mol_type = other DNA
ggcgcgccagtcctgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagacgactcggaccgatg

SEQ ID NO: 626 - DNA, 203 bp, Homo sapiens
  source 1..203: mol_type = other DNA
ggcgcgccagtcctacctctgcggcgtcactgggagcccgacggaaaactgcgctaaaggcttgtctttcccctgcccgaccgaaggagccgaccttgcctgcgctacagcttccttattttcgtcgcctgttctcctgatcctgcgtgttctaaaaaccccttaggctttccatgggttcccagacccgactcggaccgatg

SEQ ID NO: 627 - DNA, 203 bp, Homo sapiens
  source 1..203: mol_type = other DNA
ggcgcgccagtcctccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtccgactcggaccgatg

SEQ ID NO: 628 - DNA, 203 bp, Homo sapiens
  source 1..203: mol_type = other DNA
ggcgcgccagtcctaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattacgactcggaccgatg

SEQ ID NO: 629 - DNA, 203 bp, Homo sapiens
  source 1..203: mol_type = other DNA
ggcgcgccagtccttggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagcgactcggaccgatg

SEQ ID NO: 630 - DNA, 203 bp, Homo sapiens
  source 1..203: mol_type = other DNA
ggcgcgccagtcctgacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggttcaatgtatctcgactcggaccgatg

SEQ ID NO: 631 - DNA, 203 bp, Homo sapiens
  source 1..203: mol_type = other DNA
ggcgcgccagtcctggcttgttcgggcctgagctggcgctacgaagttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctacgactcggaccgatg

SEQ ID NO: 632 - DNA, 203 bp, Homo sapiens
  source 1..203: mol_type = other DNA
ggcgcgccagtcctaactcttttgagtccagaatctcagaatcgggcgttgggctttgccgggtgcttcagatcaatggatgagttccacccgttcatcgaggcactgctgcctcacgtccgcgctttctcctacacctggttcaacctgcaggcgcggaagcgcaagtacttcaagaagcatgaaaacgactcggaccgatg

SEQ ID NO: 633 - DNA, 203 bp, Homo sapiens
  source 1..203: mol_type = other DNA
ggcgcgccagtcctaagccccgccccgcgccctgcgtcgggttaagagggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagcgactcggaccgatg

SEQ ID NO: 634 - DNA, 203 bp, Homo sapiens
  source 1..203: mol_type = other DNA
ggcgcgccagtcctcactgtctgaaacagtcgcgtaaggggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgaccgactcggaccgatg

SEQ ID NO: 635 - DNA, 203 bp, Homo sapiens
  source 1..203: mol_type = other DNA
ggcgcgccagtcctgaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccacgactcggaccgatg

SEQ ID NO: 636 - DNA, 203 bp, Homo sapiens
  source 1..203: mol_type = other DNA
ggcgcgccagtcctggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggcgactcggaccgatg

SEQ ID NO: 637 - DNA, 203 bp, Homo sapiens
  source 1..203: mol_type = other DNA
ggcgcgccagtcctaccaatcccgggctcagcaagttctcgcgataccgtgagatctccagtcctgacgacaccgccgctgaaatgttagtgagactgtagggtgggcggtgcgagcggcggttagctcccagttcggcctctgaggaaaacgggcgttcgcctgcggttggtccgactgttagcaaccgactcggaccgatg

SEQ ID NO: 638 - DNA, 203 bp, Homo sapiens
  source 1..203: mol_type = other DNA
ggcgcgccagtcctctaaacgaaagagccacgacgctctgcgcatgtgcgctcttcgcaagctgaaaatcttgcggggagctctttagcaagttccgccttccagcctgaagcgcatgcgcagcctcggttccgttgcgtagcgtgtccctcagtgggacactgcagggtgcggggacaactacgaagcgactcggaccgatg

SEQ ID NO: 639 - DNA, 203 bp, Homo sapiens
  source 1..203: mol_type = other DNA
ggcgcgccagtcctaacgccaagtaggggattgcgttccctccagtcgcagagtttccctcttgtcgcccaggctggagtgaagtggcacgatctcggcttactgcaagctccgcctcccgggttcacgccattctcctgcctcagcctcccgagtagctgggactacagaccctatcagatttggatcgactcggaccgatg

SEQ ID NO: 640 - DNA, 203 bp, Homo sapiens
  source 1..203: mol_type = other DNA
ggcgcgccagtcctgtcccgtcggtctcggcgccgggaagaggcggtggcgctgcccgcggtggcgggggttggcgacggagcgcgttggtgccaggaccggggtccgaggcgcgctctccgcccacagaaatgagccgtcagactgctacagcattacctaccggtacctcgaagtgtccaccatcccgactcggaccgatg

SEQ ID NO: 641 - DNA, 203 bp, Homo sapiens
  source 1..203: mol_type = other DNA
ggcgcgccagtcctaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaacccgactcggaccgatg

SEQ ID NO: 642 - DNA, 203 bp, Homo sapiens
  source 1..203: mol_type = other DNA
ggcgcgccagtcctcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagcgactcggaccgatg

SEQ ID NO: 643 - DNA, 203 bp, Homo sapiens
  source 1..203: mol_type = other DNA
ggcgcgccagtcctgacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaacgactcggaccgatg

SEQ ID NO: 644 - DNA, 203 bp, Homo sapiens
  source 1..203: mol_type = other DNA
ggcgcgccagtcctggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatccgactcggaccgatg

SEQ ID NO: 645 - DNA, 203 bp, Homo sapiens
  source 1..203: mol_type = other DNA
ggcgcgccagtcctgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaacccgactcggaccgatg

SEQ ID NO: 646 - DNA, 203 bp, Homo sapiens
  source 1..203: mol_type = other DNA
ggcgcgccagtcctgtcacagcatcacctgggtgacgaggtcataacacctcagcccttgcttaaaaaattttatttctacttttctattgtaaagagatctcaaaacaggaagataaaattggactgacagctctacagcctagtcttttagacagtgaactaggccagcattggcagacactggcgcgactcggaccgatg

SEQ ID NO: 647 - DNA, 203 bp, Homo sapiens
  source 1..203: mol_type = other DNA
ggcgcgccagtcctgctgcaatccctgctgggcagatggagagaggagcaagggagatggcagccccgggggactgtgcatagggagggactcatgaagtggcagctaagccctgtccagtggccacccgtcagccaagggccagagaccaggaaaggaagaaaggcagcttcacttcctctttgaggcgactcggaccgatg

SEQ ID NO: 648 - DNA, 203 bp, Homo sapiens
  source 1..203: mol_type = other DNA
ggcgcgccagtcctctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccacgactcggaccgatg

SEQ ID NO: 649 - DNA, 203 bp, Homo sapiens
  source 1..203: mol_type = other DNA
ggcgcgccagtccttgccagtctgtggagagtcctgctgccctccagccgggctcctccaccgggccttgcaggggccgagagagctcggtgcccgcccttccgctcgcctttttcgtcagctggctggagcagcatgggtccgggaggtctctaggctgaggcggcggccgctcctctagttccacacgactcggaccgatg

SEQ ID NO: 650 - DNA, 203 bp, Homo sapiens
  source 1..203: mol_type = other DNA
ggcgcgccagtcctcagttggctgttaagtgacactgattctccccgccccgcctgacccccgagaaggaggcttgtcccccgctgcgtgagggggtggggaagtgggtagtgaattcggatctacctgggaggggggagtggaagttcccgccccggagagcggcgaggcggcagccacagttgattcgactcggaccgatg

SEQ ID NO: 651 - DNA, 203 bp, Homo sapiens
  source 1..203: mol_type = other DNA
ggcgcgccagtcctacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaaccgactcggaccgatg

SEQ ID NO: 652 - DNA, 203 bp, Homo sapiens
  source 1..203: mol_type = other DNA
ggcgcgccagtcctagcggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaaccgactcggaccgatg

SEQ ID NO: 653 - DNA, 203 bp, Homo sapiens
  source 1..203: mol_type = other DNA
ggcgcgccagtcctaactccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcgactcggaccgatg

SEQ ID NO: 654 - DNA, 203 bp, Homo sapiens
  source 1..203: mol_type = other DNA
ggcgcgccagtccttgtgctttctctctgtttcagctgttttccttttaagatactcctctcagatttgtgtgcttcttcccttcccacattctatactgcccagcgcctgggattccagatctgcgtttgaatccaggaaagggaggtggacacctgcgcaggtgtgtgccctccggcccctgaagccgactcggaccgatg

SEQ ID NO: 655 - DNA, 203 bp, Homo sapiens
  source 1..203: mol_type = other DNA
ggcgcgccagtcctgactttctggtaaggagaggaggttacggggaacgacgcgctgctttcatgccctttcttgttctaccttcatcggccgaggtggacacctgcgcaggtgtgtgccctccggcccctgaagcatggccagcagcggcatggctgacagcgccaaccacctgcccttctttttcgcgactcggaccgatg

SEQ ID NO: 656 - DNA, 203 bp, Homo sapiens
  source 1..203: mol_type = other DNA
ggcgcgccagtcctgctgctcctctgtcgagctgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggacgactcggaccgatg

SEQ ID NO: 657 - DNA, 203 bp, Homo sapiens
  source 1..203: mol_type = other DNA
ggcgcgccagtcctatggatggaaccaatggcagcacccaaacccatttcatcctactgggattctctgaccgaccccatctggagaggatcctctttgtggtcatcctgatcgcgtacctcctgaccctcgtaggcaacaccaccatcatcctggtgtcccggctggacccccacctccacaccccccgactcggaccgatg

SEQ ID NO: 658 - DNA, 203 bp, Homo sapiens
  source 1..203: mol_type = other DNA
ggcgcgccagtcctatccgggcaggataaaggcctgggtgaggcggctcacctaccctgctttctgcattcttctctccacatccctctctgtacttacagcccccaatggcccccaaaaagccagagcccaagaaggatgatgccaaggcagcccccaaggcagctccagctcccgcacctccccctcgactcggaccgatg

SEQ ID NO: 659 - DNA, 203 bp, Homo sapiens
  source 1..203: mol_type = other DNA
ggcgcgccagtcctggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtcgactcggaccgatg

SEQ ID NO: 660 - DNA, 203 bp, Homo sapiens
  source 1..203: mol_type = other DNA
ggcgcgccagtcctgacgccatcccggccagaaaagccctggccagtggcgggcgcgacactatccgtgcggccaggcggagacccggaggaccgaagcttccggacgacgaggaaccgcccaacatggcctcggagagtgggaagctttggggtggccggtttgtgggtgcagtggaccccatcatgcgactcggaccgatg

SEQ ID NO: 661 - DNA, 203 bp, Homo sapiens
  source 1..203: mol_type = other DNA
ggcgcgccagtcctcgagcggccgacggcgggtgcacgcgtcggtacacgtctgggcggcgacctggtcgcaagccatggtcccacgcggggtcccagggccgccgcgggacttggccgaggtctcccgacttgtgctgtgagatacgttaacgctttctcgacaccaggggtctggacttagtgacccgactcggaccgatg

SEQ ID NO: 662 - DNA, 203 bp, Homo sapiens
  source 1..203: mol_type = other DNA
ggcgcgccagtcctatctgcctcagcctctttgtcactgcctggaccattgtccctgctgtttctcagacagcatagaggctgaggctggggccaggacccagacagagacacacggtcactgcagctgaagccgctgcccctgctacaggcaccaccaggaccagctgatcattccagcccacagcacgactcggaccgatg

SEQ ID NO: 663 - DNA, 203 bp, Homo sapiens
  source 1..203: mol_type = other DNA
ggcgcgccagtcctggaggtgcggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggatgtatgtcgactcggaccgatg

SEQ ID NO: 664 - DNA, 203 bp, Homo sapiens
  source 1..203: mol_type = other DNA
ggcgcgccagtcctgcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctaccgactcggaccgatg

SEQ ID NO: 665 - DNA, 203 bp, Homo sapiens
  source 1..203: mol_type = other DNA
ggcgcgccagtcctgcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctccgactcggaccgatg

SEQ ID NO: 666 - DNA, 203 bp, Homo sapiens
  source 1..203: mol_type = other DNA
ggcgcgccagtcctgcgctgggtcaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacgactcggaccgatg

SEQ ID NO: 667 - DNA, 203 bp, Homo sapiens
  source 1..203: mol_type = other DNA
ggcgcgccagtcctcgaatgatttaaccaacgccttttccctccaaagaaacttggaggatatacctttttttccttaaatggcatctttctacccccaaaaagaaagtgtgtggttttgagggcggggacattttgggttttaaacagcgcgtttaagaacacctcagatctgccttctctatcccacgactcggaccgatg

SEQ ID NO: 668 - DNA, 203 bp, Homo sapiens
  source 1..203: mol_type = other DNA
ggcgcgccagtcctagttccgagaccggttgccatggcgttctggacagcctcgcgagtccgaccccgcccttcaggagtgacgagcggcctgaccaatgggagcagggggcgggctctctgacgaaggactggaaggtggcggtggtgaaggtgcaggccgttggggcggctcagaggcaggtgactcgactcggaccgatg

SEQ ID NO: 669 - DNA, 203 bp, Homo sapiens
  source 1..203: mol_type = other DNA
ggcgcgccagtcctggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcgcgactcggaccgatg

SEQ ID NO: 670 - DNA, 203 bp, Homo sapiens
  source 1..203: mol_type = other DNA
ggcgcgccagtcctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtcgactcggaccgatg

SEQ ID NO: 671 - DNA, 203 bp, Homo sapiens
  source 1..203: mol_type = other DNA
ggcgcgccagtcctagaggaagagaacgatttaaggagcgaatactactggtaaactaatggaagaaatctgctgcaccactggatattgggagtgtgtggcatgcatcctcatcatcaggaaactctaaaaaagaaccgagtggtgctagccaaacagctgttgttgagcgaattgttagaacatctcgactcggaccgatg

SEQ ID NO: 672 - DNA, 203 bp, Homo sapiens
  source 1..203: mol_type = other DNA
ggcgcgccagtccttacctgcttcctgagctccccgagaagtcatccaggacctccccgagaagccgtccaggaaacatgctctcaggggacccccatctgcctcagcctctttgtcactgcctggaccattgtccctgctgtttctcaggcaccaccaggaccagctgatcattccagcccacagcacgactcggaccgatg

SEQ ID NO: 673 - DNA, 203 bp, Homo sapiens
  source 1..203: mol_type = other DNA
ggcgcgccagtcctatggaaaggcttcctttctccacctctgtaactggtgcttctgagaagtaaatggtatttggatcctgacctcagacgcgaatttgggtcttctgtgcttaggagcagaaagagcccaggaggggcctgttcctttacttcttgggggaaacgcaatgcgtggcctgacttctccgactcggaccgatg

SEQ ID NO: 674 - DNA, 203 bp, Homo sapiens
  source 1..203: mol_type = other DNA
ggcgcgccagtcctgctagttcctggtgcgtcacgggggagttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcgactcggaccgatg

SEQ ID NO: 675 - DNA, 203 bp, Homo sapiens
  source 1..203: mol_type = other DNA
ggcgcgccagtcctcctttctccctcgcgttaggcaggtgacagcagggacatgtctcgggagatgcaggatgtagacctcgctgaggtgaagcctttggtggagaaaggggagaccatcaccggcctcctgcaagagtttgatgtccagacaaaacctgctacaaccccctcttcaactacgaggaccgactcggaccgatg

SEQ ID NO: 676 - DNA, 203 bp, Homo sapiens
  source 1..203: mol_type = other DNA
ggcgcgccagtcctcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagcccgactcggaccgatg

SEQ ID NO: 677 - DNA, 203 bp, Homo sapiens
  source 1..203: mol_type = other DNA
ggcgcgccagtcctaggagttgctgcatcgagttgtgaggattaaaagttggatgtaacggcttggtaattatgagctcttctagtgtcccttcctcttccctgtgcccaaggggttttaggaaagcattttatctccacagcaatcctatgaggttgatactactatcctcatagaaggggaaactgcgactcggaccgatg

SEQ ID NO: 678 - DNA, 203 bp, Homo sapiens
  source 1..203: mol_type = other DNA
ggcgcgccagtccttaattatgagctcttctagtgtcccttcctcttccctgtgcccaaggggttttaggaaagcattttatctccacagcaatcctatgaggttgatactactatcctcatagaaggggaaactgatgccaggagaggttcaagcgtcttacctgaagtcacaaagcaaactgagtgcgactcggaccgatg

SEQ ID NO: 679 - DNA, 203 bp, Homo sapiens
  source 1..203: mol_type = other DNA
ggcgcgccagtcctgcatcagggccgggggacgggtaaggggggggtgaagaaggggccggccttcaagcaagagcgacgcaagatggcagccaccacgggctcggtccctcgcaatttccgactgttggaagaactcgaagaaggccagaaaggagtaggagatggcacagttagctggggtctagacgactcggaccgatg

SEQ ID NO: 680 - DNA, 203 bp, Homo sapiens
  source 1..203: mol_type = other DNA
ggcgcgccagtccttttcagagaaagttacgtggagcgtgggcgtttcgcagactcctaagcttctggcaagtatgaggcaaggatttcacagaagaacttggagcaaaaattcccactgtcatagctataggctgtccagtcttgagggagctgcaggaacaggaaaaagagaccttcagagaagaccgactcggaccgatg

SEQ ID NO: 681 - DNA, 203 bp, Homo sapiens
  source 1..203: mol_type = other DNA
ggcgcgccagtcctcatgtcactgcctgccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagagaccttcagagaagaccgactcggaccgatg

SEQ ID NO: 682 - DNA, 203 bp, Homo sapiens
  source 1..203: mol_type = other DNA
ggcgcgccagtcctgcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtcctcgactcggaccgatg

SEQ ID NO: 683 - DNA, 203 bp, Homo sapiens
  source 1..203: mol_type = other DNA
ggcgcgccagtcctgtgggatttacttccggcagcaggtggtggggccatggctgcccttctccgagctgtgcgtaggtttcggggaaaagctgtgtgggaaaggcctctccatgggctgtggtgctgcagtgggcaggaggatcctaagaggtgggtgggcagcagttcacccatctcgaaggagaacgactcggaccgatg

SEQ ID NO: 684 - DNA, 203 bp, Homo sapiens
  source 1..203: mol_type = other DNA
ggcgcgccagtccttttgcggctccaacatggctccgcggctgtgcagcatctctgtgacggcgcgtttctattccaaggacaatgaaggcagctggttccgctccctctttgttcacaaagtggatccccggaaggatgcccactccaccctgctgtccaagaaggaaaccagcaacctctataagacgactcggaccgatg

SEQ ID NO: 685 - DNA, 203 bp, Homo sapiens
  source 1..203: mol_type = other DNA
ggcgcgccagtcctgcgaggaagcgcggtcacgtgactgctgcgggccagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggcccgactcggaccgatg

SEQ ID NO: 686 - DNA, 203 bp, Homo sapiens
  source 1..203: mol_type = other DNA
ggcgcgccagtcctctcggccccgcccccgcgccccggatatgctgggacagcccgcgcccctagaacgctttgcgtcccgacgcccgcaggtcctcgcggtgcgcaccgtttgcgacttggtacttggaaaaatggacaaggattgtgaaatgaaacgcaccacactggacagccctttggggaagccgactcggaccgatg

SEQ ID NO: 687 - DNA, 203 bp, Homo sapiens
  source 1..203: mol_type = other DNA
ggcgcgccagtcctcacgaaagtgactaggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagcgactcggaccgatg

SEQ ID NO: 688 - DNA, 203 bp, Homo sapiens
  source 1..203: mol_type = other DNA
ggcgcgccagtcctcccaaaccaaggcccccagagaggtcccccaggcccctttgggtccctgagcctcagctggaggtggggggtgcctgcagtgcgctggctcagtctccttctgaaaagctggatccagcttgtttgaagcccttgagctgatcttagatccggcgcaggagaccaacgcctgcccgactcggaccgatg

SEQ ID NO: 689 - DNA, 203 bp, Homo sapiens
  source 1..203: mol_type = other DNA
ggcgcgccagtcctggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgttgtttacttctggtttagtgtgaacgactcggaccgatg

SEQ ID NO: 690 - DNA, 203 bp, Homo sapiens
  source 1..203: mol_type = other DNA
ggcgcgccagtcctgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggccgactcggaccgatg

SEQ ID NO: 691 - DNA, 203 bp, Homo sapiens
  source 1..203: mol_type = other DNA
ggcgcgccagtcctgggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagcgactcggaccgatg

SEQ ID NO: 692 - DNA, 203 bp, Homo sapiens
  source 1..203: mol_type = other DNA
ggcgcgccagtcctagctgacttgctccctcccgggctgcggctgctgcaaaagccagcagcggcagcgggagctgtccggaggccggcgtcgaggtgagacccgggcagactgaggctgcggggtttgccgctgtctctgctattccatcctccccataggggctctctcccctctcccatctcaagcgactcggaccgatg

SEQ ID NO: 693 - DNA, 203 bp, Homo sapiens
  source 1..203: mol_type = other DNA
ggcgcgccagtcctgggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagcgactcggaccgatg

SEQ ID NO: 694 - DNA, 203 bp, Homo sapiens
  source 1..203: mol_type = other DNA
ggcgcgccagtccttaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaacgactcggaccgatg

SEQ ID NO: 695 - DNA, 203 bp, Homo sapiens
  source 1..203: mol_type = other DNA
ggcgcgccagtcctttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcacccgactcggaccgatg

SEQ ID NO: 696 - DNA, 203 bp, Homo sapiens
  source 1..203: mol_type = other DNA
ggcgcgccagtcctagagcggggaaggctgagtccacactgcaagtccagagagcagggaactaccttgagtattctactcaaacttatgtctcagagttccccaatttcccaagaagggagagatagaggccacaatccagggggccatctcttaaggtaccaataattttgcaggatcaaaccaaacgactcggaccgatg

SEQ ID NO: 697 - DNA, 203 bp, Homo sapiens
  source 1..203: mol_type = other DNA
ggcgcgccagtccttcagctctctcctccgccccccttcgccctccccctttccctccctttctcctcctcctcctgccgccgcggccgctgccggacttcgccagatcagacccacggggctgccctcccctgcgcactcccctcgctgcccgggcccggagcgcagcgcggccgcacagattcacacgactcggaccgatg

SEQ ID NO: 698 - DNA, 203 bp, Homo sapiens
  source 1..203: mol_type = other DNA
ggcgcgccagtccttttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggcgactcggaccgatg

SEQ ID NO: 699 - DNA, 203 bp, Homo sapiens
  source 1..203: mol_type = other DNA
ggcgcgccagtcctgccatataaatcagatttttgacatgttataaaatgcaagtcacagctgctgttgtctgcggtattcaaaaacttttgaaacactgcatgtccaacaaaatttattttttgtgtgaatgtactgtttttcaaccctactctcttgaccaagaatgaaactatttacaaattaagcgactcggaccgatg

SEQ ID NO: 700 - DNA, 203 bp, Homo sapiens
  source 1..203: mol_type = other DNA
ggcgcgccagtcctgggaggcagcaggttaggcagtgagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcgactcggaccgatg

SEQ ID NO: 701 - DNA, 203 bp, Homo sapiens
  source 1..203: mol_type = other DNA
ggcgcgccagtcctcggcagctccgagggcacctccggttctcccccatcctccgggagtgtctgggcgctcagtccgctctgatcccgccgaaaccacctgcggttggcaggcaggagactaggcgtctgccggggagggcagggacccgctaagctgatctcctgtacagtagtgctacttaaaatcgactcggaccgatg

SEQ ID NO: 702 - DNA, 203 bp, Homo sapiens
  source 1..203: mol_type = other DNA
ggcgcgccagtcctatttccggcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgaccgactcggaccgatg

SEQ ID NO: 703 - DNA, 203 bp, Homo sapiens
  source 1..203: mol_type = other DNA
ggcgcgccagtcctcacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcacgactcggaccgatg

SEQ ID NO: 704 - DNA, 203 bp, Homo sapiens
  source 1..203: mol_type = other DNA
ggcgcgccagtcctagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactcgactcggaccgatg

SEQ ID NO: 705 - DNA, 203 bp, Homo sapiens
  source 1..203: mol_type = other DNA
ggcgcgccagtcctgctttatctggtagcactgttacataaaattaacatttattggtgatcactaggtgccaacattatgcgaagaactttacgtggacatcccatttaattctcagaagccgatcacaaggtggccagcatcgaaatgttcagccttttagtgatgaagatgcatcaattgaaacacgactcggaccgatg

SEQ ID NO: 706 - DNA, 203 bp, Homo sapiens
  source 1..203: mol_type = other DNA
ggcgcgccagtcctggcagccccatagccatctcagggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggacgactcggaccgatg

SEQ ID NO: 707 - DNA, 203 bp, Homo sapiens
  source 1..203: mol_type = other DNA
ggcgcgccagtcctattctttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagcgactcggaccgatg

SEQ ID NO: 708 - DNA, 203 bp, Homo sapiens
  source 1..203: mol_type = other DNA
ggcgcgccagtccttcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggcaaggtgacccccgactcggaccgatg

SEQ ID NO: 709 - DNA, 203 bp, Homo sapiens
  source 1..203: mol_type = other DNA
ggcgcgccagtcctgagtctgtaccctcgtgatgtccccgccccggttcccaggcaagtttagggaagtgaaaggcgccaggtgccagtcctggcctctgatgtaacccagcgccccgcagtcccgacacagattcctggatctcagccccatagcagctatgatcccgctgctgctggcagcgctgccgactcggaccgatg

SEQ ID NO: 710 - DNA, 203 bp, Homo sapiens
  source 1..203: mol_type = other DNA
ggcgcgccagtcctgtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgactcggaccgatg

SEQ ID NO: 711 - DNA, 203 bp, Homo sapiens
  source 1..203: mol_type = other DNA
ggcgcgccagtcctaaggccctcggccggaagctccgctttctcttcctgctctccatcatggcggatcaaggtgaaaaggagaaccccatgcgggaacttcgcatccgcaaactctgtctcaacatctgtgttggggagagtggagacagactgacgcgagcagccaaggtgttggagcagctcacacgactcggaccgatg

SEQ ID NO: 712 - DNA, 203 bp, Homo sapiens
  source 1..203: mol_type = other DNA
ggcgcgccagtcctagtggaggagctgctgctggtgctggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctatcgactcggaccgatg

SEQ ID NO: 713 - DNA, 203 bp, Homo sapiens
  source 1..203: mol_type = other DNA
ggcgcgccagtcctgggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaaccgactcggaccgatg

SEQ ID NO: 714 - DNA, 203 bp, Homo sapiens
  source 1..203: mol_type = other DNA
ggcgcgccagtcctctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccacccgactcggaccgatg

SEQ ID NO: 715 - DNA, 203 bp, Homo sapiens
  source 1..203: mol_type = other DNA
ggcgcgccagtccttcccgcctccctgggagctccgcacgggatttgcagatttacagaatggctgcacattaatggaaagagaagcataaacctatcttctttcattatggagggaggtttggcagatggagaacctgatcgaacttcgcaaacagtgacgaatctcagcttctgacaccaggaaagcgactcggaccgatg

SEQ ID NO: 716 - DNA, 203 bp, Homo sapiens
  source 1..203: mol_type = other DNA
ggcgcgccagtcctctcctggaccggggggcgcggaggttggagagaggagctacccgggtctcggacaggcggcactgggaccacgaggcagggagccaggcttgaagcaggtgacatgtagacgtcccctggtccagcctcggaacctgagcgcccttctgcctggaaagtttgtggctaggcgcccgactcggaccgatg

SEQ ID NO: 717 - DNA, 203 bp, Homo sapiens
  source 1..203: mol_type = other DNA
ggcgcgccagtcctcttaggaaaactcgacaggatattgaggggaggctccagccctcgggagtaaatatcttcccttccaacctggtgtcagcagcctttcgctcatactctaccacctatgaagagaggaatatcaccggaaccagggtgaaggtgcccgtggggcaggaggtggaggggatgaaccgactcggaccgatg

SEQ ID NO: 718 - DNA, 203 bp, Homo sapiens
  source 1..203: mol_type = other DNA
ggcgcgccagtcctggggctgaaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactcgactcggaccgatg

SEQ ID NO: 719 - DNA, 203 bp, Homo sapiens
  source 1..203: mol_type = other DNA
ggcgcgccagtcctgggctggggcgctccgctgagccactcctgcgcccccctggccttgtctacctcttgccccccgaggggttagtgtcgagctcaccccagcatcctatcacctcctggtggccttgccgcccccacaaccccgaggtataaagccaggtacacgaggcaggggacgcaccaaggcgactcggaccgatg

SEQ ID NO: 720 - DNA, 203 bp, Homo sapiens
  source 1..203: mol_type = other DNA
ggcgcgccagtcctgcggtctcgttattcgtgttttctctccgccctacgattattcccttccgcccccttctctaagctgcacagcctgaatagaagggctggtccagcggcggcggaggctggcgctgtcctgagagggagggctctgtgcggaagagatgaatcggacaaagggtgatgaggaggcgactcggaccgatg

SEQ ID NO: 721 - DNA, 203 bp, Homo sapiens
  source 1..203: mol_type = other DNA
ggcgcgccagtcctggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaacgactcggaccgatg

SEQ ID NO: 722 - DNA, 203 bp, Homo sapiens
  source 1..203: mol_type = other DNA
ggcgcgccagtcctagcatgagtcagacagcctctggctttctggaagggcaaggactctatatatacagagggagcttcctagctgggatattggagcagcaagaggctgggaagccatcacttaccttgcactgagaaagaagacaaaggccagtatgcacagctttcctccactgctgctgctgccgactcggaccgatg

SEQ ID NO: 723 - DNA, 203 bp, Homo sapiens
  source 1..203: mol_type = other DNA
ggcgcgccagtcctgcctctggctttctggaagggcaaggactctatatatacagagggagcttcctagctgggatattggagcagcaagaggctgggaagccatcacttaccttgcactgagaaagaagacaaaggcaagttgaaaagcggagaaatagtggcccagtggttgaaaaattgaagcaacgactcggaccgatg

SEQ ID NO: 724 - DNA, 203 bp, Homo sapiens
  source 1..203: mol_type = other DNA
ggcgcgccagtcctaaatgaactccctccagcttagctttcacccggtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctgcgactcggaccgatg

SEQ ID NO: 725 - DNA, 203 bp, Homo sapiens
  source 1..203: mol_type = other DNA
ggcgcgccagtccttgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaacgactcggaccgatg

SEQ ID NO: 726 - DNA, 203 bp, Homo sapiens
  source 1..203: mol_type = other DNA
ggcgcgccagtcctatgtgcacacacatacactcacacgtgtgtgcaggtgcacacctcccccagaggctgcagccaagacgggcatcccacatcagagggatgaatggcaggtctgtcccgccagctgtgtgctctctcccacccgaagaaagcagcagagactcagacggcggagcctggaggagccgactcggaccgatg

SEQ ID NO: 727 - DNA, 203 bp, Homo sapiens
  source 1..203: mol_type = other DNA
ggcgcgccagtcctggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagctcaactggtgattgacctgaataaccaacgactcggaccgatg

SEQ ID NO: 728 - DNA, 203 bp, Homo sapiens
  source 1..203: mol_type = other DNA
ggcgcgccagtcctacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatcgactcggaccgatg

SEQ ID NO: 729 - DNA, 203 bp, Homo sapiens
  source 1..203: mol_type = other DNA
ggcgcgccagtcctagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtcgactcggaccgatg

SEQ ID NO: 730 - DNA, 203 bp, Homo sapiens
  source 1..203: mol_type = other DNA
ggcgcgccagtcctgcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggcccgactcggaccgatg

SEQ ID NO: 731 - DNA, 203 bp, Homo sapiens
  source 1..203: mol_type = other DNA
ggcgcgccagtcctggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaaccgactcggaccgatg

SEQ ID NO: 732 - DNA, 203 bp, Homo sapiens
  source 1..203: mol_type = other DNA
ggcgcgccagtcctctgaaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgcgactcggaccgatg

SEQ ID NO: 733 - DNA, 203 bp, Homo sapiens
  source 1..203: mol_type = other DNA
ggcgcgccagtccttccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgcccgactcggaccgatg

SEQ ID NO: 734 - DNA, 203 bp, Homo sapiens
  source 1..203: mol_type = other DNA
ggcgcgccagtcctaggccgcggcccagctgaccctcggggctcccccggcagcggacagggaagggttaaaggcccccggctccctgccccctgccctggggaacccctggccctgtggggacatgaactagggacaaattcccagctgacggggaccacaacctggattccctgcccaccctggcccgactcggaccgatg

SEQ ID NO: 735 - DNA, 203 bp, Homo sapiens
  source 1..203: mol_type = other DNA
ggcgcgccagtcctagaataattttgctgccaagtgaatcagagagacttgcagttctcggagagcacggaacttattcctgcccagagttcagacacagccagaaattaccatttcatacttcacagaatggaggtttcagcagccaaagccccaagtgccgcagacttgtctgagattgaaataaacgactcggaccgatg

SEQ ID NO: 736 - DNA, 203 bp, Homo sapiens
  source 1..203: mol_type = other DNA
ggcgcgccagtcctacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggcccgactcggaccgatg

SEQ ID NO: 737 - DNA, 203 bp, Homo sapiens
  source 1..203: mol_type = other DNA
ggcgcgccagtcctgagaccctctgctcttctgctcccttcctgtgtgctgcctggcaatggggaactctgagggctgcaataccaagaaggagggtgacctgatagctgctcaggctcggctgaaggacctggaggctctgctgaactccaaggaggccgcactgagcactgctctcagtgagaagccgactcggaccgatg

SEQ ID NO: 738 - DNA, 203 bp, Homo sapiens
  source 1..203: mol_type = other DNA
ggcgcgccagtcctcacaattgacagcctcaaggttcctggctttttgaaccaccacagacatctcctttcccggctaccccaccctgagcgccagacaccatgaaccttccttccacaaaggtctcctgggccgccgtgacgctactgctgctgctgctgctgctgccgcccgcgctgttgtcgtcccgactcggaccgatg

SEQ ID NO: 739 - DNA, 203 bp, Homo sapiens
  source 1..203: mol_type = other DNA
ggcgcgccagtcctccggaagtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaacgactcggaccgatg

SEQ ID NO: 740 - DNA, 203 bp, Homo sapiens
  source 1..203: mol_type = other DNA
ggcgcgccagtcctacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggaagaaaacagcccaaagcgactcggaccgatg

SEQ ID NO: 741 - DNA, 203 bp, Homo sapiens
  source 1..203: mol_type = other DNA
ggcgcgccagtcctactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactccgactcggaccgatg

SEQ ID NO: 742 - DNA, 203 bp, Homo sapiens
  source 1..203: mol_type = other DNA
ggcgcgccagtcctggctgggtccagatacctgtgttttgactctgttcctgtggatagctgcttggtctgaagttccagaaaggatcctgttcccagacaggtccctgagtactgacggtcacaggctgccgcgtctttcctgttgactcatgtttggttcctccagtgaaaattttacttagagaacgactcggaccgatg

SEQ ID NO: 743 - DNA, 203 bp, Homo sapiens
  source 1..203: mol_type = other DNA
ggcgcgccagtcctcaatcagttgcgaccttctcttaacaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactccgactcggaccgatg

SEQ ID NO: 744 - DNA, 203 bp, Homo sapiens
  source 1..203: mol_type = other DNA
ggcgcgccagtcctcaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagcgactcggaccgatg

SEQ ID NO: 745 - DNA, 203 bp, Homo sapiens
  source 1..203: mol_type = other DNA
ggcgcgccagtccttcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacgactcggaccgatg

SEQ ID NO: 746 - DNA, 203 bp, Homo sapiens
  source 1..203: mol_type = other DNA
ggcgcgccagtccttcatttggtcccaagtatgactcagggttaggctgggtcctcaggctccgtgctgttggaaggaagtgggaggattccaggggagttctgggaccttttcaaactgaagagaggaggctggctgcatcatgggagaagagactattgggaagaagttacctgcaactacagcaacgactcggaccgatg

SEQ ID NO: 747 - DNA, 203 bp, Homo sapiens
  source 1..203: mol_type = other DNA
ggcgcgccagtcctaaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagcgactcggaccgatg

SEQ ID NO: 748 - DNA, 203 bp, Homo sapiens
  source 1..203: mol_type = other DNA
ggcgcgccagtcctctggttttccagtcaggcggccggagggcagccctcaagaacggccctgaccgcccgcggggtgaggggccctttctgggcaggacccgccccttggtcccgcagagccttggtacttggacctgaaccttgctccgagagggagtcctcgcggacgtcagccaagattccagacgactcggaccgatg

SEQ ID NO: 749 - DNA, 203 bp, Homo sapiens
  source 1..203: mol_type = other DNA
ggcgcgccagtcctaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaacgactcggaccgatg

SEQ ID NO: 750 - DNA, 203 bp, Homo sapiens
  source 1..203: mol_type = other DNA
ggcgcgccagtcctgggcagctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagcgactcggaccgatg

SEQ ID NO: 751 - DNA, 203 bp, Homo sapiens
  source 1..203: mol_type = other DNA
ggcgcgccagtcctcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagcgactcggaccgatg

SEQ ID NO: 752 - DNA, 203 bp, Homo sapiens
  source 1..203: mol_type = other DNA
ggcgcgccagtcctggagctgccgggggaggggagttgtaagcagagcgctgagcctcgcagctcgcattcggagggaagctgacatccacaccaagtcgagacttccagggatgtggccggggagcagtcacatgctgtagctttcatgagcacaggcatcagtcaggcagatgtttgtcgactggacgactcggaccgatg

SEQ ID NO: 753 - DNA, 203 bp, Homo sapiens
  source 1..203: mol_type = other DNA
ggcgcgccagtccttgtgacatttcctctggtggtttccacgaacccaggcgtcacccctcggtggagataaagtggagccacccagctccaccgtgtctcagcctggggtcggcctctgctgcttctggactcagtgaccctgggctgtcagggagcttctgagccttggttttcctgtctagtaagcgactcggaccgatg

SEQ ID NO: 754 - DNA, 203 bp, Homo sapiens
  source 1..203: mol_type = other DNA
ggcgcgccagtcctggcggccaagatgtccgtgccttgccgctctcctaccccatgtcgctgaagcagatgagttggagcaggactcaggagggtactaggcccaggttttaggctgaacctaggaatgagtaatgagaggaggcagatcagctggaggaccagcccgagtccccagatgtcggcacacgactcggaccgatg

SEQ ID NO: 755 - DNA, 203 bp, Homo sapiens
  source 1..203: mol_type = other DNA
ggcgcgccagtcctggggcgcggggagtcgaggcatttgcgcctgggcttcggagcgtagcgccagggcctgagcctttgaagcaggaggaggggaggagagagtggggctcctctatcgggaccccctccccatgtggatctgcccaggcggcggcggcggcggcggaggaggaggcgaccgagaagcgactcggaccgatg

SEQ ID NO: 756 - DNA, 203 bp, Homo sapiens
  source 1..203: mol_type = other DNA
ggcgcgccagtcctccccggactctgcctgctcctgccatggtgccgtggccctgctgggcggatggagcaggatcccaagccgccccgtctgcggctctgggccctgatcccctggcttcccaggaagcagcggcccaggatcagccagacctctctgcctgtccctggccctggctctggcccccacgactcggaccgatg

SEQ ID NO: 757 - DNA, 203 bp, Homo sapiens
  source 1..203: mol_type = other DNA
ggcgcgccagtcctaaattaacgtactatcctccttacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttcgactcggaccgatg

SEQ ID NO: 758 - DNA, 203 bp, Homo sapiens
  source 1..203: mol_type = other DNA
ggcgcgccagtcctgagctcacaatcttaaaatgtatctcctgtaatgctgggagtggggtacgagcttcctgctgtgggagggagggggacaggaagcctcgtaaggtctcaccaggtggcaagcacactggattagaagatgcaggaaagcaccttccagtctgaagatcatttaaagactcagtccgactcggaccgatg

SEQ ID NO: 759 - DNA, 203 bp, Homo sapiens
  source 1..203: mol_type = other DNA
ggcgcgccagtcctgggactaacccctgcctggcgttccgggcggcagtgcctggtccagagtccagggactcggctgcctgcacgccccgaggcggaccccggctctgactgctcccctggccgcgggcttctcgactgggacgcggcgcgaggagggagcgcggcggccccgagtctccctgagcccgactcggaccgatg

SEQ ID NO: 760 - DNA, 203 bp, Homo sapiens
  source 1..203: mol_type = other DNA
ggcgcgccagtcctgtcggccctggggctgttcaggcactcagggcaggggagaggagagactaccgtcctggagataacggttccacggaggcccaaggcgaaacggaaggatcctcatgtacaaaactgagcggaatggagctgtgagcacgcatcaggtcctcagccagcagagccacgttccttcgactcggaccgatg

SEQ ID NO: 761 - DNA, 203 bp, Homo sapiens
  source 1..203: mol_type = other DNA
ggcgcgccagtcctaatcactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctcgactcggaccgatg

SEQ ID NO: 762 - DNA, 203 bp, Homo sapiens
  source 1..203: mol_type = other DNA
ggcgcgccagtccttcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggcgactcggaccgatg

SEQ ID NO: 763 - DNA, 203 bp, Homo sapiens
  source 1..203: mol_type = other DNA
ggcgcgccagtcctagaagagcaggaaagatcccgaaaggaggaagaggtggcgaaaaatcaactgccctgctggatttgtctttctcagcaccttggcgaagccttgggtttctttcttaaaggactgatttttagaactccacatttgaggatcacagtcaccttctatatagcaccatccccaggcgactcggaccgatg

SEQ ID NO: 764 - DNA, 203 bp, Homo sapiens
  source 1..203: mol_type = other DNA
ggcgcgccagtcctagtgtcctggttactgcagcggcagcaacagcaggtcctactatcgcctccctctagtctctgcttctctggatccctgaggagggcagaaggaagaaaacagcccaaagatgagagtgattcgcgtgggtacccgcaagagccagcttgctcgcatacagacggacagtgtggcgactcggaccgatg

SEQ ID NO: 765 - DNA, 203 bp, Homo sapiens
  source 1..203: mol_type = other DNA
ggcgcgccagtcctgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaagagttcgactcggaccgatg

SEQ ID NO: 766 - DNA, 203 bp, Homo sapiens
  source 1..203: mol_type = other DNA
ggcgcgccagtcctagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgacacgactcggaccgatg

SEQ ID NO: 767 - DNA, 203 bp, Homo sapiens
  source 1..203: mol_type = other DNA
ggcgcgccagtcctagcgcgcaggcgcggccggattccgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagcgactcggaccgatg

SEQ ID NO: 768 - DNA, 203 bp, Homo sapiens
  source 1..203: mol_type = other DNA
ggcgcgccagtcctggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacaggacacgactcggaccgatg

SEQ ID NO: 769 - DNA, 203 bp, Homo sapiens
  source 1..203: mol_type = other DNA
ggcgcgccagtcctttgaggagagcttgaggagagcaggaaaggtgggacattgctgctgctgctcactcagttccacagcagcctcccccgttgcccctctggatccactgcttaaatacggacgaggacagggccctgtctcctcagcttcaggcaccaccactgacctgggacagtgaatcgacacgactcggaccgatg

SEQ ID NO: 770 - DNA, 203 bp, Homo sapiens
  source 1..203: mol_type = other DNA
ggcgcgccagtccttcacgccaccccctccaccttggacacaggacgctgtggtttctgagccaggtacaatgactcctttcgcctcccccgttgcccctctggatccactgcttaaatacggacgaggacagggccctgtctcctcagcttcaggcaccaccactgacctgggacagtgaatcgacacgactcggaccgatg

SEQ ID NO: 771 - DNA, 203 bp, Homo sapiens
  source 1..203: mol_type = other DNA
ggcgcgccagtcctcttcaggccactctcctgtgcctgccagaagagacagagcttgaggagagcttgaggagagcaggaaagcctcccccgttgcccctctggatccactgcttaaatacggacgaggacagggccctgtctcctcagcttcaggcaccaccactgacctgggacagtgaatcgacacgactcggaccgatg

SEQ ID NO: 772 - DNA, 203 bp, Homo sapiens
  source 1..203: mol_type = other DNA
ggcgcgccagtcctccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccacgactcggaccgatg

SEQ ID NO: 773 - DNA, 203 bp, Homo sapiens
  source 1..203: mol_type = other DNA
ggcgcgccagtcctagagcccgacctggttttcagccccagccccgccactgagtggctttgtgagtgcgggcaagtcactcagcctccctaggcctcagtgacttccctgaaagcaagaattccactttcttgctgttgtgatggtggtaagggaacgggcctggctctggcccctgacgcaggaaccgactcggaccgatg

SEQ ID NO: 774 - DNA, 203 bp, Homo sapiens
  source 1..203: mol_type = other DNA
ggcgcgccagtcctacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtccccgactcggaccgatg

SEQ ID NO: 775 - DNA, 203 bp, Homo sapiens
  source 1..203: mol_type = other DNA
ggcgcgccagtcctcttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgacccgactcggaccgatg

SEQ ID NO: 776 - DNA, 203 bp, Homo sapiens
  source 1..203: mol_type = other DNA
ggcgcgccagtccttacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaacgactcggaccgatg

SEQ ID NO: 777 - DNA, 203 bp, Homo sapiens
  source 1..203: mol_type = other DNA
ggcgcgccagtcctatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaaccgactcggaccgatg

SEQ ID NO: 778 - DNA, 203 bp, Homo sapiens
  source 1..203: mol_type = other DNA
ggcgcgccagtcctcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagagggtgccactacccggcttcgactcggaccgatg

SEQ ID NO: 779 - DNA, 203 bp, Homo sapiens
  source 1..203: mol_type = other DNA
ggcgcgccagtcctgagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttcgactcggaccgatg

SEQ ID NO: 780 - DNA, 203 bp, Homo sapiens
  source 1..203: mol_type = other DNA
ggcgcgccagtcctagagagtgttcaagaaggaagtgtatcttcatacatcaccacacctgaaagcagcaccaaagcagccataaacaatatgtaaataaacagatgtggctgtattccagtacaactttacctacaaaaacaggcatcagaccagcttgccaacttgtggcatagactgtttgctaccgactcggaccgatg

SEQ ID NO: 781 - DNA, 203 bp, Homo sapiens
  source 1..203: mol_type = other DNA
ggcgcgccagtcctctaaggcactgagcgtatcatgttaaagatgagcgggtggcagcgacagagccaaaatcagagctggaacctgaggagagagtgttcaagaaggaagtgtatcttcatacatcaccacacctgaaagcaggcatcagaccagcttgccaacttgtggcatagactgtttgctaccgactcggaccgatg

SEQ ID NO: 782 - DNA, 203 bp, Homo sapiens
  source 1..203: mol_type = other DNA
ggcgcgccagtcctgggggaacgcgggagtcgggcccgacctgagccacgcgggcttggtgcccacctgtgcgcgccgcctgcgaagaaggaacggtctggggagaaggcgccgccggccgcccccgtccccaccgcggccgtcgctggagagttcgagccgcctagcgcccctggagctccccaacccgactcggaccgatg

SEQ ID NO: 783 - DNA, 203 bp, Homo sapiens
  source 1..203: mol_type = other DNA
ggcgcgccagtcctactgccgcggccctgctgctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctgcgactcggaccgatg

SEQ ID NO: 784 - DNA, 203 bp, Homo sapiens
  source 1..203: mol_type = other DNA
ggcgcgccagtcctgaccggaggagcggggccgggagctgcgaggagccctccagacgtcgccgagcgcgagggcgggcgtgctcggagtggtcgctcgtcagccgccgcccctcagtctccgcacttgcaggtcccctccctctccgccgggacgcgggagagcccggctcgcggcgggggcggccacgactcggaccgatg

SEQ ID NO: 785 - DNA, 203 bp, Homo sapiens
  source 1..203: mol_type = other DNA
ggcgcgccagtcctagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctacccgactcggaccgatg

SEQ ID NO: 786 - DNA, 203 bp, Homo sapiens
  source 1..203: mol_type = other DNA
ggcgcgccagtcctgtttctggacccggccaccccccgcgtccgcaccgccgcccccgagggacgagtgacagcggccgccgcgctcggtccagtcttcccggctggaaggtattgttgcagcatctggcagtgagactgaggatgaggacagcatggacattcccttggacctttcttcatccgctgcgactcggaccgatg

SEQ ID NO: 787 - DNA, 203 bp, Homo sapiens
  source 1..203: mol_type = other DNA
ggcgcgccagtcctacatctcccggcaggctgcggaagggggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcacgactcggaccgatg

SEQ ID NO: 788 - DNA, 203 bp, Homo sapiens
  source 1..203: mol_type = other DNA
ggcgcgccagtcctggctgtttcctggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacacgactcggaccgatg

SEQ ID NO: 789 - DNA, 203 bp, Homo sapiens
  source 1..203: mol_type = other DNA
ggcgcgccagtccttcgtttacctcttcattctactctaaaggcatcgttattaggaaaatcctgttgtgaataagaaggattccacagatcacataccagagcggttttgcctcagctgctctcaactttgtaatcttgtgaagaagctgacaagcttggctgattgcagtgcactatgaggactgacgactcggaccgatg

SEQ ID NO: 790 - DNA, 203 bp, Homo sapiens
  source 1..203: mol_type = other DNA
ggcgcgccagtcctaggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgccgactcggaccgatg

SEQ ID NO: 791 - DNA, 203 bp, Homo sapiens
  source 1..203: mol_type = other DNA
ggcgcgccagtcctacaatcctttgcggtggttcaagatggcggcgcccagtggcactgtgagcgattcggaaagtagtaacagcagtagcgatgcggaggagctggagcggtgccgcgaggcggcaatgccggcttggggcttggagcaacgcccgcacgtggcagggaagccaagagccggtgctgcgactcggaccgatg

SEQ ID NO: 792 - DNA, 203 bp, Homo sapiens
  source 1..203: mol_type = other DNA
ggcgcgccagtcctggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggccgactcggaccgatg

SEQ ID NO: 793 - DNA, 203 bp, Homo sapiens
  source 1..203: mol_type = other DNA
ggcgcgccagtcctatttataagcaatagtagcttatttggctcacagttctggaggctgagaagatcgtgaggctgcatctggcaagggccttcttgctgcttcataacatggcagaagacatcatgcgggtgtgtgtctggggaagagacttacagaagtggagttgctgagtcaaagatctaacccgactcggaccgatg

SEQ ID NO: 794 - DNA, 203 bp, Homo sapiens
  source 1..203: mol_type = other DNA
ggcgcgccagtcctatgtctggccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttcgactcggaccgatg

SEQ ID NO: 795 - DNA, 203 bp, Homo sapiens
  source 1..203: mol_type = other DNA
ggcgcgccagtcctgtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttccgactcggaccgatg

SEQ ID NO: 796 - DNA, 203 bp, Homo sapiens
  source 1..203: mol_type = other DNA
ggcgcgccagtcctggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttccgactcggaccgatg

SEQ ID NO: 797 - DNA, 203 bp, Homo sapiens
  source 1..203: mol_type = other DNA
ggcgcgccagtcctctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacgactcggaccgatg

SEQ ID NO: 798 - DNA, 203 bp, Homo sapiens
  source 1..203: mol_type = other DNA
ggcgcgccagtcctgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatccgactcggaccgatg

SEQ ID NO: 799 - DNA, 203 bp, Homo sapiens
  source 1..203: mol_type = other DNA
ggcgcgccagtcctcctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaacgactcggaccgatg

SEQ ID NO: 800 - DNA, 203 bp, Homo sapiens
  source 1..203: mol_type = other DNA
ggcgcgccagtcctgctccgctgaatccgcccgcgcgtcgccgccgtcgtcgccgccccccgtcccggcccccctgggttccctcagcccagccctgtccagcccggttcccgggaggatgaagttcgtgtacaaagaagagcatccgttcgagaagcgccgctctgagggcgagaagatccgaaagacgactcggaccgatg

SEQ ID NO: 801 - DNA, 203 bp, Homo sapiens
  source 1..203: mol_type = other DNA
ggcgcgccagtcctgagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtggcgactcggaccgatg

SEQ ID NO: 802 - DNA, 203 bp, Homo sapiens
  source 1..203: mol_type = other DNA
ggcgcgccagtccttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgataccgactcggaccgatg

SEQ ID NO: 803 - DNA, 203 bp, Homo sapiens
  source 1..203: mol_type = other DNA
ggcgcgccagtcctataagctgggtcccgatgccgcgagcggaatctcggcgctcccggaagtggcctgaaggccgcgcgccagtcccgagcagtgctcgctcctgctcggggcgctgcggccccgggcgtcgccatgaccagtgagctggacatcttcgtggggaacacgacccttatcgacgaggacgactcggaccgatg

SEQ ID NO: 804 - DNA, 203 bp, Homo sapiens
  source 1..203: mol_type = other DNA
ggcgcgccagtcctagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagccccgactcggaccgatg

SEQ ID NO: 805 - DNA, 203 bp, Homo sapiens
  source 1..203: mol_type = other DNA
ggcgcgccagtcctgggcacgagggcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagcgactcggaccgatg

SEQ ID NO: 806 - DNA, 203 bp, Homo sapiens
  source 1..203: mol_type = other DNA
ggcgcgccagtcctggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaatcgactcggaccgatg

SEQ ID NO: 807 - DNA, 203 bp, Homo sapiens
  source 1..203: mol_type = other DNA
ggcgcgccagtcctgggcgcagagctggcgctctagcccacggagttggttaactcctctcaccggcccctggaaagggttccaagtcctttagtacccgacgctgtctgggaattccgggcgtttcggctccttggtcgcagaggcaggaggcacccgaccgcatgtctgtcatggacctcgccaatcgactcggaccgatg

SEQ ID NO: 808 - DNA, 203 bp, Homo sapiens
  source 1..203: mol_type = other DNA
ggcgcgccagtcctgccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcacgactcggaccgatg

SEQ ID NO: 809 - DNA, 203 bp, Homo sapiens
  source 1..203: mol_type = other DNA
ggcgcgccagtcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggcgactcggaccgatg

SEQ ID NO: 810 - DNA, 203 bp, Homo sapiens
  source 1..203: mol_type = other DNA
ggcgcgccagtcctgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagcgactcggaccgatg

SEQ ID NO: 811 - DNA, 203 bp, Homo sapiens
  source 1..203: mol_type = other DNA
ggcgcgccagtcctcgttgctgcccggaggctcctacgccacggcccgtcgggcccggcgccggaagtgagctgttccgaggcgccgccgggagctgccacgtccgagacctggagcagccaccgccgcaatcatggtgtcagtaattaacactgtggatacctcccatgaggacatgattcacgacgcgactcggaccgatg

SEQ ID NO: 812 - DNA, 203 bp, Homo sapiens
  source 1..203: mol_type = other DNA
ggcgcgccagtccttgagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcgactcggaccgatg

SEQ ID NO: 813 - DNA, 203 bp, Homo sapiens
  source 1..203: mol_type = other DNA
ggcgcgccagtcctcacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcccgactcggaccgatg

SEQ ID NO: 814 - DNA, 203 bp, Homo sapiens
  source 1..203: mol_type = other DNA
ggcgcgccagtcctgcatttggggctgaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtccgactcggaccgatg

SEQ ID NO: 815 - DNA, 203 bp, Homo sapiens
  source 1..203: mol_type = other DNA
ggcgcgccagtcctcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccacccgactcggaccgatg

SEQ ID NO: 816 - DNA, 203 bp, Homo sapiens
  source 1..203: mol_type = other DNA
ggcgcgccagtcctggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcacgactcggaccgatg

SEQ ID NO: 817 - DNA, 203 bp, Homo sapiens
  source 1..203: mol_type = other DNA
ggcgcgccagtcctgcggcatgggcagtatccgccgccatcctcttccgtgaggcgcgctgagaccgggaccggccctcctgagaggatgccggtgcgggcgcccgcggagagggacccgtcgccatgggccgtgtgatccgtggacagaggaagggcgccgggtctgtgttccgcgcgcacgtgaagcgactcggaccgatg

SEQ ID NO: 818 - DNA, 203 bp, Homo sapiens
  source 1..203: mol_type = other DNA
ggcgcgccagtcctcctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattcgactcggaccgatg

SEQ ID NO: 819 - DNA, 203 bp, Homo sapiens
  source 1..203: mol_type = other DNA
ggcgcgccagtcctccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaagtgaaacccccgcccctgaagacgactcggaccgatg

SEQ ID NO: 820 - DNA, 203 bp, Homo sapiens
  source 1..203: mol_type = other DNA
ggcgcgccagtcctcgaaaaagaagcagtcctgggctgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgactcggaccgatg

SEQ ID NO: 821 - DNA, 203 bp, Homo sapiens
  source 1..203: mol_type = other DNA
ggcgcgccagtcctgatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaacgactcggaccgatg

SEQ ID NO: 822 - DNA, 203 bp, Homo sapiens
  source 1..203: mol_type = other DNA
ggcgcgccagtcctcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgaccgactcggaccgatg

SEQ ID NO: 823 - DNA, 203 bp, Homo sapiens
  source 1..203: mol_type = other DNA
ggcgcgccagtccttccaggttcacacaactggaacccatctccaggaacaaacagctggaacccatctcccgttgaagggaaactgccagatttttgtaagattcttcctcctgggcacctctaagatactgatggctctgcagaggacccattcattgcttctgcttttgctgctgaccctgctggcgactcggaccgatg

SEQ ID NO: 824 - DNA, 203 bp, Homo sapiens
  source 1..203: mol_type = other DNA
ggcgcgccagtcctacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcgactcggaccgatg

SEQ ID NO: 825 - DNA, 203 bp, Homo sapiens
  source 1..203: mol_type = other DNA
ggcgcgccagtcctcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtcgactcggaccgatg

SEQ ID NO: 826 - DNA, 203 bp, Homo sapiens
  source 1..203: mol_type = other DNA
ggcgcgccagtccttcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcacgactcggaccgatg

SEQ ID NO: 827 - DNA, 203 bp, Homo sapiens
  source 1..203: mol_type = other DNA
ggcgcgccagtcctccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggcccgactcggaccgatg

SEQ ID NO: 828 - DNA, 203 bp, Homo sapiens
  source 1..203: mol_type = other DNA
ggcgcgccagtcctgggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattcgactcggaccgatg

SEQ ID NO: 829 - DNA, 203 bp, Homo sapiens
  source 1..203: mol_type = other DNA
ggcgcgccagtcctggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcacgactcggaccgatg

SEQ ID NO: 830 - DNA, 203 bp, Homo sapiens
  source 1..203: mol_type = other DNA
ggcgcgccagtcctaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccacccgactcggaccgatg

SEQ ID NO: 831 - DNA, 203 bp, Homo sapiens
  source 1..203: mol_type = other DNA
ggcgcgccagtcctgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggcgactcggaccgatg

SEQ ID NO: 832 - DNA, 203 bp, Homo sapiens
  source 1..203: mol_type = other DNA
ggcgcgccagtcctgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtccgactcggaccgatg

SEQ ID NO: 833 - DNA, 203 bp, Homo sapiens
  source 1..203: mol_type = other DNA
ggcgcgccagtccttcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactaccgactcggaccgatg

SEQ ID NO: 834 - DNA, 203 bp, Homo sapiens
  source 1..203: mol_type = other DNA
ggcgcgccagtcctcgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattcgactcggaccgatg

SEQ ID NO: 835 - DNA, 203 bp, Homo sapiens
  source 1..203: mol_type = other DNA
ggcgcgccagtcctgatccacaagtatatcctgagttcacttacctcttgggtggcagcacacatcggtccaccctgcttgtccagaaactgttaagagttggaagttcagaagaaaaaaaaaaggaattgaatgatctggcacgggaccctccagcacagtgttcagcaggtcctgttggagatgatcgactcggaccgatg

SEQ ID NO: 836 - DNA, 203 bp, Homo sapiens
  source 1..203: mol_type = other DNA
ggcgcgccagtcctgactgtctacattagtaattcccaacttgggtccgaaagtgaacttttgctgaagcgaagtagctaaccgcttccatgtgcaaggcaggttccagacttcggggtgaggaggattaactgaaggaccccaggggaaccggtgtgctcactgatccgcctccagggccaccgccacgactcggaccgatg

SEQ ID NO: 837 - DNA, 203 bp, Homo sapiens
  source 1..203: mol_type = other DNA
ggcgcgccagtcctacgcggtgccgcggggcgggagtagaggcggagggaggggacacgggctcattgcggtgtgcgccctgcactctgtccctcactcgccgccgacgacctgtctcgccgagcgcacgccttgccgccgccccgcagaaatgcttcggttacccacagtctttcgccagatgagaccgactcggaccgatg

SEQ ID NO: 838 - DNA, 203 bp, Homo sapiens
  source 1..203: mol_type = other DNA
ggcgcgccagtcctcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaacgactcggaccgatg

SEQ ID NO: 839 - DNA, 203 bp, Homo sapiens
  source 1..203: mol_type = other DNA
ggcgcgccagtcctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcacgactcggaccgatg

SEQ ID NO: 840 - DNA, 203 bp, Homo sapiens
  source 1..203: mol_type = other DNA
ggcgcgccagtcctggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactcggaccgatg

SEQ ID NO: 841 - DNA, 203 bp, Homo sapiens
  source 1..203: mol_type = other DNA
ggcgcgccagtcctgccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgcgactcggaccgatg

SEQ ID NO: 842 - DNA, 203 bp, Homo sapiens
  source 1..203: mol_type = other DNA
ggcgcgccagtcctaggcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacgactcggaccgatg

SEQ ID NO: 843 - DNA, 203 bp, Homo sapiens
  source 1..203: mol_type = other DNA
ggcgcgccagtcctagcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacgactcggaccgatg

SEQ ID NO: 844 - DNA, 203 bp, Homo sapiens
  source 1..203: mol_type = other DNA
ggcgcgccagtcctctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggagcgactcggaccgatg

SEQ ID NO: 845 - DNA, 203 bp, Homo sapiens
  source 1..203: mol_type = other DNA
ggcgcgccagtcctcgggcgggtgtggccaggggtgtgggtctgtgagggaccggtcggaagggcgtcgcgcggcctcgggtgacatgcggggggcggcgagcgcgagtgtccgcgagccgacgccgctcccgggtagaggcgccccccgcacaaagccccgggcgggccgaggcccgactgtagggacgactcggaccgatg

SEQ ID NO: 846 - DNA, 203 bp, Homo sapiens
  source 1..203: mol_type = other DNA
ggcgcgccagtccttccgcttccgtccacttggcgagtgagacgctgatgggaggatggacgtactggtgtctgagtgctccgcgcggctgctgcagcaggaagaagagattaaatctctgactgctgaaattgaccggttgaaaaactgtggctgtttaggagcttctccaaatttggagcagttaccgactcggaccgatg

SEQ ID NO: 847 - DNA, 203 bp, Homo sapiens
  source 1..203: mol_type = other DNA
ggcgcgccagtcctgggtagccgactggggtctcctggcgacgaccatggcgggggatgtgggcggtcgcagctgcacggactcggaactgctgctgcacccggagctgctgtcccaggagttccttctcctcactctggagcagaagaacatagctgttgaaactgatgtaagagtaaacaaagacacgactcggaccgatg

SEQ ID NO: 848 - DNA, 203 bp, Homo sapiens
  source 1..203: mol_type = other DNA
ggcgcgccagtcctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgcgactcggaccgatg

SEQ ID NO: 849 - DNA, 203 bp, Homo sapiens
  source 1..203: mol_type = other DNA
ggcgcgccagtcctgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggacgactcggaccgatg

SEQ ID NO: 850 - DNA, 203 bp, Homo sapiens
  source 1..203: mol_type = other DNA
ggcgcgccagtcctgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagcccgactcggaccgatg

SEQ ID NO: 851 - DNA, 203 bp, Homo sapiens
  source 1..203: mol_type = other DNA
ggcgcgccagtcctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcgactcggaccgatg

SEQ ID NO: 852 - DNA, 203 bp, Homo sapiens
  source 1..203: mol_type = other DNA
ggcgcgccagtcctgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaagctgagatctgtatctgtggacctgaatgttgatccctcgactcggaccgatg

SEQ ID NO: 853 - DNA, 203 bp, Homo sapiens
  source 1..203: mol_type = other DNA
ggcgcgccagtcctgacggagggaggactcgggacagggaattggccctgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggcgactcggaccgatg

SEQ ID NO: 854 - DNA, 203 bp, Homo sapiens
  source 1..203: mol_type = other DNA
ggcgcgccagtcctccgtgagtctgaccttaggtgtctcgtgtctggggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagtcgactcggaccgatg

SEQ ID NO: 855 - DNA, 203 bp, Homo sapiens
  source 1..203: mol_type = other DNA
ggcgcgccagtcctagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgccgactcggaccgatg

SEQ ID NO: 856 - DNA, 203 bp, Homo sapiens
  source 1..203: mol_type = other DNA
ggcgcgccagtcctcagaggtcagacggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagccgactcggaccgatg

SEQ ID NO: 857 - DNA, 203 bp, Homo sapiens
  source 1..203: mol_type = other DNA
ggcgcgccagtcctgggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggacccgactcggaccgatg

SEQ ID NO: 858 - DNA, 203 bp, Homo sapiens
  source 1..203: mol_type = other DNA
ggcgcgccagtcctggagcctggaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgacgactcggaccgatg

SEQ ID NO: 859 - DNA, 203 bp, Homo sapiens
  source 1..203: mol_type = other DNA
ggcgcgccagtcctaaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagacgactcggaccgatg

SEQ ID NO: 860 - DNA, 203 bp, Homo sapiens
  source 1..203: mol_type = other DNA
ggcgcgccagtcctgcgcactcagggtctgaggcagctagtagccggagggtcaccatgaagttcaatcccttcgttacctgggaccgcagtaaaaaccgcaaacgtcacttcaatgccccctcacacgtgcgcaggaagatcatgtcatccccgctctccaaggagctgcggcagaagtacaatgtccgactcggaccgatg

SEQ ID NO: 861 - DNA, 203 bp, Homo sapiens
  source 1..203: mol_type = other DNA
ggcgcgccagtcctctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtgcgactcggaccgatg

SEQ ID NO: 862 - DNA, 203 bp, Homo sapiens
  source 1..203: mol_type = other DNA
ggcgcgccagtcctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgccgactcggaccgatg

SEQ ID NO: 863 - DNA, 203 bp, Homo sapiens
  source 1..203: mol_type = other DNA
ggcgcgccagtcctaatccagaggcaggggagggacggtgcaggcgcagagtattgggtttggctggcctcgatttaaagagacagaagctgtcggggtcctggaagacggtccccaataccctccccccaagtccttgggaccacttgggtccccagagctggggagatggtttgtggcggctttgccgactcggaccgatg

SEQ ID NO: 864 - DNA, 203 bp, Homo sapiens
  source 1..203: mol_type = other DNA
ggcgcgccagtcctcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgccgactcggaccgatg

SEQ ID NO: 865 - DNA, 203 bp, Homo sapiens
  source 1..203: mol_type = other DNA
ggcgcgccagtcctatgtctggtcgtggcaaacaaggaggcaaggcccgcgccaaggccaagtcgcgctcgtcccgcgctggcctccagttcccggtagggcgagtgcaccgcttgctgcgcaaaggcaactacgcggagcgggtgggggcccgcgcgcccgtctacatggcggcggtcctcgagtaccgactcggaccgatg

SEQ ID NO: 866 - DNA, 203 bp, Homo sapiens
  source 1..203: mol_type = other DNA
ggcgcgccagtccttctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaacccgactcggaccgatg

SEQ ID NO: 867 - DNA, 203 bp, Homo sapiens
  source 1..203: mol_type = other DNA
ggcgcgccagtccttcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaacgactcggaccgatg

SEQ ID NO: 868 - DNA, 203 bp, Homo sapiens
  source 1..203: mol_type = other DNA
ggcgcgccagtcctgcccggaaacggaagtctcgttctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagccccgactcggaccgatg

SEQ ID NO: 869 - DNA, 203 bp, Homo sapiens
  source 1..203: mol_type = other DNA
ggcgcgccagtcctcagaggcagcggttggaggcgcggtgggtgtctgcgggggtctcgcggggcggctgcggtgtttcaccgggaaaggctcgaggagagcgcggctcacgagagataacccagctgtgctccctggaaccttcaatttcaaggcctccctgcctctactaggcgccttagctcactcgactcggaccgatg

SEQ ID NO: 870 - DNA, 203 bp, Homo sapiens
  source 1..203: mol_type = other DNA
ggcgcgccagtcctgcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccccgactcggaccgatg

SEQ ID NO: 871 - DNA, 203 bp, Homo sapiens
  source 1..203: mol_type = other DNA
ggcgcgccagtccttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctcgactcggaccgatg

SEQ ID NO: 872 - DNA, 203 bp, Homo sapiens
  source 1..203: mol_type = other DNA
ggcgcgccagtcctaagaatcgcgggcctgtctgcaagacttgagttcaggactcccaatccttcgccatccgaacctggagggcatccagtcgacacctacaggggtcggacatgtccaaggctaactgagaggccttccagacgcttcatttttgttgtttgggtttgcggcagggcacaaagaggcgactcggaccgatg

SEQ ID NO: 873 - DNA, 203 bp, Homo sapiens
  source 1..203: mol_type = other DNA
ggcgcgccagtcctagaggaacagggccctggagcacctggtttcggggacagtagggttggtgggagttgcgatgatattgccacctacctcttacatcttttagtctgtctgctatcagctatgccgctgcccgttgcgctgcagacccgcttggccaagagaggcatcctcaaacatctggagcccgactcggaccgatg

SEQ ID NO: 874 - DNA, 203 bp, Homo sapiens
  source 1..203: mol_type = other DNA
ggcgcgccagtcctctcattgacttccttcctgttctaactgccagtactcagaagtcagagttgagagacagaggcaccccggacagagacgtgaagcactgaataaatagatcagaatgactgaaaaagccccagagccacatgtggaggaggatgatgatgatgagctggacagcaagctcaattcgactcggaccgatg

SEQ ID NO: 875 - DNA, 203 bp, Homo sapiens
  source 1..203: mol_type = other DNA
ggcgcgccagtccttctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagcccgactcggaccgatg

SEQ ID NO: 876 - DNA, 203 bp, Homo sapiens
  source 1..203: mol_type = other DNA
ggcgcgccagtcctggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatccgactcggaccgatg

SEQ ID NO: 877 - DNA, 203 bp, Homo sapiens
  source 1..203: mol_type = other DNA
ggcgcgccagtcctactaagaccgcaaggcattcatttcctcctacggtggatgcggacgccgggaggaggagagccccagagagaggagctgggagcggaggcgcagagaacacgtagcgactccgaagatcagccccaatgaacatgtcagtgttgactttacaagaatatgaattcgaaaagcagcgactcggaccgatg

SEQ ID NO: 878 - DNA, 203 bp, Homo sapiens
  source 1..203: mol_type = other DNA
ggcgcgccagtcctaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagcgactcggaccgatg

SEQ ID NO: 879 - DNA, 203 bp, Homo sapiens
  source 1..203: mol_type = other DNA
ggcgcgccagtcctccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccgactcggaccgatg

SEQ ID NO: 880 - DNA, 203 bp, Homo sapiens
  source 1..203: mol_type = other DNA
ggcgcgccagtcctgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgaccgactcggaccgatg

SEQ ID NO: 881 - DNA, 203 bp, Homo sapiens
  source 1..203: mol_type = other DNA
ggcgcgccagtcctagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagccgactcggaccgatg

SEQ ID NO: 882 - DNA, 203 bp, Homo sapiens
  source 1..203: mol_type = other DNA
ggcgcgccagtcctgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatcgactcggaccgatg

SEQ ID NO: 883 - DNA, 203 bp, Homo sapiens
  source 1..203: mol_type = other DNA
ggcgcgccagtcctaacgagacatctagtacggggctcacaggtaacagaactctgatcagatccgccccggctcccacacagctataaggttgcctgcctgcctgcacagaaatgacgaaggacaaaaacagcccagggctgaagaaaaagtcccagtcggtggatattaatgctccagggttcaaccgactcggaccgatg

SEQ ID NO: 884 - DNA, 203 bp, Homo sapiens
  source 1..203: mol_type = other DNA
ggcgcgccagtcctcgccgctcaccgcagccccctcctggcgacccgcaagtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcacgactcggaccgatg

SEQ ID NO: 885 - DNA, 203 bp, Homo sapiens
  source 1..203: mol_type = other DNA
ggcgcgccagtcctgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccgactcggaccgatg

SEQ ID NO: 886 - DNA, 203 bp, Homo sapiens
  source 1..203: mol_type = other DNA
ggcgcgccagtcctttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctcgactcggaccgatg

SEQ ID NO: 887 - DNA, 203 bp, Homo sapiens
  source 1..203: mol_type = other DNA
ggcgcgccagtcctgaggcggccccacgctgctttcccagaaggctgtgcgtgctcctcgcttcctccgcggtcttccgagcggtcgcgtgaactgcttcctgcaggctggccatggcgcttcacgttcccaaggctccgggctttgcccagatgctcaaggagggagcgaaacacttttcaggattacgactcggaccgatg

SEQ ID NO: 888 - DNA, 203 bp, Homo sapiens
  source 1..203: mol_type = other DNA
ggcgcgccagtcctgcagggagctgggacagtcctgggtcaggcaaggactctgtgatgcttccctgctccctcgcctttctctgcatctgatcctgggatgtcctagccaccatggctttccagctgagcaggatcatgcggccagatgatgccaacgtggccggcaatgtccacggggggaccatccgactcggaccgatg

SEQ ID NO: 889 - DNA, 203 bp, Homo sapiens
  source 1..203: mol_type = other DNA
ggcgcgccagtcctgggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacgactcggaccgatg

SEQ ID NO: 890 - DNA, 203 bp, Homo sapiens
  source 1..203: mol_type = other DNA
ggcgcgccagtccttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcgcgactcggaccgatg

SEQ ID NO: 891 - DNA, 203 bp, Homo sapiens
  source 1..203: mol_type = other DNA
ggcgcgccagtcctctcacgtgacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgccgactcggaccgatg

SEQ ID NO: 892 - DNA, 203 bp, Homo sapiens
  source 1..203: mol_type = other DNA
ggcgcgccagtcctagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggcgactcggaccgatg

SEQ ID NO: 893 - DNA, 203 bp, Homo sapiens
  source 1..203: mol_type = other DNA
ggcgcgccagtcctccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttcctccttctgcgcggctgcagctcgggacttcggcctgacccagccccccgactcggaccgatg

SEQ ID NO: 894 - DNA, 203 bp, Homo sapiens
  source 1..203: mol_type = other DNA
ggcgcgccagtcctccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgccgactcggaccgatg

SEQ ID NO: 895 - DNA, 203 bp, Homo sapiens
  source 1..203: mol_type = other DNA
ggcgcgccagtcctgcctgtgctgtgcctgcctcctagagctcattccctacgccccgactctgtcctggacagcgtgcccaccagccatggcggggccccggggcctcctcccactctgcctcctggccttctgcctggcaggcttcagcttcgtcagggggcaggtgctgttcaaaggctgtgatgcgactcggaccgatg

SEQ ID NO: 896 - DNA, 203 bp, Homo sapiens
  source 1..203: mol_type = other DNA
ggcgcgccagtcctaagggaggaggcgccgagctgaccgggcgacgccgcgggaggttctggaaacgccgggagctgcgagtgtccagacacttccctctgtgaccatgaaactctgggtgtctgcattgctgatggcctggtttggtgtcctgagctgtgtgcaggccgaattcttcacctctattgcgactcggaccgatg

SEQ ID NO: 897 - DNA, 203 bp, Homo sapiens
  source 1..203: mol_type = other DNA
ggcgcgccagtcctatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatccgactcggaccgatg

SEQ ID NO: 898 - DNA, 203 bp, Homo sapiens
  source 1..203: mol_type = other DNA
ggcgcgccagtcctgacgagacaccgaagcagaggatacaggaggattaaaggattcaggaaagcaagcagccctccggagaagctgtcgaaattcaagactggcaagagaagcaaattcaacctctcacaccgatcatttctcattccctgaaaagaagagattgtttccccagggaagtgaaaatacgactcggaccgatg

SEQ ID NO: 899 - DNA, 203 bp, Homo sapiens
  source 1..203: mol_type = other DNA
ggcgcgccagtcctgttttgcctgcacgatgtccagcaaagctgagaagaagcagcgattgagtggccgaggaagctcccaggcaagctggtcagggcgggccactcgggctgctgtggccacacaggagcaggggaatgccccggctgtcagtgagccagagctgcaggctgagctccccaaggaggcgactcggaccgatg

SEQ ID NO: 900 - DNA, 203 bp, Homo sapiens
  source 1..203: mol_type = other DNA
ggcgcgccagtccttttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggcgactcggaccgatg

SEQ ID NO: 901 - DNA, 203 bp, Homo sapiens
  source 1..203: mol_type = other DNA
ggcgcgccagtcctgttcgctgcagcatcctcaggcttcacgttggagcctcttgattgtggtgttcagcattatttaagatcacctatgcatcatctgaagccacagtcccaggtcatcttcatcaccttccccagtggaatgcctcctgtgttaaagcccacaacaacccctgtggaggaacaacccgactcggaccgatg

SEQ ID NO: 902 - DNA, 203 bp, Homo sapiens
  source 1..203: mol_type = other DNA
ggcgcgccagtcctgagaactcacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcacgactcggaccgatg

SEQ ID NO: 903 - DNA, 203 bp, Homo sapiens
  source 1..203: mol_type = other DNA
ggcgcgccagtcctgggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccgactcggaccgatg

SEQ ID NO: 904 - DNA, 203 bp, Homo sapiens
  source 1..203: mol_type = other DNA
ggcgcgccagtcctctccccccgctaccctaactttgccaggcaccttttcccttccatccatcttaaaggaaggaagggacgggctgagttccccgacgagagacacacccagattttcctgcagcttggggagaggtcctcccaggagccttggtccctcctggcctgccggagtccttagccaggcgactcggaccgatg

SEQ ID NO: 905 - DNA, 203 bp, Homo sapiens
  source 1..203: mol_type = other DNA
ggcgcgccagtccttgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagccccgactcggaccgatg

SEQ ID NO: 906 - DNA, 203 bp, Homo sapiens
  source 1..203: mol_type = other DNA
ggcgcgccagtcctgcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggcgactcggaccgatg

SEQ ID NO: 907 - DNA, 203 bp, Homo sapiens
  source 1..203: mol_type = other DNA
ggcgcgccagtcctgcggcagtatagagagtacctcacgaaggggacgtgggaaagtgttagcggggaacgctgggaaactcccggcctccgccaccatcttgctttcctttaatccggcagtgaccgtgtgtcagaacaatcttgaatcatgaagctactaaccagagccggctctttctcgagattcgactcggaccgatg

SEQ ID NO: 908 - DNA, 203 bp, Homo sapiens
  source 1..203: mol_type = other DNA
ggcgcgccagtcctccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaacgactcggaccgatg

SEQ ID NO: 909 - DNA, 203 bp, Homo sapiens
  source 1..203: mol_type = other DNA
ggcgcgccagtcctcaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgccgactcggaccgatg

SEQ ID NO: 910 - DNA, 203 bp, Homo sapiens
  source 1..203: mol_type = other DNA
ggcgcgccagtcctgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgaaagcaacccgactcggaccgatg

SEQ ID NO: 911 - DNA, 203 bp, Homo sapiens
  source 1..203: mol_type = other DNA
ggcgcgccagtcctctggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagaccgactcggaccgatg

SEQ ID NO: 912 - DNA, 203 bp, Homo sapiens
  source 1..203: mol_type = other DNA
ggcgcgccagtcctccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagccgactcggaccgatg

SEQ ID NO: 913 - DNA, 203 bp, Homo sapiens
  source 1..203: mol_type = other DNA
ggcgcgccagtcctgccgcggccgacggtagttcgcttccccgagagtgcgcggaggcccgggtgcgaggagggcctgtttctcttcagccctggttcattcacctcggggaccgagggccccgccgtcaggagccggcgaccgtgccctggtgcgagctgtgatggtcattgtcctccagagcagtgcgactcggaccgatg

SEQ ID NO: 914 - DNA, 203 bp, Homo sapiens
  source 1..203: mol_type = other DNA
ggcgcgccagtcctcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgcccgactcggaccgatg

SEQ ID NO: 915 - DNA, 203 bp, Homo sapiens
  source 1..203: mol_type = other DNA
ggcgcgccagtcctctcctgggcccctcctcccttcaaggattgcgaagaactggtcgcaaatcctcctaagccaccagcatctcggtcttcagctcacaccagccttgagcccagcctgcggccaggggaccacgcacgtcccacccacccagcgactccccagccgctgcccactcttcctcactccgactcggaccgatg

SEQ ID NO: 916 - DNA, 203 bp, Homo sapiens
  source 1..203: mol_type = other DNA
ggcgcgccagtcctctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagccgactcggaccgatg

SEQ ID NO: 917 - DNA, 203 bp, Homo sapiens
  source 1..203: mol_type = other DNA
ggcgcgccagtcctggggtccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtatcgactcggaccgatg

SEQ ID NO: 918 - DNA, 203 bp, Homo sapiens
  source 1..203: mol_type = other DNA
ggcgcgccagtcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacacgactcggaccgatg

SEQ ID NO: 919 - DNA, 203 bp, Homo sapiens
  source 1..203: mol_type = other DNA
ggcgcgccagtccttcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagcgactcggaccgatg

SEQ ID NO: 920 - DNA, 203 bp, Homo sapiens
  source 1..203: mol_type = other DNA
ggcgcgccagtcctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaacgactcggaccgatg

SEQ ID NO: 921 - DNA, 203 bp, Homo sapiens
  source 1..203: mol_type = other DNA
ggcgcgccagtcctgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatcgactcggaccgatg

SEQ ID NO: 922 - DNA, 203 bp, Homo sapiens
  source 1..203: mol_type = other DNA
ggcgcgccagtccttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgccgactcggaccgatg

SEQ ID NO: 923 - DNA, 203 bp, Homo sapiens
  source 1..203: mol_type = other DNA
ggcgcgccagtcctgccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagcgactcggaccgatg

SEQ ID NO: 924 - DNA, 203 bp, Homo sapiens
  source 1..203: mol_type = other DNA
ggcgcgccagtcctttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggcgactcggaccgatg

SEQ ID NO: 925 - DNA, 203 bp, Homo sapiens
  source 1..203: mol_type = other DNA
ggcgcgccagtcctgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtcgactcggaccgatg

SEQ ID NO: 926 - DNA, 203 bp, Homo sapiens
  source 1..203: mol_type = other DNA
ggcgcgccagtcctgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttggggggaagtaattccggttgttgcaccatgcgactcggaccgatg

SEQ ID NO: 927 - DNA, 203 bp, Homo sapiens
  source 1..203: mol_type = other DNA
ggcgcgccagtcctttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagcgactcggaccgatg

SEQ ID NO: 928 - DNA, 203 bp, Homo sapiens
  source 1..203: mol_type = other DNA
ggcgcgccagtcctcccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggcgactcggaccgatg

SEQ ID NO: 929 - DNA, 203 bp, Homo sapiens
  source 1..203: mol_type = other DNA
ggcgcgccagtcctagagccggcgccgtcaccgcccgcattgccgctcccagtcccgcgctcggcacgacatgaaatcccccgacgaggtgctacgcgagggcgagttggagaagcgcagcgacagcctcttccagctatggaagaagaagcgcggggtgctcacctccgaccgcctgagcctgttcccgactcggaccgatg

SEQ ID NO: 930 - DNA, 203 bp, Homo sapiens
  source 1..203: mol_type = other DNA
ggcgcgccagtcctggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgcgactcggaccgatg

SEQ ID NO: 931 - DNA, 203 bp, Homo sapiens
  source 1..203: mol_type = other DNA
ggcgcgccagtccttccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaacgactcggaccgatg

SEQ ID NO: 932 - DNA, 203 bp, Homo sapiens
  source 1..203: mol_type = other DNA
ggcgcgccagtccttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggcgactcggaccgatg

SEQ ID NO: 933 - DNA, 203 bp, Homo sapiens
  source 1..203: mol_type = other DNA
ggcgcgccagtcctttgttcgcattataaaaggcacgcgcgggcgcgaggcccttctctcgccaggcgtcctcgtggaaggcccgggaccgcgggatgggtgtcggcgtgaccaggcctgagctccctgtctctcctcagtgacatcgtctttaaaccctgcgtggcaatccctgacgcaccgccgtgcgactcggaccgatg

SEQ ID NO: 934 - DNA, 203 bp, Homo sapiens
  source 1..203: mol_type = other DNA
ggcgcgccagtcctggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcatcgactcggaccgatg

SEQ ID NO: 935 - DNA, 203 bp, Homo sapiens
  source 1..203: mol_type = other DNA
ggcgcgccagtcctaccacagggtcttgcctccgcgcgccccgccctcgtcctcttgtgtagcctgaggcggcggtagcatggagggggagagtacgtcggcggtgctctcgggctttgtgctcggcgcactcgctttccagcacctcaacacggactcggacacggaaggttttcttcttggggaagcgactcggaccgatg

SEQ ID NO: 936 - DNA, 203 bp, Homo sapiens
  source 1..203: mol_type = other DNA
ggcgcgccagtcctaggaaagtggagggggaggcggtggcgacgtccagcctgagaacctcaagagagggaggtgacgggacgctgagaggaagagacctgggaaattaagtttcttgcggagtacggtggggattgcagctgctgagcagggattctggaaagcattgcgtacctgagcccccagcacgactcggaccgatg

SEQ ID NO: 937 - DNA, 203 bp, Homo sapiens
  source 1..203: mol_type = other DNA
ggcgcgccagtcctggtggcgctgttacatagcccgtagtcagaggcctttcagcccaggggccggcgcacgaaacctgtttggaggttatggatgataaacccaatcctgaagccctaagtgacagttcagagcgtcttttctcctttggcgtcatcgcagatgttcaatttgcagacttagaagatcgactcggaccgatg

SEQ ID NO: 938 - DNA, 203 bp, Homo sapiens
  source 1..203: mol_type = other DNA
ggcgcgccagtcctgtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctcgactcggaccgatg

SEQ ID NO: 939 - DNA, 203 bp, Homo sapiens
  source 1..203: mol_type = other DNA
ggcgcgccagtcctggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgactcggaccgatg

SEQ ID NO: 940 - DNA, 203 bp, Homo sapiens
  source 1..203: mol_type = other DNA
ggcgcgccagtcctcccagccctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtcccgactcggaccgatg

SEQ ID NO: 941 - DNA, 203 bp, Homo sapiens
  source 1..203: mol_type = other DNA
ggcgcgccagtcctcggccactcggcatctgggttttagtcaggcagtgctccaggcgcctggctgccaggctacgggagaaaagtcctccgctcggccgcacccgttagaggcgctctccactgctgtcctcttcagctcaagatggtggcctgccgggcgattggcatcctcagccgcttttctgccgactcggaccgatg

SEQ ID NO: 942 - DNA, 203 bp, Homo sapiens
  source 1..203: mol_type = other DNA
ggcgcgccagtcctcggcggtggcgggagctgctgtctgagcagcggttggggaccgagcgaacttggcccaggagcccgggcctagggagaggcgcggcggcggcgggagcgcgaacggctggagctggccttcttcgccttctcctcggctgtggagccctggtggggggtctgcgcccggtcacccgactcggaccgatg

SEQ ID NO: 943 - DNA, 203 bp, Homo sapiens
  source 1..203: mol_type = other DNA
ggcgcgccagtcctctagaagaactcgaccagtgagcaggcgaggaaggggcgggagccggggtcccggtagcttctagtaggttccagaaggcggcgcgtgcggttgggaacgcggagcggacggattcgattcaacggggttcgggaccgcgctgcgctatggagcaggtcaatgagctgaaggagcgactcggaccgatg

SEQ ID NO: 944 - DNA, 203 bp, Homo sapiens
  source 1..203: mol_type = other DNA
ggcgcgccagtcctgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcacccgactcggaccgatg

SEQ ID NO: 945 - DNA, 203 bp, Homo sapiens
  source 1..203: mol_type = other DNA
ggcgcgccagtccttcactcaccctggcacattcagcccccctaacccaccttgaacattgaccaccacacactccctggcacgctcttctcaccctcaacttctgccacctctccctgggcaatactgccagcctttccctaatctcagagctgcagccctgccctgtcactcacctcaaacctgcccgactcggaccgatg

SEQ ID NO: 946 - DNA, 203 bp, Homo sapiens
  source 1..203: mol_type = other DNA
ggcgcgccagtcctggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcacccgactcggaccgatg

SEQ ID NO: 947 - DNA, 203 bp, Homo sapiens
  source 1..203: mol_type = other DNA
ggcgcgccagtcctcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaaccgactcggaccgatg

SEQ ID NO: 948 - DNA, 203 bp, Homo sapiens
  source 1..203: mol_type = other DNA
ggcgcgccagtcctcccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccacccgactcggaccgatg

SEQ ID NO: 949 - DNA, 203 bp, Homo sapiens
  source 1..203: mol_type = other DNA
ggcgcgccagtcctccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgacgactcggaccgatg

SEQ ID NO: 950 - DNA, 203 bp, Homo sapiens
  source 1..203: mol_type = other DNA
ggcgcgccagtcctgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagccgactcggaccgatg

SEQ ID NO: 951 - DNA, 203 bp, Homo sapiens
  source 1..203: mol_type = other DNA
ggcgcgccagtcctgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgactcggaccgatg

SEQ ID NO: 952 - DNA, 203 bp, Homo sapiens
  source 1..203: mol_type = other DNA
ggcgcgccagtcctagcacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagcgactcggaccgatg

SEQ ID NO: 953 - DNA, 203 bp, Homo sapiens
  source 1..203: mol_type = other DNA
ggcgcgccagtcctaagagtcccggacagtgcaaagcaaatgcaagaagaccccctccctagccgatgggaaatgccccagccgttgaaggcggaaataacggcctgtaggcaacggaactcccagcgttcgcaaaggagggaggagccggaaactcagggcgcgaggcctgtgggcccagcgggaagcgactcggaccgatg

SEQ ID NO: 954 - DNA, 203 bp, Homo sapiens
  source 1..203: mol_type = other DNA
ggcgcgccagtcctcaccctacagcagttcaggctgtgtggttcgcaggaagcatacactggctttttgattcttgctagttcccagctcacagtttgggaggatccaacaccaacctttacgtgaagtggaggcccaaggacagtgaggagctgggtggtcccagcctggagctgtgccagcctgaccgactcggaccgatg

SEQ ID NO: 955 - DNA, 203 bp, Homo sapiens
  source 1..203: mol_type = other DNA
ggcgcgccagtcctgagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaaccgactcggaccgatg

SEQ ID NO: 956 - DNA, 203 bp, Homo sapiens
  source 1..203: mol_type = other DNA
ggcgcgccagtcctgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagcgactcggaccgatg

SEQ ID NO: 957 - DNA, 203 bp, Homo sapiens
  source 1..203: mol_type = other DNA
ggcgcgccagtcctatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacacgactcggaccgatg

SEQ ID NO: 958 - DNA, 203 bp, Homo sapiens
  source 1..203: mol_type = other DNA
ggcgcgccagtcctcagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgcccgactcggaccgatg

SEQ ID NO: 959 - DNA, 203 bp, Homo sapiens
  source 1..203: mol_type = other DNA
ggcgcgccagtcctcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaacccgactcggaccgatg

SEQ ID NO: 960 - DNA, 203 bp, Homo sapiens
  source 1..203: mol_type = other DNA
ggcgcgccagtcctcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctacgactcggaccgatg

SEQ ID NO: 961 - DNA, 203 bp, Homo sapiens
  source 1..203: mol_type = other DNA
ggcgcgccagtcctacgccagggagctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagtcgactcggaccgatg

SEQ ID NO: 962 - DNA, 203 bp, Homo sapiens
  source 1..203: mol_type = other DNA
ggcgcgccagtcctctctggtggagagagtgttgtctaaaacaagttccggaagggaggctgcccttcggggtccgagaaccaccggcctccccagtttgagggctgttaccccgtgcgcgcttcgacgttgctgctgttggctctcctcgcccctcgttcccttgggaaccgcctgggaactccgcccgactcggaccgatg

SEQ ID NO: 963 - DNA, 203 bp, Homo sapiens
  source 1..203: mol_type = other DNA
ggcgcgccagtcctttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctctctcgggtccgtgcctccaagcgactcggaccgatg

SEQ ID NO: 964 - DNA, 203 bp, Homo sapiens
  source 1..203: mol_type = other DNA
ggcgcgccagtcctacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagcgactcggaccgatg

SEQ ID NO: 965 - DNA, 203 bp, Homo sapiens
  source 1..203: mol_type = other DNA
ggcgcgccagtcctatcggatggctgttacctcctcctaaaatgtctgcatttacccagataatcttccaatggaaatccatggttcaagtgccacctcttcaggaaagccatctgacttcaatcaggtcagccctgacaaaggtcagctagccccttgaggacatcagctttggcctcagggtcctacgactcggaccgatg

SEQ ID NO: 966 - DNA, 203 bp, Homo sapiens
  source 1..203: mol_type = other DNA
ggcgcgccagtcctgagcagggagtcagagacgccccgttccaggacccttgtcaccgggagacaggagcggggaggatctgtggggtcctgggttcagcactctgccctgctgccgctgaggagaggtcagccctgacaaaggtcagctagccccttgaggacatcagctttggcctcagggtcctacgactcggaccgatg

SEQ ID NO: 967 - DNA, 203 bp, Homo sapiens
  source 1..203: mol_type = other DNA
ggcgcgccagtcctcactgttggtaaagcccagcccttcccaacctgcaagctcaccttccaggactgggcccagcccatgctctccatatataagctgctgccccgagcctgattcctagtcctgcttctcttccctctctcctccagcctctcacactctcctcagctctctcatctcctggaacccgactcggaccgatg

SEQ ID NO: 968 - DNA, 203 bp, Homo sapiens
  source 1..203: mol_type = other DNA
ggcgcgccagtcctgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaaccgactcggaccgatg

SEQ ID NO: 969 - DNA, 203 bp, Homo sapiens
  source 1..203: mol_type = other DNA
ggcgcgccagtcctgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatcgactcggaccgatg

SEQ ID NO: 970 - DNA, 203 bp, Homo sapiens
  source 1..203: mol_type = other DNA
ggcgcgccagtcctaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgccgactcggaccgatg

SEQ ID NO: 971 - DNA, 203 bp, Homo sapiens
  source 1..203: mol_type = other DNA
ggcgcgccagtcctttacaggaacagtgtggcctctctggaactctgcagaccaactgccgtgatgctgaagttccgaacagtccatgggggcctgaggctcctgggaatccgccgaacctccaccgcccccgctgcctccccaaatgtccggcgcctggagtataagcccatcaagaaagtcatggtcgactcggaccgatg

SEQ ID NO: 972 - DNA, 203 bp, Homo sapiens
  source 1..203: mol_type = other DNA
ggcgcgccagtcctgtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctcccccgactcggaccgatg

SEQ ID NO: 973 - DNA, 203 bp, Homo sapiens
  source 1..203: mol_type = other DNA
ggcgcgccagtcctggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgcgactcggaccgatg

SEQ ID NO: 974 - DNA, 203 bp, Homo sapiens
  source 1..203: mol_type = other DNA
ggcgcgccagtcctgttcgcgttcgccccgcctcaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatgcgactcggaccgatg

SEQ ID NO: 975 - DNA, 203 bp, Homo sapiens
  source 1..203: mol_type = other DNA
ggcgcgccagtcctgggggctggaatactgtaccttgatcttagggcctggaaaaatcaggtaggtaactctctggtcctaggtggaggtgtaggggaggttgggccagggatgccttcactgtgtctctctggtcttgccaccccagaccgagggacacacaggcactgctgtctgcaacacaagcacgactcggaccgatg

SEQ ID NO: 976 - DNA, 203 bp, Homo sapiens
  source 1..203: mol_type = other DNA
ggcgcgccagtcctctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgaccgactcggaccgatg

SEQ ID NO: 977 - DNA, 203 bp, Homo sapiens
  source 1..203: mol_type = other DNA
ggcgcgccagtcctccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagacgactcggaccgatg

SEQ ID NO: 978 - DNA, 203 bp, Homo sapiens
  source 1..203: mol_type = other DNA
ggcgcgccagtcctaaagtggctgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcacgactcggaccgatg

SEQ ID NO: 979 - DNA, 203 bp, Homo sapiens
  source 1..203: mol_type = other DNA
ggcgcgccagtccttggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgcgactcggaccgatg

SEQ ID NO: 980 - DNA, 203 bp, Homo sapiens
  source 1..203: mol_type = other DNA
ggcgcgccagtcctcgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggccgactcggaccgatg

SEQ ID NO: 981 - DNA, 203 bp, Homo sapiens
  source 1..203: mol_type = other DNA
ggcgcgccagtcctctggtaggagagcgccgcgggcggatggaggcgactcttcgccccgcctgagctcaggaggggctagcgcggagcgcgggtcccgcctccagccgcgggagcggccgcgcgagccaccactggaggaggaggaggaggagcggacgtcggcttctccccgcgggagcccccagccgactcggaccgatg

SEQ ID NO: 982 - DNA, 203 bp, Homo sapiens
  source 1..203: mol_type = other DNA
ggcgcgccagtcctcgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagcgactcggaccgatg

SEQ ID NO: 983 - DNA, 203 bp, Homo sapiens
  source 1..203: mol_type = other DNA
ggcgcgccagtcctggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgccgactcggaccgatg

SEQ ID NO: 984 - DNA, 203 bp, Homo sapiens
  source 1..203: mol_type = other DNA
ggcgcgccagtcctttccgggttttgtgtcgaatctgcggcggcgacccggcgccgcgtcacgcggtggtgaatgtgcggcagcacgcgcgccgcgtcgtttacgcggcgatttcatcatgctccgagccgggcggcgcgcgccgcttccgtcgccaccctctctggacagcccagggccgcaggctccgactcggaccgatg

SEQ ID NO: 985 - DNA, 203 bp, Homo sapiens
  source 1..203: mol_type = other DNA
ggcgcgccagtccttggagggaagggggcgggcagacggcataggaaggcgccggaagtggtcccgcagaggcggggtgggagtggggctcccgaggcagtgcagttggctgtagctgggcgcctcggttaggtgcgctgtcagtcctttccgagtgcctggcccagtctctcccgcctcggcccaaccgactcggaccgatg

SEQ ID NO: 986 - DNA, 203 bp, Homo sapiens
  source 1..203: mol_type = other DNA
ggcgcgccagtcctggcccaccgccgcccaggcaaggccgccctgccttgggcgcagcgctgccatggctgggggccgtggggcccccgggcgcggccgggacgagcctccggagagctacccgcaacgacaggaccacgagctacaggccctggaggccatctacggcgcggacttccaagacctgccgactcggaccgatg

SEQ ID NO: 987 - DNA, 203 bp, Homo sapiens
  source 1..203: mol_type = other DNA
ggcgcgccagtcctctgcgactcgaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctcccccccgactcggaccgatg

SEQ ID NO: 988 - DNA, 203 bp, Homo sapiens
  source 1..203: mol_type = other DNA
ggcgcgccagtcctcccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagcgactcggaccgatg

SEQ ID NO: 989 - DNA, 203 bp, Homo sapiens
  source 1..203: mol_type = other DNA
ggcgcgccagtcctgcggcagctcttttccttcttcctccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaacgactcggaccgatg

SEQ ID NO: 990 - DNA, 203 bp, Homo sapiens
  source 1..203: mol_type = other DNA
ggcgcgccagtcctctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcacccgactcggaccgatg

SEQ ID NO: 991 - DNA, 203 bp, Homo sapiens
  source 1..203: mol_type = other DNA
ggcgcgccagtcctccggcttccccgccccgccccgtccccgggcgtctccattttggtctcaggtgtggactcggcaagaaccagcgcaagagggaagcagagttatagctaccccggccgcggagccggctcactgcactacccccgcccccttctttcctccagacgccgaagtcgcgggcgctccgactcggaccgatg

SEQ ID NO: 992 - DNA, 203 bp, Homo sapiens
  source 1..203: mol_type = other DNA
ggcgcgccagtcctgccgccccgccccgccccgcgcgctccagacccccggggcggctgccgggagagatgctggaagaaacttcttaaatgaccgcgtctggctggccgtggagcctttctgggttggggagaggaaaggaaagtggaaaaaacctgagaacttcctgatctctctcgctgtgagaccgactcggaccgatg

SEQ ID NO: 993 - DNA, 203 bp, Homo sapiens
  source 1..203: mol_type = other DNA
ggcgcgccagtcctatgcaggccttcccacaagggcccggcagcatgacaaggtgaaggcagagtatgtgcatctcaaccatccgctcaccctcgtgaccagagagcgcgatttggccgtgaaggagaaacaccagctccaagccaagctggagaacctagaacaggtcctgaagcatatgcgagaggcgactcggaccgatg

SEQ ID NO: 994 - DNA, 203 bp, Homo sapiens
  source 1..203: mol_type = other DNA
ggcgcgccagtcctaggcccagtggccgagcggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagcgactcggaccgatg

SEQ ID NO: 995 - DNA, 203 bp, Homo sapiens
  source 1..203: mol_type = other DNA
ggcgcgccagtcctactacttctcccccggactccttggtagtctgttagtgggagatccttgttgccgtcccttcgcctccttcaccgccgcagaccccttcaagttctagtcatgcgtgagtgcatctccatccacgttggccaggctggtgtccagattggcaatgcctgctgggagctctactgcgactcggaccgatg

SEQ ID NO: 996 - DNA, 203 bp, Homo sapiens
  source 1..203: mol_type = other DNA
ggcgcgccagtcctagtggagccagcgccacgcgtctccagggtctccatacccagccttcgtccctgcggtgcccagaggccttgcgcgcattttgcatttgggaagacaggtcctgagtgcgaccgtcacccagcggaagtgtgagggttcggcccagcggcagggctagccctgggcctcctgttcgactcggaccgatg

SEQ ID NO: 997 - DNA, 203 bp, Homo sapiens
  source 1..203: mol_type = other DNA
ggcgcgccagtcctcggagcccacggagcccacggaggagcccacggaggagccccagcgtccgaacgggcagaccccctcgagccgcgaaggagcccgagaagcagccacgatgtgcggaatctttgcctacatgaactacagagtcccccggacgaggaaggagatcttcgaaaccctcatcaaggcgactcggaccgatg

SEQ ID NO: 998 - DNA, 203 bp, Homo sapiens
  source 1..203: mol_type = other DNA
ggcgcgccagtcctatatggaggtgaagggtgagatcgggaaacaaagggtatggccccctagttcccaaagggagcagggagatgggaatagaattgaaggtaggttttaggctacttgggaggaggaatatttaggtaattgtggagactttctcctgtgtgatgaaggcggcagacactgtgatccgactcggaccgatg

SEQ ID NO: 999 - DNA, 203 bp, Homo sapiens
  source 1..203: mol_type = other DNA
ggcgcgccagtcctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattcgactcggaccgatg

SEQ ID NO: 1000 - DNA, 203 bp, Homo sapiens
  source 1..203: mol_type = other DNA
ggcgcgccagtcctgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagacgactcggaccgatg

SEQ ID NO: 1001 - DNA, 203 bp, Homo sapiens
  source 1..203: mol_type = other DNA
ggcgcgccagtcctgagtattgcctttggcccccacccccacgggtccccgcgctccgtcttccttctgactgggggactccgcgggacggcgttcccggcgcgcactgtaccccttgccgccccttccccttcatgttggacctgacctcccgcggacaagtggggacgtcccggaggatggccgagcgactcggaccgatg

SEQ ID NO: 1002 - DNA, 203 bp, Homo sapiens
  source 1..203: mol_type = other DNA
ggcgcgccagtcctggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaacgactcggaccgatg

SEQ ID NO: 1003 - DNA, 203 bp, Homo sapiens
  source 1..203: mol_type = other DNA
ggcgcgccagtcctgggcatacctcggaactggtcctcaggcagagggttgtcctcccgggcagaaaggcgacagcggcgtctgcggggtccttcctggcggcgggcgcaggcgtttcctcggcgtggggcggaagcacgatctccggcagcggcctgggaactcttagctgagcaggcgagagcatccgactcggaccgatg

SEQ ID NO: 1004 - DNA, 203 bp, Homo sapiens
  source 1..203: mol_type = other DNA
ggcgcgccagtcctcagccctaggccctgcgcgagctgccccgccctaccccctccagcgtcctgtcgcctcctcgcccgacttcggcctgtccctctctcacgcgctcagtcctcgctcttcgccccccgcagctatcggcactcggtctcccgcgcctggcgggctccgcccgagcctctgggccccgactcggaccgatg

SEQ ID NO: 1005 - DNA, 203 bp, Homo sapiens
  source 1..203: mol_type = other DNA
ggcgcgccagtcctacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgccgactcggaccgatg

SEQ ID NO: 1006 - DNA, 203 bp, Homo sapiens
  source 1..203: mol_type = other DNA
ggcgcgccagtcctagatatccgcccctgacaccattcctcccttcccccctccaccggccgcgggcataaaaggcgccaggtgagggcctcgccgctcctcccgcgaatcgcagcttctgagaccagggttgctccgtccgtgctccgcctcgccatgacttcctacagctatcgccagtcgtcggccgactcggaccgatg

SEQ ID NO: 1007 - DNA, 203 bp, Homo sapiens
  source 1..203: mol_type = other DNA
ggcgcgccagtcctccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggcgactcggaccgatg

SEQ ID NO: 1008 - DNA, 203 bp, Homo sapiens
  source 1..203: mol_type = other DNA
ggcgcgccagtcctctccgactctcggcacctggcctccagctttcggaactatggaggccgcgcccgggacccccccgccgccgccatcagagtcgccgccgccgccatcgccgccgccgccatcaacgccttcgcctcctccgtgttcccccgacgcccgcccggccaccccgcacctcctccacccgactcggaccgatg

SEQ ID NO: 1009 - DNA, 203 bp, Homo sapiens
  source 1..203: mol_type = other DNA
ggcgcgccagtcctcttacttcgaaggctgtgctccgctcaccatccagagcggaggtgcggaccttaaactcactcctggagaaagatctgcaagtgcgcagagagaagactggcagtggagcatgcatctggagggcagagacggcaggcggtacccccgcgcgccggcggtggagctcctgcagacgactcggaccgatg

SEQ ID NO: 1010 - DNA, 203 bp, Homo sapiens
  source 1..203: mol_type = other DNA
ggcgcgccagtcctcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttcgactcggaccgatg

SEQ ID NO: 1011 - DNA, 203 bp, Homo sapiens
  source 1..203: mol_type = other DNA
ggcgcgccagtcctcagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatcgactcggaccgatg

SEQ ID NO: 1012 - DNA, 203 bp, Homo sapiens
  source 1..203: mol_type = other DNA
ggcgcgccagtccttggatttgtctttctcagcaccttggcgaagccttgggtttctttcttaaaggactgatttttagaactccacatttgagtgtgaagtgagggggtctctctccctccttctccttcctctgtgattcaccttcctttttaccctgccctgcggcggctccgccccttaccttccgactcggaccgatg

SEQ ID NO: 1013 - DNA, 203 bp, Homo sapiens
  source 1..203: mol_type = other DNA
ggcgcgccagtcctcacctctcgtaaccaatggaaccgcggcgctcggccgattctcgcaggcgccctcagatctacgctctctgatgcaacgccggaatcgcggaaaccgccggtgcacgttggagtcataagacggcgtcggtgttgcagtctgtgtccttggaggtgaccagggccactgcaggccgactcggaccgatg

SEQ ID NO: 1014 - DNA, 203 bp, Homo sapiens
  source 1..203: mol_type = other DNA
ggcgcgccagtccttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgcgactcggaccgatg

SEQ ID NO: 1015 - DNA, 203 bp, Homo sapiens
  source 1..203: mol_type = other DNA
ggcgcgccagtcctcccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcacgactcggaccgatg

SEQ ID NO: 1016 - DNA, 203 bp, Homo sapiens
  source 1..203: mol_type = other DNA
ggcgcgccagtccttgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgcgactcggaccgatg

SEQ ID NO: 1017 - DNA, 203 bp, Homo sapiens
  source 1..203: mol_type = other DNA
ggcgcgccagtcctggcgtgccacctcgccgcgcagctttacgaacctagagcagcgccgccccgcctcctgtctccgtcctcacctccccgccccctcccagcttcgcgtctcctagctcgacgcgcccgctataatcacgtgattgcctcatccgggtcttttgcgttctctttccctctcccaaccgactcggaccgatg

SEQ ID NO: 1018 - DNA, 203 bp, Homo sapiens
  source 1..203: mol_type = other DNA
ggcgcgccagtcctgcgtgctgactgagctagtcttggggtcctggagaagggggctggaggcatgcccacagcctcccccccatgagcttggggctggcgagggcacaggaggtggagctgacactagagacggttatccagacactggagagcagcgtcctgtgccaggagaaaggcttgggcgcgcgactcggaccgatg

SEQ ID NO: 1019 - DNA, 203 bp, Homo sapiens
  source 1..203: mol_type = other DNA
ggcgcgccagtcctgagccgctggcgccactagagaagggcgagcggcgcggcagagtgcggcgcagcgcagctcctgaggttttggttatgaacaggattcggattcacgtcttgccaaccaatcgggggaggatcactccagtgcccaggtctcaggaacctctgtcttgtgcattcactcatcgtcgactcggaccgatg

SEQ ID NO: 1020 - DNA, 203 bp, Homo sapiens
  source 1..203: mol_type = other DNA
ggcgcgccagtcctggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgcgactcggaccgatg

SEQ ID NO: 1021 - DNA, 203 bp, Homo sapiens
  source 1..203: mol_type = other DNA
ggcgcgccagtcctcgattcaggggagggagcaactggagcctcaggccctccagagtagtctgcctgaccaccctggagcccacagaagcccaggacgtctcccgcgaagcctccccgtgtgtggctgaggatggctgagcagcagggccgggagcttgaggctgagtgccccgtctgctggaaccccgactcggaccgatg

SEQ ID NO: 1022 - DNA, 203 bp, Homo sapiens
  source 1..203: mol_type = other DNA
ggcgcgccagtcctttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaacgactcggaccgatg

SEQ ID NO: 1023 - DNA, 203 bp, Homo sapiens
  source 1..203: mol_type = other DNA
ggcgcgccagtcctgcggcagtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgcgactcggaccgatg

SEQ ID NO: 1024 - DNA, 203 bp, Homo sapiens
  source 1..203: mol_type = other DNA
ggcgcgccagtcctctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagccgactcggaccgatg

SEQ ID NO: 1025 - DNA, 203 bp, Homo sapiens
  source 1..203: mol_type = other DNA
ggcgcgccagtcctcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctcgactcggaccgatg

SEQ ID NO: 1026 - DNA, 203 bp, Homo sapiens
  source 1..203: mol_type = other DNA
ggcgcgccagtcctaagcagttccgggaaaccccgcgtgctgccgggatcgcgtctcagtccatcaggggggggagggggtggcgcgcgcgccatttctagtcgttttcaaagcgcctcgcgctgattctcacgggcccggctgccggcccccgctctgccctgcataataaaatggctaatcaggtgcgactcggaccgatg

SEQ ID NO: 1027 - DNA, 203 bp, Homo sapiens
  source 1..203: mol_type = other DNA
ggcgcgccagtcctgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacccgactcggaccgatg

SEQ ID NO: 1028 - DNA, 203 bp, Homo sapiens
  source 1..203: mol_type = other DNA
ggcgcgccagtcctcgaaggaacctgacccaggctctgtgaggaggcaaggttttcaggggacaggccaacccagaggacaggattccctggaggccacagaggagcaccaaggagaagatctgcctgtgggtcttcattgcccagctcctgcccacactcctgcctgctgccctgacgagagtcatccgactcggaccgatg

SEQ ID NO: 1029 - DNA, 203 bp, Homo sapiens
  source 1..203: mol_type = other DNA
ggcgcgccagtcctgttggtgacgtcaccgcgttcaccagcccggaagtgcgcgtggcggcggtggcggctgcggcaacagcggggccgatgtgtagttggtgactgcctctccagatgctgaggtgcctgtatcattggcacaggccagtgctgaaccgtaggtggagtaggctgtgccttctgaagcgactcggaccgatg

SEQ ID NO: 1030 - DNA, 203 bp, Homo sapiens
  source 1..203: mol_type = other DNA
ggcgcgccagtcctcggcgggcatacctcggaactggtcctcaggcagagggttgtcctcccgggcagaaaggcgacagcggcgtctgcggggtccttcctggcggcgggcgcaggcgtttcctcggcgtggggcggaagcacgatctccggcagcggcctgggaactcttagctgagcaggcgagagcgactcggaccgatg

SEQ ID NO: 1031 - DNA, 203 bp, Homo sapiens
  source 1..203: mol_type = other DNA
ggcgcgccagtcctgcttttgctgcttcctcattttctcttgcagccgccatgattctgaggccttcccagctatgtggaactatgactgtgatgatcctcttgtgtctgccttgcctcaggcatccttcagcagttcttccgagctctccagcagtcatggtcctggatttgcaaggctgaatagaacgactcggaccgatg

SEQ ID NO: 1032 - DNA, 203 bp, Homo sapiens
  source 1..203: mol_type = other DNA
ggcgcgccagtcctgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttccgactcggaccgatg

SEQ ID NO: 1033 - DNA, 203 bp, Homo sapiens
  source 1..203: mol_type = other DNA
ggcgcgccagtcctcggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcgactcggaccgatg

SEQ ID NO: 1034 - DNA, 203 bp, Homo sapiens
  source 1..203: mol_type = other DNA
ggcgcgccagtcctgtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctcgactcggaccgatg

SEQ ID NO: 1035 - DNA, 203 bp, Homo sapiens
  source 1..203: mol_type = other DNA
ggcgcgccagtcctgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatcccgactcggaccgatg

SEQ ID NO: 1036 - DNA, 203 bp, Homo sapiens
  source 1..203: mol_type = other DNA
ggcgcgccagtcctctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgcgactcggaccgatg

SEQ ID NO: 1037 - DNA, 203 bp, Homo sapiens
  source 1..203: mol_type = other DNA
ggcgcgccagtcctgctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaacgactcggaccgatg

SEQ ID NO: 1038 - DNA, 203 bp, Homo sapiens
  source 1..203: mol_type = other DNA
ggcgcgccagtccttccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggcgactcggaccgatg

SEQ ID NO: 1039 - DNA, 203 bp, Homo sapiens
  source 1..203: mol_type = other DNA
ggcgcgccagtcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagcgactcggaccgatg

SEQ ID NO: 1040 - DNA, 203 bp, Homo sapiens
  source 1..203: mol_type = other DNA
ggcgcgccagtcctggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacgactcggaccgatg

SEQ ID NO: 1041 - DNA, 203 bp, Homo sapiens
  source 1..203: mol_type = other DNA
ggcgcgccagtcctgggctcgggtaaccggagtgctggtatctaatcgtcgctcaaaagctcctaggtgcgcgggtggatataattcccggcttctcgagaagacactacagcctcaaggaggtatatcccgtgccttacctgactgggggctctgagtccagttgtgttgtcttcaacttagacacccgactcggaccgatg

SEQ ID NO: 1042 - DNA, 203 bp, Homo sapiens
  source 1..203: mol_type = other DNA
ggcgcgccagtcctaagtttgaaactggtaacttcgggagttgagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgactcggaccgatg

SEQ ID NO: 1043 - DNA, 203 bp, Homo sapiens
  source 1..203: mol_type = other DNA
ggcgcgccagtccttggcgtggagagtttggggatctacagcagccaaaggcttgtccctgactttatatggctgctcctggcgagcgactgagtcgtccgtgaggaaaaagaggcgaggcttttccgagatcgtctcagcgatggcgcttcggtcgcggttttgggggttgttctcggtttgcaggacgactcggaccgatg

SEQ ID NO: 1044 - DNA, 203 bp, Homo sapiens
  source 1..203: mol_type = other DNA
ggcgcgccagtcctcccgttagtcttttcttcacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctcgactcggaccgatg

SEQ ID NO: 1045 - DNA, 203 bp, Homo sapiens
  source 1..203: mol_type = other DNA
ggcgcgccagtcctaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgccgactcggaccgatg

SEQ ID NO: 1046 - DNA, 203 bp, Homo sapiens
  source 1..203: mol_type = other DNA
ggcgcgccagtccttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacaccgactcggaccgatg

SEQ ID NO: 1047 - DNA, 203 bp, Homo sapiens
  source 1..203: mol_type = other DNA
ggcgcgccagtcctgcatacctgcctgggtgtccaaatgtaactagatgctttcacaaaccccacccacaaagcagcacatgtttttaagacttcagttttctattcacatcggcctcataatacccaccctgacctgctgtaaaagacctggaacaaacaaaaatgattacacctacagtgaagatgcgactcggaccgatg

SEQ ID NO: 1048 - DNA, 203 bp, Homo sapiens
  source 1..203: mol_type = other DNA
ggcgcgccagtcctaatttgaattggggcgtgtctagaaagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgcgactcggaccgatg

SEQ ID NO: 1049 - DNA, 203 bp, Homo sapiens
  source 1..203: mol_type = other DNA
ggcgcgccagtcctcgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaacgactcggaccgatg

SEQ ID NO: 1050 - DNA, 203 bp, Homo sapiens
  source 1..203: mol_type = other DNA
ggcgcgccagtcctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggacgactcggaccgatg

SEQ ID NO: 1051 - DNA, 203 bp, Homo sapiens
  source 1..203: mol_type = other DNA
ggcgcgccagtcctcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagggttgaatgcaccctcaggcacgacccgactcggaccgatg

SEQ ID NO: 1052 - DNA, 203 bp, Homo sapiens
  source 1..203: mol_type = other DNA
ggcgcgccagtcctccacgctcgtgccgctccccccccgcgctcccagttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgactcggaccgatg

SEQ ID NO: 1053 - DNA, 203 bp, Homo sapiens
  source 1..203: mol_type = other DNA
ggcgcgccagtcctgaaaacctgaatacggaactgaagcagcagctcagtttctcactccgaagtggcagcagccagagagggagtcggtgtggacgcgaggagccgggcgcttagaacagaggcttgcacaggtggagatgtggaagtctgtagtgggccatgatgtgtctgtttccgtggagaccccgactcggaccgatg

SEQ ID NO: 1054 - DNA, 203 bp, Homo sapiens
  source 1..203: mol_type = other DNA
ggcgcgccagtcctaacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggcagccgactcggaccgatg

SEQ ID NO: 1055 - DNA, 203 bp, Homo sapiens
  source 1..203: mol_type = other DNA
ggcgcgccagtcctgcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagcgactcggaccgatg

SEQ ID NO: 1056 - DNA, 203 bp, Homo sapiens
  source 1..203: mol_type = other DNA
ggcgcgccagtcctgtgttcctcttttcctcggttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggcgactcggaccgatg

SEQ ID NO: 1057 - DNA, 203 bp, Homo sapiens
  source 1..203: mol_type = other DNA
ggcgcgccagtcctggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgacgactcggaccgatg

SEQ ID NO: 1058 - DNA, 203 bp, Homo sapiens
  source 1..203: mol_type = other DNA
ggcgcgccagtcctcagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttcccgactcggaccgatg

SEQ ID NO: 1059 - DNA, 203 bp, Homo sapiens
  source 1..203: mol_type = other DNA
ggcgcgccagtccttcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagcgactcggaccgatg

SEQ ID NO: 1060 - DNA, 203 bp, Homo sapiens
  source 1..203: mol_type = other DNA
ggcgcgccagtcctaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgcccgactcggaccgatg

SEQ ID NO: 1061 - DNA, 203 bp, Homo sapiens
  source 1..203: mol_type = other DNA
ggcgcgccagtcctagggactgttctcttcagtgagtggcaggtgtccggaggctgcactgcagcgtagccgcttgggcgggcggccagtggcgactacagcagggactggctgccaacccctccggctacgggccccttaccgagctcccagactggtcatatgcggatggccgccctgctcccccacgactcggaccgatg

SEQ ID NO: 1062 - DNA, 203 bp, Homo sapiens
  source 1..203: mol_type = other DNA
ggcgcgccagtcctggagggccctgagggaggggtcagacgctttaggaaagagttaatgcgaagagggggaggggataggacgaagaaaccgaagggaaagctcagggccgccaacttccagctgcagcggcgactttcagtttcatttccacggaccctcctgcctgggccgcagccgccgccgcgcgactcggaccgatg

SEQ ID NO: 1063 - DNA, 203 bp, Homo sapiens
  source 1..203: mol_type = other DNA
ggcgcgccagtccttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagacgactcggaccgatg

SEQ ID NO: 1064 - DNA, 203 bp, Homo sapiens
  source 1..203: mol_type = other DNA
ggcgcgccagtccttgtggagtcgggactggagctgctgccgcggcgacgccggggatctttgtcgctagctcccggcccttctgccccgccgccttccctcagtcagcgttgcccactcctctccggccgggcgcccctgcctccatttcccgctctctgtccaccacacacacggcccccccgatccgactcggaccgatg

SEQ ID NO: 1065 - DNA, 203 bp, Homo sapiens
  source 1..203: mol_type = other DNA
ggcgcgccagtcctggaaaaccgcagcggggtagcgcgggcgctgccggaacttgtagttccacctcccgccgcgctaaatagccggaaacgggggcggccagaacagagaactaccgaggcgaagcacctgtggaatcctctcaagaggaacagtcattgtgtgaaggttcaaattcagctgttagccgactcggaccgatg

SEQ ID NO: 1066 - DNA, 203 bp, Homo sapiens
  source 1..203: mol_type = other DNA
ggcgcgccagtcctggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctcgactcggaccgatg

SEQ ID NO: 1067 - DNA, 203 bp, Homo sapiens
  source 1..203: mol_type = other DNA
ggcgcgccagtcctcttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatcgactcggaccgatg

SEQ ID NO: 1068 - DNA, 203 bp, Homo sapiens
  source 1..203: mol_type = other DNA
ggcgcgccagtcctcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccgactcggaccgatg

SEQ ID NO: 1069 - DNA, 203 bp, Homo sapiens
  source 1..203: mol_type = other DNA
ggcgcgccagtcctgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgcgactcggaccgatg

SEQ ID NO: 1070 - DNA, 203 bp, Homo sapiens
  source 1..203: mol_type = other DNA
ggcgcgccagtccttgcaggtaccatggagctgagctataggctcttcatctgcctcctgctctggggtagtactgagctgtgctacccccaacccctctggctcttgcagggtggagccagccatcctgagacgtccgtacagcccgtactggtggagtgtcaggaggccactctgatggtcatggtcgactcggaccgatg

SEQ ID NO: 1071 - DNA, 203 bp, Homo sapiens
  source 1..203: mol_type = other DNA
ggcgcgccagtcctagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccacccgactcggaccgatg

SEQ ID NO: 1072 - DNA, 203 bp, Homo sapiens
  source 1..203: mol_type = other DNA
ggcgcgccagtcctgtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggaccgactcggaccgatg

SEQ ID NO: 1073 - DNA, 203 bp, Homo sapiens
  source 1..203: mol_type = other DNA
ggcgcgccagtcctagcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattcgactcggaccgatg

SEQ ID NO: 1074 - DNA, 203 bp, Homo sapiens
  source 1..203: mol_type = other DNA
ggcgcgccagtcctccagctcgggccttagaacttctgaacgggcagtgcgggtaggccctgcttagcccttcccggaggacacctgaccaaaagaggaagatagtcttgggacccttgcatggtgtttcaaagggtggtgaagaactaaggtagaagaatacatgttcacttccagtgaacaagagccgactcggaccgatg

SEQ ID NO: 1075 - DNA, 203 bp, Homo sapiens
  source 1..203: mol_type = other DNA
ggcgcgccagtcctaggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatcgactcggaccgatg

SEQ ID NO: 1076 - DNA, 203 bp, Homo sapiens
  source 1..203: mol_type = other DNA
ggcgcgccagtcctgattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaacgactcggaccgatg

SEQ ID NO: 1077 - DNA, 203 bp, Homo sapiens
  source 1..203: mol_type = other DNA
ggcgcgccagtcctccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgcgactcggaccgatg

SEQ ID NO: 1078 - DNA, 203 bp, Homo sapiens
  source 1..203: mol_type = other DNA
ggcgcgccagtcctgacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacacccgactcggaccgatg

SEQ ID NO: 1079 - DNA, 203 bp, Homo sapiens
  source 1..203: mol_type = other DNA
ggcgcgccagtcctgggtgcgagctggagactccgcgggagcgcggccgggaggcttcgccccggagctggcccgacgcctcccgagctggcagggctctcggcggaggtcggagcgtgggcttcctcctcccgccagggaaaacagagaggatgaaggcctatctaaagagcgcagaaggcttttttcgactcggaccgatg

SEQ ID NO: 1080 - DNA, 203 bp, Homo sapiens
  source 1..203: mol_type = other DNA
ggcgcgccagtcctgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacacgactcggaccgatg

SEQ ID NO: 1081 - DNA, 203 bp, Homo sapiens
  source 1..203: mol_type = other DNA
ggcgcgccagtcctggcaggtggtagccttcccgcccttctggcctctccatcccctgctgcgggggaccgcgcaagcgcagtgagtactgcacgttgtcgcgggccagtaacgtcatcagacgtgtgtgtgtccctgcggcgctaagaaggggagactgaggctgaggctggggaacatcgggcagccgactcggaccgatg

SEQ ID NO: 1082 - DNA, 203 bp, Homo sapiens
  source 1..203: mol_type = other DNA
ggcgcgccagtcctaggatgtgtagggggcggggcccggcggaagcgtatataaggccgggctcggggacgcccccccctcactcgcgcgttaggaggctcgggtcgttgtggtgcgctgtcttcccgcttgcgtcagggacctgcccgactcagtggccgccatggcatcagatgaaggcaaactttcgactcggaccgatg

SEQ ID NO: 1083 - DNA, 203 bp, Homo sapiens
  source 1..203: mol_type = other DNA
ggcgcgccagtccttcccagacccggggctctccaaggccccgcgcttccgagctccgcgcaaactctggcttctcttgtacgacagaggtggtttgctcttccgttgccccgtggcttcagctcatctttggcaggaaggcgaggcttccgcccggcacaggggatgtccagctcgccgctgtccaacgactcggaccgatg

SEQ ID NO: 1084 - DNA, 203 bp, Homo sapiens
  source 1..203: mol_type = other DNA
ggcgcgccagtccttgcggctcacagagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtcccccgactcggaccgatg

SEQ ID NO: 1085 - DNA, 203 bp, Homo sapiens
  source 1..203: mol_type = other DNA
ggcgcgccagtcctagtttcgtccgagctcagtagagttttgctgttaagactgcgcgaggagctagagagagcggagagcgctgagccgggccgcacccgccgagccgtcttgatactgatggacattgtgtgggccagaggcagggatggttggctatgaccccaaaccagatggcaggaataacacgactcggaccgatg

SEQ ID NO: 1086 - DNA, 203 bp, Homo sapiens
  source 1..203: mol_type = other DNA
ggcgcgccagtcctggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactcgactcggaccgatg

SEQ ID NO: 1087 - DNA, 203 bp, Homo sapiens
  source 1..203: mol_type = other DNA
ggcgcgccagtcctgacagcggcgtggcggcggcggtggcggtagcgacggcacgccgtagggcggtcagaaggtttccggttccggtgtaacgttcgggctccgtctcaggggctgaagtttgtgaggtgtagtattgagtcctgtttgagctattgttctctttttcctgaaaaatggcactgtcacgactcggaccgatg

SEQ ID NO: 1088 - DNA, 203 bp, Homo sapiens
  source 1..203: mol_type = other DNA
ggcgcgccagtcctaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagcccgactcggaccgatg

SEQ ID NO: 1089 - DNA, 203 bp, Homo sapiens
  source 1..203: mol_type = other DNA
ggcgcgccagtcctaacgcaggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggtttcgactcggaccgatg

SEQ ID NO: 1090 - DNA, 203 bp, Homo sapiens
  source 1..203: mol_type = other DNA
ggcgcgccagtcctcctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaaccgactcggaccgatg

SEQ ID NO: 1091 - DNA, 203 bp, Homo sapiens
  source 1..203: mol_type = other DNA
ggcgcgccagtcctctcaacctccgtggctagtcttgacgtggcgggttgctttccaaaatggcgcgggtgctgaaggctgcagccgcgaatgccgtagggcttttttccagacttcaagctcccattccaacagtaagagcttcttccacatcacagcccttggatcaagtgacaggttctgtgtggcgactcggaccgatg

SEQ ID NO: 1092 - DNA, 203 bp, Homo sapiens
  source 1..203: mol_type = other DNA
ggcgcgccagtcctaaaggaaccgggttgtcttgggccgggcagggcgggtggtgactctcaaaaggaaataggatcatggcagcagatgatgacaatggtgatggaacaagtttatttgatgtcttttctgcttctcctcttaagaacaatgatgaaggctcactggacatatacgctgggttggaccgactcggaccgatg

SEQ ID NO: 1093 - DNA, 203 bp, Homo sapiens
  source 1..203: mol_type = other DNA
ggcgcgccagtcctgcttttcaccctctaccctcccctcagcctggccttttcttccgccctcacagccaccgcgacccaacgctgaggaaagaccccgacttgtggtgtccttccccttgcccaaactggccacgaaaggacatatagcgagagagaaagaggattttctgccgtctcttggcaaaacgactcggaccgatg

SEQ ID NO: 1094 - DNA, 203 bp, Homo sapiens
  source 1..203: mol_type = other DNA
ggcgcgccagtcctcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtccgactcggaccgatg

SEQ ID NO: 1095 - DNA, 203 bp, Homo sapiens
  source 1..203: mol_type = other DNA
ggcgcgccagtcctagttacctctcccctttcacgtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccgcgactcggaccgatg

SEQ ID NO: 1096 - DNA, 203 bp, Homo sapiens
  source 1..203: mol_type = other DNA
ggcgcgccagtcctctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggcgactcggaccgatg

SEQ ID NO: 1097 - DNA, 203 bp, Homo sapiens
  source 1..203: mol_type = other DNA
ggcgcgccagtcctgactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgcccgactcggaccgatg

SEQ ID NO: 1098 - DNA, 203 bp, Homo sapiens
  source 1..203: mol_type = other DNA
ggcgcgccagtcctataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaacgactcggaccgatg

SEQ ID NO: 1099 - DNA, 203 bp, Homo sapiens
  source 1..203: mol_type = other DNA
ggcgcgccagtcctgatgatgtcagcactgcttccggtcggtggcgcttctctctggcccgagccagcatgatccgctgggcccccagcgcatctcctggaagagcccactcaccctggacgagctcttcggtagcctcagaccgtccttgaagaggatgactgagacattatgggccacgcgctgtgcgactcggaccgatg

SEQ ID NO: 1100 - DNA, 203 bp, Homo sapiens
  source 1..203: mol_type = other DNA
ggcgcgccagtcctgcgtcacgcagcgcacgtcgccgcgcgcctgcgctcttttccacgtgcgaaagccccggactcgtggagttgtgaacgccgcggactccggagccgcacaaaccagggctcgccatgaagccaggattcagtccccgtgggggtggctttggcggccgagggggctttggtgaccgactcggaccgatg

SEQ ID NO: 1101 - DNA, 203 bp, Homo sapiens
  source 1..203: mol_type = other DNA
ggcgcgccagtcctaggaaggaagtggggccctgcggcgcccagccaccccctgacggcttccccacgggaggacgcgaggccccggcccagccatggccccctggcgcaaagctgacaaggagcggcacggcgtggccatatacaacttccaaggcagcggagccccccagctctccctgcagatcgcgactcggaccgatg

SEQ ID NO: 1102 - DNA, 203 bp, Homo sapiens
  source 1..203: mol_type = other DNA
ggcgcgccagtcctacagcatggagtggggttacctgttggaagtgacctcgctgctggccgccttggcgctgctgcagcgctctagcggcgctgcggccgcctcggccaaggagctggcatgccaagagatcaccgtgccgctgtgtaagggcatcggctacaactacacctacatgcccaatcagtcgactcggaccgatg

SEQ ID NO: 1103 - DNA, 203 bp, Homo sapiens
  source 1..203: mol_type = other DNA
ggcgcgccagtcctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatcgactcggaccgatg

SEQ ID NO: 1104 - DNA, 203 bp, Homo sapiens
  source 1..203: mol_type = other DNA
ggcgcgccagtcctcgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgcgactcggaccgatg

SEQ ID NO: 1105 - DNA, 203 bp, Homo sapiens
  source 1..203: mol_type = other DNA
ggcgcgccagtcctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacagtcgactcggaccgatg

SEQ ID NO: 1106 - DNA, 203 bp, Homo sapiens
  source 1..203: mol_type = other DNA
ggcgcgccagtcctgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtaccgactcggaccgatg

SEQ ID NO: 1107 - DNA, 203 bp, Homo sapiens
  source 1..203: mol_type = other DNA
ggcgcgccagtcctagtgctaagcaaatacaggaaccaaaaaggtttatagaggctgccttatgctgtctcatccagttcctttgcggtcctcttcttcagcacatgccaaagctgttcctcacggcctgtgagacaagagcatcttggatgtaggacaatggaagagttagatgccttattggaggacgactcggaccgatg

SEQ ID NO: 1108 - DNA, 203 bp, Homo sapiens
  source 1..203: mol_type = other DNA
ggcgcgccagtcctcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggaccgactcggaccgatg

SEQ ID NO: 1109 - DNA, 203 bp, Homo sapiens
  source 1..203: mol_type = other DNA
ggcgcgccagtcctgagtcctgctagatccccgcaagctaggccagctcctcccactgcctcccttcctctttctcctcctcttactcctttccagccagaccttggctgtctacaggatgggggacaccctgagccccggacatggcaaccacagagagagcagcccttttctttcccccttggaggcgactcggaccgatg

SEQ ID NO: 1110 - DNA, 203 bp, Homo sapiens
  source 1..203: mol_type = other DNA
ggcgcgccagtcctagcacccgtaggtcggattatctggtaaggcaccggaagtgaccgcctcgcggctgcttcctctcctggagtccagagtcccgttgctccgccgcgatattcagtaaaccactgggagtccggcagcatggaggcagcgcgccctcccccgacggcagggaagttcgtggtggtcgactcggaccgatg

SEQ ID NO: 1111 - DNA, 203 bp, Homo sapiens
  source 1..203: mol_type = other DNA
ggcgcgccagtcctcgaaggggcgtggccaagcgcaccgcctcggggcggggccggcgttctagcgcatcgcggccgggtgcgtcactcgcgaagtggaatttgcccagacaagcaacatggctcggaaacgcgcggccggcggggagccgcggggacgcgaactgcgcagccagaaatccaaggccacgactcggaccgatg

SEQ ID NO: 1112 - DNA, 203 bp, Homo sapiens
  source 1..203: mol_type = other DNA
ggcgcgccagtcctaagtgtgcagcagatcttcttccgggcggacgtggagccggaagcggaggttccgggctccgggatgaaaggagggaacgcagacagctggcagagagagaagttggctagcatggaatcaccagaggagcctggagcatccatggatgagaactactttgtgaactacactttcgactcggaccgatg

SEQ ID NO: 1113 - DNA, 203 bp, Homo sapiens
  source 1..203: mol_type = other DNA
ggcgcgccagtcctccgccgcggtcgaggatcctggaggtttgtccccgccgccccgacgcttccgccgggtccgtcggcacgtcggccctgcctcccggaccaccctgcggggcgcaccagcgatctggggtgcggggctcggcctccctgcgctcctggctgacggtgtgaccttgggtcttaacccgactcggaccgatg

SEQ ID NO: 1114 - DNA, 203 bp, Homo sapiens
  source 1..203: mol_type = other DNA
ggcgcgccagtcctaggcatcggcgcggtcagcctcgtcgcgcgcccacgcccccacgccggctcttcccggggtccttccgtgcgcgttgatatgattggccggcgaatcgtggttctcttttcctccttggctgtctgaagatagatcgccatcatgaacgacaccgtaactatccgcactagaaacgactcggaccgatg

SEQ ID NO: 1115 - DNA, 203 bp, Homo sapiens
  source 1..203: mol_type = other DNA
ggcgcgccagtcctcaacagaagccaagaaggaagccgtctatcttgtggcgatcatgtataagctggcctcctgctgtttgcttttcataggattcttaaatcctctcttatctcttcctctccttgactccagggaaatatcctttcaactctcagcacctcatgaagacgcgcgcttaactccggcgactcggaccgatg

SEQ ID NO: 1116 - DNA, 203 bp, Homo sapiens
  source 1..203: mol_type = other DNA
ggcgcgccagtccttgcattttgctccggagcgtccagagtcctggccctgagcgggaatcgcagtggccgaggctgagcggcaggcggatcgccccgaccctcactcctggcgtctgagtctctggcgtagcccatgctgagtgggcggctggtcctgggtctggtctccatggctggccgcgtttgcgactcggaccgatg

SEQ ID NO: 1117 - DNA, 203 bp, Homo sapiens
  source 1..203: mol_type = other DNA
ggcgcgccagtcctgtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttccgactcggaccgatg

SEQ ID NO: 1118 - DNA, 203 bp, Homo sapiens
  source 1..203: mol_type = other DNA
ggcgcgccagtcctagtcatccccaaaacgaggggatatcagcttaccgaggccgcaggttttcctagtccctacctcatagatatgtaggacatccccgggcccggaatgcggctctctgaccctctctgtgccctcccccgccccccgaaccaggcttggcgggcggaggcgccagcggatgtctccgactcggaccgatg

SEQ ID NO: 1119 - DNA, 203 bp, Homo sapiens
  source 1..203: mol_type = other DNA
ggcgcgccagtcctcttgccgcgctgcactccaccacgcctcctccaagtcccagcgaacccgcgtgcaacctgtcccgactctagccgcctcttcagctcgccatggatcccaactgctcctgcgccgccggtgactcctgcacctgcgccggctcctgcaaatgcaaagagtgcaaatgcacctcccgactcggaccgatg

SEQ ID NO: 1120 - DNA, 203 bp, Homo sapiens
  source 1..203: mol_type = other DNA
ggcgcgccagtcctcccccacacaccccagccgaggcccggaaggggccaggcgcgcttccgtctccgccggggatgcacggagggcggagctgcggcccgaggacgcgacgcgagcccagttccggcgaggaggccgcgccagtgacagcgatggcggcggagtcggcgctccaagttgtggagaagcgactcggaccgatg

SEQ ID NO: 1121 - DNA, 203 bp, Homo sapiens
  source 1..203: mol_type = other DNA
ggcgcgccagtcctatgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagcgactcggaccgatg

SEQ ID NO: 1122 - DNA, 203 bp, Homo sapiens
  source 1..203: mol_type = other DNA
ggcgcgccagtcctactggtgggaactggattttgcggctgcagaggacttccccaaattttgccacattaacagctgactgcacatctgagccccgaggtgaagcagggcctcaggtagccagggaactggttgagcagaggaaatcggagagacctttttttttgtcatgaacaggctcagtgtgacgactcggaccgatg

SEQ ID NO: 1123 - DNA, 203 bp, Homo sapiens
  source 1..203: mol_type = other DNA
ggcgcgccagtcctggccgcccactgaggatctgctggctgcagcgagtggaaggacctgctcggctggaacgttttttttttttttccctcccaggcgacgtccgatgggtgtgtcgggcaggaggtgatatttgacaggctgcgcgcgggcgagctgccgcggagcacccggcaggggctgacagccgactcggaccgatg

SEQ ID NO: 1124 - DNA, 203 bp, Homo sapiens
  source 1..203: mol_type = other DNA
ggcgcgccagtcctgcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgcgactcggaccgatg

SEQ ID NO: 1125 - DNA, 203 bp, Homo sapiens
  source 1..203: mol_type = other DNA
ggcgcgccagtcctagtctgggacgcgccgccgccatgatcatccctgtacgctgcttcacttgtggcaagatcgtcggcaacaagtgggaggcttacctggggctgctgcaggccgagtacaccgagggggatgcgctggatgccctgggcctgaagcgctactgctgccgccggatgctgctggcccgactcggaccgatg

SEQ ID NO: 1126 - DNA, 203 bp, Homo sapiens
  source 1..203: mol_type = other DNA
ggcgcgccagtcctctcgtttgcgatgttccgttatctggatgcggcggagggatctggcggagggaggtgtttatgaggcgctgggggcggaggaggcgaattagtccgagtggagagagcgagctgagtggttgtgtggtcgcgtctcggaaaccggtagcgcttgcagcatggctgaccaactgacgactcggaccgatg

SEQ ID NO: 1127 - DNA, 203 bp, Homo sapiens
  source 1..203: mol_type = other DNA
ggcgcgccagtcctgattcgcccacccactgtgccaacatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgactcggaccgatg

SEQ ID NO: 1128 - DNA, 203 bp, Homo sapiens
  source 1..203: mol_type = other DNA
ggcgcgccagtccttgacaggcatgagccaccgcgcctggccccttcttttgaatgggcctccttgcgtttccgtttcaatgccccgtgctacttttttgggagccccaaggctgtactgtttgattgactcctttttttcccctttctttttaacctaaattaaagctgccactgcagagccccgcccgactcggaccgatg

SEQ ID NO: 1129 - DNA, 203 bp, Homo sapiens
  source 1..203: mol_type = other DNA
ggcgcgccagtcctacttccgggcgcggcgccggcttgctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggccgactcggaccgatg

SEQ ID NO: 1130 - DNA, 203 bp, Homo sapiens
  source 1..203: mol_type = other DNA
ggcgcgccagtccttccccgcgcgggttcgcgtcgcgtctgcagtggccgaggctgctgcctgccgggcagatgggtccgccttgttccggctgcagctttcgccgccggggcttgctggctgtcgggaactagtcaactggagtttttgttgacttcccacggaaacatgccctgaactgtcacagacgactcggaccgatg

SEQ ID NO: 1131 - DNA, 203 bp, Homo sapiens
  source 1..203: mol_type = other DNA
ggcgcgccagtcctaaatcagcatgtttattatttttaaaaaattagggcctggattttgacaatgtcaagatttaccgtatatccctgtttgtttggatacaccagtgacgtccacttctagaagacaaagttatattacttaaacaaccaaagatggagtctcgctcttcgcccaggctggagtgccgactcggaccgatg

SEQ ID NO: 1132 - DNA, 203 bp, Homo sapiens
  source 1..203: mol_type = other DNA
ggcgcgccagtcctacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaacgactcggaccgatg

SEQ ID NO: 1133 - DNA, 203 bp, Homo sapiens
  source 1..203: mol_type = other DNA
ggcgcgccagtcctttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgcccgactcggaccgatg

SEQ ID NO: 1134 - DNA, 203 bp, Homo sapiens
  source 1..203: mol_type = other DNA
ggcgcgccagtcctagagcgcgcgtcgtggaacgtcttggttgccacggcaagcgcgcgcgcgaggccttgggaacctcgggaccggcccccggcgagcgcagcggcgcccagtagtcatcttagtgggatttggggaagcaacagggctgtgtggggtaacctgccacctttaagtggaaatcagaacgactcggaccgatg

SEQ ID NO: 1135 - DNA, 203 bp, Homo sapiens
  source 1..203: mol_type = other DNA
ggcgcgccagtccttggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcgactcggaccgatg

SEQ ID NO: 1136 - DNA, 203 bp, Homo sapiens
  source 1..203: mol_type = other DNA
ggcgcgccagtccttgtcccctcgcgcagtcaccgagcgcagatcccgcgctctcgattggaacgcctccccatcactcagccacactcaggggctggacgcctcactcccgtttccgagccataaaaggtctaggaccgcttcccccgagccagcagaacatccagtcatggataaaaatgagctggcgactcggaccgatg

SEQ ID NO: 1137 - DNA, 203 bp, Homo sapiens
  source 1..203: mol_type = other DNA
ggcgcgccagtcctggcggggaggggccgggggcctcggggacccaagcgcgagggaaaggcctggccgagagcgggccggagcccaggcctggcgcggcggcgcccgccagaacatccagtcatggataaaaatgagctggttcagaaggccaaactggccgagcaggctgagcgatatgatgacatcgactcggaccgatg

SEQ ID NO: 1138 - DNA, 203 bp, Homo sapiens
  source 1..203: mol_type = other DNA
ggcgcgccagtcctacagatccgccatgacaaaggaggagagtcggggacttgagccgtggctccgacttgggcggagcctggaggggggtggttgcgatacggggaccggagaatttgcactttaaagtccgggtctgcccgttttcgtttcacagtaaccgacgtctcaagtcagaacatccagtccgactcggaccgatg

SEQ ID NO: 1139 - DNA, 203 bp, Homo sapiens
  source 1..203: mol_type = other DNA
ggcgcgccagtccttgtgtgtgagtgcaggcaggctgacaatgatttcctcagtgattacgtacagagcgagtccctgcgggttaggggccccctctggagccatcctgatggctttgggggccttgcttccattttccattattatgtggactaccggagcgacagcgcagtccaagaccttgcaggcgactcggaccgatg

SEQ ID NO: 1140 - DNA, 203 bp, Homo sapiens
  source 1..203: mol_type = other DNA
ggcgcgccagtcctcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaaccgactcggaccgatg

SEQ ID NO: 1141 - DNA, 203 bp, Homo sapiens
  source 1..203: mol_type = other DNA
ggcgcgccagtcctagtaagccagcgtggctacgccatcacgaccggcggtggcacatgcgcaatagcgagacgctggagcgcggcgtaggtggctgccgagtcttttcctgtttagggtcttatcctggcattgagggcgccggactggcgcttttggccgacttggcattgggtgggcggcttcttcgactcggaccgatg

SEQ ID NO: 1142 - DNA, 203 bp, Homo sapiens
  source 1..203: mol_type = other DNA
ggcgcgccagtccttaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaacgactcggaccgatg

SEQ ID NO: 1143 - DNA, 203 bp, Homo sapiens
  source 1..203: mol_type = other DNA
ggcgcgccagtccttcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagacgactcggaccgatg

SEQ ID NO: 1144 - DNA, 203 bp, Homo sapiens
  source 1..203: mol_type = other DNA
ggcgcgccagtcctgatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatgtttcgaaatcagtatgacaatgatgcgactcggaccgatg

SEQ ID NO: 1145 - DNA, 203 bp, Homo sapiens
  source 1..203: mol_type = other DNA
ggcgcgccagtcctaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagactattgcccagaagaaaagcgactcggaccgatg

SEQ ID NO: 1146 - DNA, 203 bp, Homo sapiens
  source 1..203: mol_type = other DNA
ggcgcgccagtcctcctcccacctcccgggaaccctggctgagtgtgcgtgtgtgggagcgcgagagccccccgacagccaccccttggggcgcgcggctgcagttagggccttggcccctccaccagaggaaggtgctgccacgtgtctgctccttctgaacctccaggtttctgctacgttgcccccgactcggaccgatg

SEQ ID NO: 1147 - DNA, 203 bp, Homo sapiens
  source 1..203: mol_type = other DNA
ggcgcgccagtccttcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagccgactcggaccgatg

SEQ ID NO: 1148 - DNA, 203 bp, Homo sapiens
  source 1..203: mol_type = other DNA
ggcgcgccagtcctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggcgactcggaccgatg

SEQ ID NO: 1149 - DNA, 203 bp, Homo sapiens
  source 1..203: mol_type = other DNA
ggcgcgccagtcctccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgcccgactcggaccgatg

SEQ ID NO: 1150 - DNA, 203 bp, Homo sapiens
  source 1..203: mol_type = other DNA
ggcgcgccagtccttcataaaaggaaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacacgactcggaccgatg

SEQ ID NO: 1151 - DNA, 203 bp, Homo sapiens
  source 1..203: mol_type = other DNA
ggcgcgccagtcctatggagactgaaagtgagagtagcactttaggggatgacagtgtcttctggttggagtctgaagttataatccaggtgactgactgtgaagaggaagaaagggaagagaagttcaggaagatgaagtcctcagtacattctgaagaagatgattttgttccagagctacatagacgactcggaccgatg

SEQ ID NO: 1152 - DNA, 203 bp, Homo sapiens
  source 1..203: mol_type = other DNA
ggcgcgccagtcctttgagtatttccgtccaatcaaaaggagactgtaagaggaggaggaggaggagatgactggggagcgggagctggagaatactgcccagttactctagcgcgccaggccgaaccgcagcttcttggcttaggtacttctactcacagcggccgattccgaggccaactccagcacgactcggaccgatg

SEQ ID NO: 1153 - DNA, 203 bp, Homo sapiens
  source 1..203: mol_type = other DNA
ggcgcgccagtcctgcgcgcgcttgggcgcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggcgactcggaccgatg

SEQ ID NO: 1154 - DNA, 203 bp, Homo sapiens
  source 1..203: mol_type = other DNA
ggcgcgccagtcctagggctgaggcataaaactgccagagggtctcaaggcaggcaaagaagaaccatgaggctcatcctgcctgtgggtttgattgctaccactcttgcaattgctcctgtccgctttgacagggagaaggtgttccgcgtgaagccccaggatgaaaaacaagcagacatcataaacgactcggaccgatg

SEQ ID NO: 1155 - DNA, 203 bp, Homo sapiens
  source 1..203: mol_type = other DNA
ggcgcgccagtcctcgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgacccgactcggaccgatg

SEQ ID NO: 1156 - DNA, 203 bp, Homo sapiens
  source 1..203: mol_type = other DNA
ggcgcgccagtccttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagcccgactcggaccgatg

SEQ ID NO: 1157 - DNA, 203 bp, Homo sapiens
  source 1..203: mol_type = other DNA
ggcgcgccagtccttgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtggtgactctcaaaaggaaataggatccgactcggaccgatg

SEQ ID NO: 1158 - DNA, 203 bp, Homo sapiens
  source 1..203: mol_type = other DNA
ggcgcgccagtcctgctccgcccccgcgccgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgcgactcggaccgatg

SEQ ID NO: 1159 - DNA, 203 bp, Homo sapiens
  source 1..203: mol_type = other DNA
ggcgcgccagtcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtattttccacttgttcatcaatcgactcggaccgatg

SEQ ID NO: 1160 - DNA, 203 bp, Homo sapiens
  source 1..203: mol_type = other DNA
ggcgcgccagtcctgccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttcgactcggaccgatg

SEQ ID NO: 1161 - DNA, 203 bp, Homo sapiens
  source 1..203: mol_type = other DNA
ggcgcgccagtcctgggacggtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggacgactcggaccgatg

SEQ ID NO: 1162 - DNA, 203 bp, Homo sapiens
  source 1..203: mol_type = other DNA
ggcgcgccagtcctgctgcctgagaaggattggcacgggcacagaccactgcccccacctgccctgcgccatctacccaagaaggctcggcacgggcaccaaccactgcctccaactgccccatgctgcctgagaaggcactgcacggccacccccaactgccccgcactgtccctacccgggcagcccgactcggaccgatg

SEQ ID NO: 1163 - DNA, 203 bp, Homo sapiens
  source 1..203: mol_type = other DNA
ggcgcgccagtcctaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggcccgactcggaccgatg

SEQ ID NO: 1164 - DNA, 203 bp, Homo sapiens
  source 1..203: mol_type = other DNA
ggcgcgccagtcctcaccctcgcgatctgtcaagtctgtccccaggggaggtccccctttcgggaggaagtttttaaggggatttctcaaaatcacccccgcgcttccttcactccttccttagagccggaggtcggtgagggcccgcggaatcatctatctcgcccccgtcgcagcgcgcagggacccgactcggaccgatg

SEQ ID NO: 1165 - DNA, 203 bp, Homo sapiens
  source 1..203: mol_type = other DNA
ggcgcgccagtcctctgcgtcagccagcccagctatttaagcaggctggcatcagcaaacacagcttccaaacccagggcttgcgcttgcctttgcctcttccacactaatgacagactgccccactgagaagggtctagcggagcacaggtcaccagctgggcaacattcagaaagttagtcttcctcgactcggaccgatg

SEQ ID NO: 1166 - DNA, 203 bp, Homo sapiens
  source 1..203: mol_type = other DNA
ggcgcgccagtcctaaaaactgcgggaagcaggaaagagcacaacaggtttctctctatttccggtgtattgtatcctcacgtttccggagattgacgttgctcttgtgttctcgcgagaggcgggaaagggcgcagggtttgaaacatggcggacgacgtagaccagcaacaaactaccaacactgtcgactcggaccgatg

SEQ ID NO: 1167 - DNA, 203 bp, Homo sapiens
  source 1..203: mol_type = other DNA
ggcgcgccagtcctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaaccgactcggaccgatg

SEQ ID NO: 1168 - DNA, 203 bp, Homo sapiens
  source 1..203: mol_type = other DNA
ggcgcgccagtcctgcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagcgactcggaccgatg

SEQ ID NO: 1169 - DNA, 203 bp, Homo sapiens
  source 1..203: mol_type = other DNA
ggcgcgccagtcctcttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggccgactcggaccgatg

SEQ ID NO: 1170 - DNA, 203 bp, Homo sapiens
  source 1..203: mol_type = other DNA
ggcgcgccagtcctatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccgactcggaccgatg

SEQ ID NO: 1171 - DNA, 203 bp, Homo sapiens
  source 1..203: mol_type = other DNA
ggcgcgccagtcctcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcatacgactcggaccgatg

SEQ ID NO: 1172 - DNA, 203 bp, Homo sapiens
  source 1..203: mol_type = other DNA
ggcgcgccagtcctggagaataaaataatcaggaggctgggtttgtgcttggctccaagcatgccctgctctctgacctggagactaccacctcgcacatgccaaggtcaggggctcccaaagagcgccctgcggagcctctcacccctcccccatcctatggccaccagccacagacagggtctgggcgactcggaccgatg

SEQ ID NO: 1173 - DNA, 203 bp, Homo sapiens
  source 1..203: mol_type = other DNA
ggcgcgccagtcctctgttcgccccgcgccaccggcccgcgccccgccatggaggacctggatgccctgctctctgacctggagactaccacctcgcacatgccaaggtcaggggctcccaaagagcgccctgcggagcctctcacccctcccccatcctatggccaccagccacagacagggtctggcgactcggaccgatg

SEQ ID NO: 1174 - DNA, 203 bp, Homo sapiens
  source 1..203: mol_type = other DNA
ggcgcgccagtcctgcggagcagtggaaccgagactgccccgcggagccgccgctagacttcgggctccttgaggatattcagttttgtatgtttgaatatcctctcaccatgttcagcataaagtaccattcttaatgattatcctcaacaagacaggtgtgagagggttgctgttgtattgcaatccgactcggaccgatg

SEQ ID NO: 1175 - DNA, 203 bp, Homo sapiens
  source 1..203: mol_type = other DNA
ggcgcgccagtcctggggccggatccccggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccgactcggaccgatg

SEQ ID NO: 1176 - DNA, 203 bp, Homo sapiens
  source 1..203: mol_type = other DNA
ggcgcgccagtcctcttcctctccaggatccccaaggctaggaggccaacctactaacagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 1177 - DNA, 203 bp, Homo sapiens
  source 1..203: mol_type = other DNA
ggcgcgccagtcctagctccgcgggcccggctgggcgagtgtctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctcccgactcggaccgatg

SEQ ID NO: 1178 - DNA, 203 bp, Homo sapiens
  source 1..203: mol_type = other DNA
ggcgcgccagtcctggggcaagacagctccaccaggagtcaggagtgaatcccctctgggaacgaggcactaggaagaagaacttccagcccaggagaaataacatctgctttgctgccgagctcagaggagaccccagacccctcccgcagccagagggctggagcctgctcagaggtgctttgaagcgactcggaccgatg

SEQ ID NO: 1179 - DNA, 203 bp, Homo sapiens
  source 1..203: mol_type = other DNA
ggcgcgccagtcctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcacgactcggaccgatg

SEQ ID NO: 1180 - DNA, 203 bp, Homo sapiens
  source 1..203: mol_type = other DNA
ggcgcgccagtcctgggagtgaacggagagcgtagtgaccatcatgttttagcacaaccccctcagaccactctgtggagaacagactgtcagggaacgtgggtggaggcagagagaccagaaagattccaggacagagatgacagaggcttaggccatggagcctcctcaacaagcccaagagtgagcgactcggaccgatg

SEQ ID NO: 1181 - DNA, 203 bp, Homo sapiens
  source 1..203: mol_type = other DNA
ggcgcgccagtcctttccttacaccaatcggaacgtgcaggggtggggagctggccaatcaggcgcggagggcggggccgggcggggttccacctggcggctggctctcagtcccctcgctgtagtcgcggagctgtgtctgttcccaggagtccttcggcggctgttgtgtcgggagcctgatcgcgcgactcggaccgatg

SEQ ID NO: 1182 - DNA, 203 bp, Homo sapiens
  source 1..203: mol_type = other DNA
ggcgcgccagtcctctgtgcggtcacttccggcccgggagcgcgcgggttgattcgtccttcctcagccgcgggtgatcgtagctcggaaatggcgggatttggtgctatggagaaatttttggtagaatataagagtgcagtggagaagaaactggcagagtacaaatgtaacaccaacacagcaatcgactcggaccgatg

SEQ ID NO: 1183 - DNA, 203 bp, Homo sapiens
  source 1..203: mol_type = other DNA
ggcgcgccagtcctgtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctcgactcggaccgatg

SEQ ID NO: 1184 - DNA, 203 bp, Homo sapiens
  source 1..203: mol_type = other DNA
ggcgcgccagtcctaagtcgagaggcggtgcacacccgtcgcgcatgcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatgcgactcggaccgatg

SEQ ID NO: 1185 - DNA, 203 bp, Homo sapiens
  source 1..203: mol_type = other DNA
ggcgcgccagtcctacggaaacagaaattgctttgcggcccgcacggaaattgctttccttcggcttccgttcttggtccatgtgagagaagctggctgctgaaatgactgcgaaccggcttgcagagagccttctggctttgagccaacaggaagaactagcggatttgccaaaagactacctcttgcgactcggaccgatg

SEQ ID NO: 1186 - DNA, 203 bp, Homo sapiens
  source 1..203: mol_type = other DNA
ggcgcgccagtccttggtggtccggttatgggaaaagaagcctcgtgggagagcagagcctgaaaaaggactgcgcggactgacttcttggctactgaaagcaaagctccactgttccaggcacgattctgccttctctcaaatggcataactcaggactctgcaaattcccagaaacaggaggaaaacgactcggaccgatg

SEQ ID NO: 1187 - DNA, 203 bp, Homo sapiens
  source 1..203: mol_type = other DNA
ggcgcgccagtcctccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctccgactcggaccgatg

SEQ ID NO: 1188 - DNA, 203 bp, Homo sapiens
  source 1..203: mol_type = other DNA
ggcgcgccagtcctgtctctttcttagtttgatttgctagctggtttaatctgttttgtgtagtgccttggagcttacgcatttttttttttttccctccattcgaattcactaagagcaagcatgagggatatgagagtgaacatggctgcagtttttcctgcttaagcttgctttgatccttttaacgactcggaccgatg

SEQ ID NO: 1189 - DNA, 203 bp, Homo sapiens
  source 1..203: mol_type = other DNA
ggcgcgccagtcctatgagagaagaggagcggcgctcaggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggaccgactcggaccgatg

SEQ ID NO: 1190 - DNA, 203 bp, Homo sapiens
  source 1..203: mol_type = other DNA
ggcgcgccagtcctttgaaacccgagccatctcaccgctcgcccccaaccctgggctctggctgtttaaaagctggagaggaagtgaaagcgtcaagtacagttgatagaagtccagatcctgaggaaatctccagctaaatgctcaaaatataaaatactgagctgagatttgcgaagagcagcagccgactcggaccgatg

SEQ ID NO: 1191 - DNA, 203 bp, Homo sapiens
  source 1..203: mol_type = other DNA
ggcgcgccagtcctgtcttacctcgttgtggcgtcagaaccgccgtcgctcgctcccttctcggcagtggtacctgttcccggtgtccctgaggacgtgcgggccaggtttgcggggccaagtgttgcggcgacgcacctcacgtcgagaatcgggaggaggagactgcaaggataggcccaggagtacgactcggaccgatg

SEQ ID NO: 1192 - DNA, 203 bp, Homo sapiens
  source 1..203: mol_type = other DNA
ggcgcgccagtcctcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggcgactcggaccgatg

SEQ ID NO: 1193 - DNA, 203 bp, Homo sapiens
  source 1..203: mol_type = other DNA
ggcgcgccagtcctgaagtcggcgtcttgagtcataggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggacgactcggaccgatg

SEQ ID NO: 1194 - DNA, 203 bp, Homo sapiens
  source 1..203: mol_type = other DNA
ggcgcgccagtcctcggcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgcccgactcggaccgatg

SEQ ID NO: 1195 - DNA, 203 bp, Homo sapiens
  source 1..203: mol_type = other DNA
ggcgcgccagtcctcggttcttaagcggcagcgcgctgcgggcgccgagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaacgactcggaccgatg

SEQ ID NO: 1196 - DNA, 203 bp, Homo sapiens
  source 1..203: mol_type = other DNA
ggcgcgccagtcctggagcagccgacgtggccgcaggggaccgtgcctgggggggtctgcgcggggccgctgactcgcgaggttctctgtcgcctgccgccctcgctccttttctccccttctagagtgttacggtgactcttgggtccgaaggggacggacgtcctcccacgtaccatttagaagaacgactcggaccgatg

SEQ ID NO: 1197 - DNA, 203 bp, Homo sapiens
  source 1..203: mol_type = other DNA
ggcgcgccagtcctgcctggtgatatgcagctgtacctgtgacatcataattgcaccctccgacatgatatctcttccaaatgcttgatgaaaaaggtgggaggatcacttgagccagggagttgaaggctgcagtgagccctgtttttgccaccacactccagcttgggattgattcctaaagactccgactcggaccgatg

SEQ ID NO: 1198 - DNA, 203 bp, Homo sapiens
  source 1..203: mol_type = other DNA
ggcgcgccagtcctagctccggctccccctatataaatcggccatttgcttcgctccgccccgcagcgccggagtcaaagccggttcccggcccagtcccgtcctgcagcagtctgcctcctctttcaacatgacagatgccgctgtgtccttcgccaaggacttcctggcaggtggagtggccgcagcgactcggaccgatg

SEQ ID NO: 1199 - DNA, 203 bp, Homo sapiens
  source 1..203: mol_type = other DNA
ggcgcgccagtcctggccgcagctccccggcggaggcaagaggtggttgggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttctcgactcggaccgatg

SEQ ID NO: 1200 - DNA, 203 bp, Homo sapiens
  source 1..203: mol_type = other DNA
ggcgcgccagtcctatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgcccgactcggaccgatg

SEQ ID NO: 1201 - DNA, 203 bp, Homo sapiens
  source 1..203: mol_type = other DNA
ggcgcgccagtcctgcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccacccgactcggaccgatg

SEQ ID NO: 1202 - DNA, 203 bp, Homo sapiens
  source 1..203: mol_type = other DNA
ggcgcgccagtcctctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagacgactcggaccgatg

SEQ ID NO: 1203 - DNA, 203 bp, Homo sapiens
  source 1..203: mol_type = other DNA
ggcgcgccagtccttcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggcgactcggaccgatg

SEQ ID NO: 1204 - DNA, 203 bp, Homo sapiens
  source 1..203: mol_type = other DNA
ggcgcgccagtcctatgagtcttctagctaaacctatgagctttgaaaccacagcaatcactttcttcatcatccttctaatttgcctcatttgcatcctcctcttattggtggtttttttatataaatgtttccaaggcaggaaaggtaaagagacaaagaaagtgccttgtacagatgcaaacggacgactcggaccgatg

SEQ ID NO: 1205 - DNA, 203 bp, Homo sapiens
  source 1..203: mol_type = other DNA
ggcgcgccagtcctagagtcttaaaatcctgctctggccggattccagactcgtgggggaaaggctgtttccaaggcaggaaaggtaaagagacaaagaaagtgccttgtacagatgcaaacggaggtgtagactgtgcagctgccaaagtggtgacaagcaatccagaggaccatgaaaggatcttacgactcggaccgatg

SEQ ID NO: 1206 - DNA, 203 bp, Homo sapiens
  source 1..203: mol_type = other DNA
ggcgcgccagtcctcttgcccggcgcgacctgatgatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgactcggaccgatg

SEQ ID NO: 1207 - DNA, 203 bp, Homo sapiens
  source 1..203: mol_type = other DNA
ggcgcgccagtcctaattcccaaaaggccacaaaggggccaccactacgcatgcgtagatccctcccgttagctttggcgcctcagcgagctcttctcgcgcatgcgttctccgaacggtcttcttccgacagcttgctgccctagaccagagttggtggctggacctcctgcgacttccgagttgcgcgactcggaccgatg

SEQ ID NO: 1208 - DNA, 203 bp, Homo sapiens
  source 1..203: mol_type = other DNA
ggcgcgccagtcctggccgcggcgtcgcgtcggaacgtgactggatggtagtgtgctggccggtctgcctccgggagaaccgagcgcttccggtggtttggctttgaatgacagcaagaactctgtctttaatggcttcattggtagcgtatgatgattcggactcggaggctgagacagagcatgcacgactcggaccgatg

SEQ ID NO: 1209 - DNA, 203 bp, Homo sapiens
  source 1..203: mol_type = other DNA
ggcgcgccagtcctgcgcctaaagcgccccgtgccgcttaacgcggtctctcatagccgctcgccttcctttcacttcctgttccttcagaaagcgctgtgccttggaccaaccttacttcttactattgacagctcagctaactcctattcatccttcaaaacccatctctggtggtttggctttgacgactcggaccgatg

SEQ ID NO: 1210 - DNA, 203 bp, Homo sapiens
  source 1..203: mol_type = other DNA
ggcgcgccagtcctcgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggacgactcggaccgatg

SEQ ID NO: 1211 - DNA, 203 bp, Homo sapiens
  source 1..203: mol_type = other DNA
ggcgcgccagtcctcagttactttcaggctcggggagtgaaggcctcgttgagagaaggtctcattcggtgttttgggaagagagtcgtgtgggcccaggtctgtctgctatcagctatgccgctgcccgttgcgctgcagacccgcttggccaagagaggcatcctcaaacatctggagcctgaacccgactcggaccgatg

SEQ ID NO: 1212 - DNA, 203 bp, Homo sapiens
  source 1..203: mol_type = other DNA
ggcgcgccagtccttgagccccggggctgcgtttcctgagacctggccgcagcctccgcgggtggcaagcgggctggggagagccgagggccaaaggaagagaaaatcgcggggagtctctggccgggagagtccaggtagcgctcggcgggcagcagtgcgcaggcccctcggcttcaaccgccacacgactcggaccgatg

SEQ ID NO: 1213 - DNA, 203 bp, Homo sapiens
  source 1..203: mol_type = other DNA
ggcgcgccagtcctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctaccgactcggaccgatg

SEQ ID NO: 1214 - DNA, 203 bp, Homo sapiens
  source 1..203: mol_type = other DNA
ggcgcgccagtcctgaaaggccccaggggctattttttgcaggaacggtcactccctaaatccaggcagggaaagggaggagtctgagccgagtcacgccccttctcctgtaaacttgggtcgcctctagcttagcgagcgctggagtttgaagagcgggcagtggctgcacacgccaaactttccctcgactcggaccgatg

SEQ ID NO: 1215 - DNA, 203 bp, Homo sapiens
  source 1..203: mol_type = other DNA
ggcgcgccagtcctcgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgcgactcggaccgatg

SEQ ID NO: 1216 - DNA, 203 bp, Homo sapiens
  source 1..203: mol_type = other DNA
ggcgcgccagtcctcctcaatcggcgggacagcagggcgcgtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagcccgactcggaccgatg

SEQ ID NO: 1217 - DNA, 203 bp, Homo sapiens
  source 1..203: mol_type = other DNA
ggcgcgccagtcctagcggtctcccgcccgcggcgccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcacgactcggaccgatg

SEQ ID NO: 1218 - DNA, 203 bp, Homo sapiens
  source 1..203: mol_type = other DNA
ggcgcgccagtccttcgtgcgcctgcagcccttggttcttggaaacgccggcgccttgttcagggctggtggggctggggcgcaaggtgcagctgacaatgcccgagaggagccgcagcctctggtggagttcggtcgggtgtgggggtagtcaaggaaagaagcaaagggaatacctcctctgaaaacgactcggaccgatg

SEQ ID NO: 1219 - DNA, 203 bp, Homo sapiens
  source 1..203: mol_type = other DNA
ggcgcgccagtccttttctcccaggccccgcccctccgtccctcaccgcaccacccctaaagacgctagcgctgcgatggcggaggccgtggagcgcactgacgagctggtccgggagtacctgctcttccgcgggttcacgcacacactgcggcagctggacgccgagatcaaggcggacaaggagacgactcggaccgatg

SEQ ID NO: 1220 - DNA, 203 bp, Homo sapiens
  source 1..203: mol_type = other DNA
ggcgcgccagtcctttgtgggagtcgtagtccgcggtgaggcccagtgcgcaggcgcagtttgccggccgccatcgcgcactggggctccgggcggctgggaccggcctggggtagctgcgcagcaggtgggtcggtcccggggatgcagcgcgggggtcagagagcgaccccaacagggtagacgggcgactcggaccgatg

SEQ ID NO: 1221 - DNA, 203 bp, Homo sapiens
  source 1..203: mol_type = other DNA
ggcgcgccagtcctgccttctgcccggccccttcgcccacgtgaagaacgccagggagctgtgaggcagtgctgtgtggttcctgccgtccggactctttttcctctactgagattcatctgtgtgaaatatgagttggcgaggaagatcgacctatcggcctagaccaagacgctacgtagagcctccgactcggaccgatg

SEQ ID NO: 1222 - DNA, 203 bp, Homo sapiens
  source 1..203: mol_type = other DNA
ggcgcgccagtccttagagctgagcagttgtccgcgtgcgcaggcggaagtcccggattgaggcgccgccatttttgctgcccggacgcggagcgagaggctgagagagtcggagacactatccgcttccatccgtcgcgcagaccctgccggagccgctgccgctatggatgatcgagaggatctggcgactcggaccgatg

SEQ ID NO: 1223 - DNA, 203 bp, Homo sapiens
  source 1..203: mol_type = other DNA
ggcgcgccagtccttattttaagcccagtcttccctgggccacctttagcagatcctcgtgcgcccccgccccctggccgtgaaactcagcctctatccagcagcgacgacaagtaaagtggcccgccggtttctgagccttctgccctgcggggacacggtctgcaccctgcccgcggccacggacccgactcggaccgatg

SEQ ID NO: 1224 - DNA, 203 bp, Homo sapiens
  source 1..203: mol_type = other DNA
ggcgcgccagtcctactcgcacatgcgagcacattccttccttccttctcactctctcggcccttgacttctacaagcccatggaacatttctggaaagacgttcttgatccagcagggtggcccgccggtttctgagccttctgccctgcggggacacggtctgcaccctgcccgcggccacggacccgactcggaccgatg

SEQ ID NO: 1225 - DNA, 203 bp, Homo sapiens
  source 1..203: mol_type = other DNA
ggcgcgccagtcctacaaagatctcttcacattctccgggactgcggtaccaaatatcagcacagcacttcttgaaaaaggatgtagattttaatctgaactttgaaccatcactgaggtggcccgccggtttctgagccttctgccctgcggggacacggtctgcaccctgcccgcggccacggacccgactcggaccgatg

SEQ ID NO: 1226 - DNA, 203 bp, Homo sapiens
  source 1..203: mol_type = other DNA
ggcgcgccagtcctacggactgctaaaggtctcccctcccacctgcattgctctacaatctgtggcctcagcccttgccaactctgcctcttcccccgctgactgggcctctgcagagatgtgggcagctggtcaggatggccattcgggctcagcacagcaacgcagcccagactcagactggggaacgactcggaccgatg

SEQ ID NO: 1227 - DNA, 203 bp, Homo sapiens
  source 1..203: mol_type = other DNA
ggcgcgccagtcctaagaaaggtaagggccctgggcgaggaaagcgcggccctttccgagtttggtgttttgcagcgaaaggaaatctcgctcttccgaaagtcctccagggcgagagaggaaagggcctagaatacctcctctgaaaaatggcagaagcagttttccatgccccaaagaggaaaagacgactcggaccgatg

SEQ ID NO: 1228 - DNA, 203 bp, Homo sapiens
  source 1..203: mol_type = other DNA
ggcgcgccagtcctatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagcccgactcggaccgatg

SEQ ID NO: 1229 - DNA, 203 bp, Homo sapiens
  source 1..203: mol_type = other DNA
ggcgcgccagtcctagacgcgacggtgctgggatcccgggagggagcggagcggacctgggcttggtcgcctccaagccggcgggaccgagtgctttaggccgcttgaaagaaagttgctccgacccgggaaaaggagaagatgaaggaagccaaggatgcccgctataccaatgggcacctcttcaccgactcggaccgatg

SEQ ID NO: 1230 - DNA, 203 bp, Homo sapiens
  source 1..203: mol_type = other DNA
ggcgcgccagtcctgtcagacttcctgtccccgagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggccgactcggaccgatg

SEQ ID NO: 1231 - DNA, 203 bp, Homo sapiens
  source 1..203: mol_type = other DNA
ggcgcgccagtcctaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctcgactcggaccgatg

SEQ ID NO: 1232 - DNA, 203 bp, Homo sapiens
  source 1..203: mol_type = other DNA
ggcgcgccagtcctgtaaggaggaaaactgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccacgactcggaccgatg

SEQ ID NO: 1233 - DNA, 203 bp, Homo sapiens
  source 1..203: mol_type = other DNA
ggcgcgccagtcctgcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcacgactcggaccgatg

SEQ ID NO: 1234 - DNA, 203 bp, Homo sapiens
  source 1..203: mol_type = other DNA
ggcgcgccagtcctgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggcgactcggaccgatg

SEQ ID NO: 1235 - DNA, 203 bp, Homo sapiens
  source 1..203: mol_type = other DNA
ggcgcgccagtccttctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgccgactcggaccgatg

SEQ ID NO: 1236 - DNA, 203 bp, Homo sapiens
  source 1..203: mol_type = other DNA
ggcgcgccagtcctgcttcatttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgactcggaccgatg

SEQ ID NO: 1237 - DNA, 203 bp, Homo sapiens
  source 1..203: mol_type = other DNA
ggcgcgccagtcctagcccaagatttctagggcattggccgcgctgctgggtgatccctccgggctcaagttgcaagggggcgggccgggccggaggtggagtctcccgccaattgaagcctccgctataaattgaactccctgcactgctgaagcccagatgcctcgccaggccacgtcgcggttggcgactcggaccgatg

SEQ ID NO: 1238 - DNA, 203 bp, Homo sapiens
  source 1..203: mol_type = other DNA
ggcgcgccagtcctgctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctacgactcggaccgatg

SEQ ID NO: 1239 - DNA, 203 bp, Homo sapiens
  source 1..203: mol_type = other DNA
ggcgcgccagtcctatgaatatgcaagtgcgaggaagatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcgactcggaccgatg

SEQ ID NO: 1240 - DNA, 203 bp, Homo sapiens
  source 1..203: mol_type = other DNA
ggcgcgccagtcctcctgcctcctcagatctcgtttcttcggctacgaatctcgcgagaagtcaagttctcatgagttctcccaaaatccaccgctcttcctctttccctaagcagcctgaggtgatctgtgaaaatggttcgctattcacttgacccggagaaccccacgaaatcatgcaaatcaagcgactcggaccgatg

SEQ ID NO: 1241 - DNA, 203 bp, Homo sapiens
  source 1..203: mol_type = other DNA
ggcgcgccagtcctagtcaagttctcatgagttctcccaaaatccaccgctcttcctctttccctaagcagcctgagggttgactggattggtgaggcccgtgtggctacttctgtggaagcagtgctgtagttactggaagataaaagggaaagcaagcccttggtgggggaaagtgatctgtgaaacgactcggaccgatg

SEQ ID NO: 1242 - DNA, 203 bp, Homo sapiens
  source 1..203: mol_type = other DNA
ggcgcgccagtcctcgctggaggcggtggcttcttatgcgggaggacgtggcggagggcctgactttgggagccgggggttgactggattggtgaggcccgtgtggctacttctgtggaagcagtgctgtagttactggaagataaaagggaaagcaagcccttggtgggggaaagtgatctgtgaaacgactcggaccgatg

SEQ ID NO: 1243 - DNA, 203 bp, Homo sapiens
  source 1..203: mol_type = other DNA
ggcgcgccagtcctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagcgactcggaccgatg

SEQ ID NO: 1244 - DNA, 203 bp, Homo sapiens
  source 1..203: mol_type = other DNA
ggcgcgccagtcctttcttcggctacgaatctcgcgagaagtcaagttctcatgagttctcccaaaatccaccgctcttcctctttccctaagcagcctgaggtgatctgtgaaaatggttcgctattcacttgacccggagaaccccacgaaataacactcgtgaaactgctcaggccatcaagggtcgactcggaccgatg

SEQ ID NO: 1245 - DNA, 203 bp, Homo sapiens
  source 1..203: mol_type = other DNA
ggcgcgccagtccttttttctcccagcaagctgtgcgacgcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgacgactcggaccgatg

SEQ ID NO: 1246 - DNA, 203 bp, Homo sapiens
  source 1..203: mol_type = other DNA
ggcgcgccagtcctgacaaccggcgtggaggcgtggccacagccgcccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcgactcggaccgatg

SEQ ID NO: 1247 - DNA, 203 bp, Homo sapiens
  source 1..203: mol_type = other DNA
ggcgcgccagtcctgtctcaggacgggcgctttggagccggccccaggcagcgtgtgtcggtcgcctagtctggagaactagtcctcgactcacgtgcaaggatgatgctgaaaggaataacaaggcttatctctaggatccataagttggaccctgggcgttttttacacatggggacccaggctcgcgactcggaccgatg

SEQ ID NO: 1248 - DNA, 203 bp, Homo sapiens
  source 1..203: mol_type = other DNA
ggcgcgccagtcctgacgggcgctttggagccggccccaggcagcgtgtgtcggtcgcctagtctggagaactagtcctcgactcacgagatgaagttttaccatgttggccaggctggtctcgaattcctgacctcaagtgatctgcccaccttgacctcccaaagtgctgggattacagtgcaaggcgactcggaccgatg

SEQ ID NO: 1249 - DNA, 203 bp, Homo sapiens
  source 1..203: mol_type = other DNA
ggcgcgccagtcctgcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtccgactcggaccgatg

SEQ ID NO: 1250 - DNA, 203 bp, Homo sapiens
  source 1..203: mol_type = other DNA
ggcgcgccagtcctctgagtcgctgtcgcggaggctggagcgctgccccggaagtcctcccccctgttccccgcccgcggcaaacatggcggtggactcggcgatggagctgttatttttagatacttttaaacacccgagcgctgagcaaagttctcatatagatgtggttcgttttccatgtgtggcgactcggaccgatg

SEQ ID NO: 1251 - DNA, 203 bp, Homo sapiens
  source 1..203: mol_type = other DNA
ggcgcgccagtcctgtcatttattattattgctattagtgttacctattattttctttttgaacccacttattgcctaattagtcatagtttgacaattgcccttgtattccaccatgtcaaatataaatttacatagatgaagctcctgaaattattcttgggttaccattttgtgaagctattgatcgactcggaccgatg

SEQ ID NO: 1252 - DNA, 203 bp, Homo sapiens
  source 1..203: mol_type = other DNA
ggcgcgccagtcctagattgtttcacatcaccagtgtatcctcagctcctaacactgtgtctggtacacattgtttgatggttttgatgtttcagattcgttatatttcacaaacacaaggcttgccagctgaatatcttctcagtgccggaacaaaaacaaccaggtttttcaacagagatcctaatcgactcggaccgatg

SEQ ID NO: 1253 - DNA, 203 bp, Homo sapiens
  source 1..203: mol_type = other DNA
ggcgcgccagtcctcggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgcgactcggaccgatg

SEQ ID NO: 1254 - DNA, 203 bp, Homo sapiens
  source 1..203: mol_type = other DNA
ggcgcgccagtcctgcgcggtcgctcagcagtgacgtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggcgactcggaccgatg

SEQ ID NO: 1255 - DNA, 203 bp, Homo sapiens
  source 1..203: mol_type = other DNA
ggcgcgccagtcctgcgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctcgactcggaccgatg

SEQ ID NO: 1256 - DNA, 203 bp, Homo sapiens
  source 1..203: mol_type = other DNA
ggcgcgccagtccttttttcaaaagattcgttctgagccgtttaaaatgctcttgtgttctacgaagtctctttgcatccttgaacaccggggaatttccaggtatttcatttctcctgtcccctcccctccccaccccatctattaatattattcttttgaagattcttcgttgtcaagccgccaaacgactcggaccgatg

SEQ ID NO: 1257 - DNA, 203 bp, Homo sapiens
  source 1..203: mol_type = other DNA
ggcgcgccagtccttcgccccgcgggccggccgagacgacgggaagttttatttgcagctcggagcctgtggcggatggtgggactctccggccctgtgcagtaaaagattgatctctgggctggtgaacataatctctgtcccagtcagaaaaggagagaggaaattagcagagcgattggtggagacgactcggaccgatg

SEQ ID NO: 1258 - DNA, 203 bp, Homo sapiens
  source 1..203: mol_type = other DNA
ggcgcgccagtcctctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacacgactcggaccgatg

SEQ ID NO: 1259 - DNA, 203 bp, Homo sapiens
  source 1..203: mol_type = other DNA
ggcgcgccagtcctgcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgagcgactcggaccgatg

SEQ ID NO: 1260 - DNA, 203 bp, Homo sapiens
  source 1..203: mol_type = other DNA
ggcgcgccagtcctccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacacgactcggaccgatg

SEQ ID NO: 1261 - DNA, 203 bp, Homo sapiens
  source 1..203: mol_type = other DNA
ggcgcgccagtcctttctggggtggctctagtctcatggccacaaagctctagcccaggcgccgcgaggcactggcattgagagcccaatgcatctcagcctcacgctgcagaagccagtggggctggggagccgcagcagcgtcgattttcttcacaagaagatgggaactgtgggctacaagtaggcgactcggaccgatg

SEQ ID NO: 1262 - DNA, 203 bp, Homo sapiens
  source 1..203: mol_type = other DNA
ggcgcgccagtcctcccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagctctagggcccgtgcaggccacacccgactcggaccgatg

SEQ ID NO: 1263 - DNA, 203 bp, Homo sapiens
  source 1..203: mol_type = other DNA
ggcgcgccagtcctccgcccgcgccatggtctcgccctagggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacacccgactcggaccgatg

SEQ ID NO: 1264 - DNA, 203 bp, Homo sapiens
  source 1..203: mol_type = other DNA
ggcgcgccagtcctaggcggcgcgggcggcgcctcagcggaagagcgggcctctgggccgcagtgaccaacccccgcccctcaccccacgtggttggaggtttccagaagcgctgccgccaccgcatcgcgcagctctttgccgtcggagcgcttgtttgctgcctcgtactcctccatttatccgcccgactcggaccgatg

SEQ ID NO: 1265 - DNA, 203 bp, Homo sapiens
  source 1..203: mol_type = other DNA
ggcgcgccagtcctatggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggcccgactcggaccgatg

SEQ ID NO: 1266 - DNA, 203 bp, Homo sapiens
  source 1..203: mol_type = other DNA
ggcgcgccagtcctgcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacagtgcttgtgaaactgaacacaacaaaagtcgactcggaccgatg

SEQ ID NO: 1267 - DNA, 203 bp, Homo sapiens
  source 1..203: mol_type = other DNA
ggcgcgccagtcctgtgcagcggctgccacggagctcgcagctgcggcttctgaggagtaagcggcgcggtagcgaaggccgccgaacctgcctggctagccggcgacttgagtgacgactcttttgaaacagatggtcaccatgtttagatattagcagtcccatatatgcatgtctgcatttgaaacgactcggaccgatg

SEQ ID NO: 1268 - DNA, 203 bp, Homo sapiens
  source 1..203: mol_type = other DNA
ggcgcgccagtccttgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttggtgcttgtgaaactgaacacaacaaaagtcgactcggaccgatg

SEQ ID NO: 1269 - DNA, 203 bp, Homo sapiens
  source 1..203: mol_type = other DNA
ggcgcgccagtccttctgaagagaggcgggacgcggggtgataacagctggctctggtgggcgggcgggagctggggaggaggagcaggagaggcccacaggcttcatttggagtcaggcctggctgttgctcaggtgaccagcttgtgtctctgggagggcgctgctttccccggccacccggcgcgcgactcggaccgatg

SEQ ID NO: 1270 - DNA, 203 bp, Homo sapiens
  source 1..203: mol_type = other DNA
ggcgcgccagtcctgtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggcgactcggaccgatg

SEQ ID NO: 1271 - DNA, 203 bp, Homo sapiens
  source 1..203: mol_type = other DNA
ggcgcgccagtcctaactcccaagccccacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcacgactcggaccgatg

SEQ ID NO: 1272 - DNA, 203 bp, Homo sapiens
  source 1..203: mol_type = other DNA
ggcgcgccagtccttgggcttggcctgccttgccctgccgggaagtgatccccaaggcagggtgagagttccccatctgaggcgtttgttgcagctacctgcacttctagatgctccccaggttcatcctgtgtcgtctcccccacctaccagtcatcttcttgtgagccctgggcttaggagtcacccgactcggaccgatg

SEQ ID NO: 1273 - DNA, 203 bp, Homo sapiens
  source 1..203: mol_type = other DNA
ggcgcgccagtcctgtgcgctgctgcgcaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataacgactcggaccgatg

SEQ ID NO: 1274 - DNA, 203 bp, Homo sapiens
  source 1..203: mol_type = other DNA
ggcgcgccagtccttagcaccacccgagccaatggcggcggccgaggggcggagggggctggcaggaggggagggagcgctggctttagagccacagctgcaaagattccgaggtgcagaagttgtctgagtgcgttggtcggcggcagtcgggccagacccaggactctgcgactttacatctttaacgactcggaccgatg

SEQ ID NO: 1275 - DNA, 203 bp, Homo sapiens
  source 1..203: mol_type = other DNA
ggcgcgccagtccttagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtcgactcggaccgatg

SEQ ID NO: 1276 - DNA, 203 bp, Homo sapiens
  source 1..203: mol_type = other DNA
ggcgcgccagtcctcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctccgactcggaccgatg

SEQ ID NO: 1277 - DNA, 203 bp, Homo sapiens
  source 1..203: mol_type = other DNA
ggcgcgccagtcctgcgcatggtgagtaggttggtccgaagtttgaaccggacagaagcgctggtcggcgtctggcggttattgttcaaaactacaactccattttgacactttctcacttgtaccgatcttcagacgccctccttcttcatgagaatgatgccatccataagatctgtgcaaaactgcgactcggaccgatg

SEQ ID NO: 1278 - DNA, 203 bp, Homo sapiens
  source 1..203: mol_type = other DNA
ggcgcgccagtcctagagcgcagggagcagccggtggctcggcggcggcggcggcggcggcggcggcgtcggcgtcgtctacctccagcttctcctccctcctcctccgtctcctcctctctctctccatctgctgtggttatggcctgtcgctggagcacaaaagagtctccgcggtggaggtctgccgactcggaccgatg

SEQ ID NO: 1279 - DNA, 203 bp, Homo sapiens
  source 1..203: mol_type = other DNA
ggcgcgccagtccttggagccggcttgacagggtctgagggggagtggagaactgggcgaggaggttcccgtgggtgagcgcgtacgggatggctggctcgcaggacggccgaaggtggtggttggtgggagcagccagcgacgagcccgtagacactcgtacgcgtgcgggctgacgtgcgcgctaccgactcggaccgatg

SEQ ID NO: 1280 - DNA, 203 bp, Homo sapiens
  source 1..203: mol_type = other DNA
ggcgcgccagtcctgtgatttggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgcgactcggaccgatg

SEQ ID NO: 1281 - DNA, 203 bp, Homo sapiens
  source 1..203: mol_type = other DNA
ggcgcgccagtcctcggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatcgactcggaccgatg

SEQ ID NO: 1282 - DNA, 203 bp, Homo sapiens
  source 1..203: mol_type = other DNA
ggcgcgccagtcctcagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctcgactcggaccgatg

SEQ ID NO: 1283 - DNA, 203 bp, Homo sapiens
  source 1..203: mol_type = other DNA
ggcgcgccagtcctacgccgtggcgtgccgcaggacgcgacggctgcagaacatccgccgcaccgctgggggccaacgttgtgggaccgaggagtccgaggtggcgactgagtgagatacccagctgtgcggagctaggacgcggaacatcccagaggccagcatcaacatgtttccatccttggggacgactcggaccgatg

SEQ ID NO: 1284 - DNA, 203 bp, Homo sapiens
  source 1..203: mol_type = other DNA
ggcgcgccagtcctgcctgcgcacgcaccgggccggggactgggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaacgactcggaccgatg

SEQ ID NO: 1285 - DNA, 203 bp, Homo sapiens
  source 1..203: mol_type = other DNA
ggcgcgccagtcctccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaaccgactcggaccgatg

SEQ ID NO: 1286 - DNA, 203 bp, Homo sapiens
  source 1..203: mol_type = other DNA
ggcgcgccagtcctatagaggcggggctgcggcggctgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcgactcggaccgatg

SEQ ID NO: 1287 - DNA, 203 bp, Homo sapiens
  source 1..203: mol_type = other DNA
ggcgcgccagtcctagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcggccttggctgattcgactcggaccgatg

SEQ ID NO: 1288 - DNA, 203 bp, Homo sapiens
  source 1..203: mol_type = other DNA
ggcgcgccagtcctctggagggccgcactcccgttccagccaggctgagccttctgtcccctgcctctggggcctgggaaccccccttcttctttctcctgaatggcacccccgccctagaatccagacaccgagtttcccactgtggctggttcaaggagctccctggtgacagtctgtggctgagccgactcggaccgatg

SEQ ID NO: 1289 - DNA, 203 bp, Homo sapiens
  source 1..203: mol_type = other DNA
ggcgcgccagtcctggagccgtccgcctacgggggccgggacgtcgcctgcgcgtctctcgttttcggacggctgcagcatcgcggtggggatcgaaagcgggggcttctgggacgcagctctggagacgcggcctcggaccagccatttcggtgtagaagtggcagcacggcagactggtcaaacaacgactcggaccgatg

SEQ ID NO: 1290 - DNA, 203 bp, Homo sapiens
  source 1..203: mol_type = other DNA
ggcgcgccagtcctggtgctgggaggccttagaacgccgtggcgtgccgcaggacgcgacggctgcagaacatccgccgcaccgctgggggccaacgttgtgggaccgaggagtccgaggtggcgactgagtgagatacccagctgtgcggagctaggacgcggaacatcccagaggccagcatcaaccgactcggaccgatg

SEQ ID NO: 1291 - DNA, 203 bp, Homo sapiens
  source 1..203: mol_type = other DNA
ggcgcgccagtcctccgggaggctgagactgcattgttgggatttgatgcactaatctcctgtctccgccgcctttccctctgttcggtctcttgccctccctcccttcgtctgtccttcctccgtgtgtttgtctatcctcctctgtccctcctctttcctctccttgctttctttggttttctgcacgactcggaccgatg

SEQ ID NO: 1292 - DNA, 203 bp, Homo sapiens
  source 1..203: mol_type = other DNA
ggcgcgccagtcctcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctcgactcggaccgatg

SEQ ID NO: 1293 - DNA, 203 bp, Homo sapiens
  source 1..203: mol_type = other DNA
ggcgcgccagtcctaggggcagcgggagccggccgggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagcgactcggaccgatg

SEQ ID NO: 1294 - DNA, 203 bp, Homo sapiens
  source 1..203: mol_type = other DNA
ggcgcgccagtcctcttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgacgactcggaccgatg

SEQ ID NO: 1295 - DNA, 203 bp, Homo sapiens
  source 1..203: mol_type = other DNA
ggcgcgccagtcctccggattcccctgcggcttcgatccctttccactgggtattgagattggcgaggggagaggcgcagaaacggcgtactctagtgcagtggttcaatctcggctcactgcaacctccgcctccccgattcaagcgattctcctgcgtcagcctccccagtagctgagactacaggcgactcggaccgatg

SEQ ID NO: 1296 - DNA, 203 bp, Homo sapiens
  source 1..203: mol_type = other DNA
ggcgcgccagtcctggaccaaagaaacgcgagcttagccctgggtagcgcggccaatggccgtggagcagcccctgtaaactggctcgggcgcccccacgcccgcccttccttcttctcccagcattgccccccccacgtttcagcacagcgctggccgcagtctgacaggaaagggacggagccaagcgactcggaccgatg

SEQ ID NO: 1297 - DNA, 203 bp, Homo sapiens
  source 1..203: mol_type = other DNA
ggcgcgccagtccttctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaaccgactcggaccgatg

SEQ ID NO: 1298 - DNA, 203 bp, Homo sapiens
  source 1..203: mol_type = other DNA
ggcgcgccagtcctggaggcctgcgtccggaaagtcagtagaattcatcacaagagagctacaagagcctggaagaagctgaagactgctaccctccatccttactcaccctggacctgagagacctcttcaatcaggtggagcaaggccctctcctgtcctgccccaaggctggcacagacttgagccgactcggaccgatg

SEQ ID NO: 1299 - DNA, 203 bp, Homo sapiens
  source 1..203: mol_type = other DNA
ggcgcgccagtcctagtgggtgggaagagcccccaagagctctgtgcgggattctaggctcccctgtgacagccgcggcaggaagcaggcgggcgctccccggccacaggcctgttgttctcggaagggagaaagctggacatttccccacgtaactcccagctctgggcctagagtgcgtgcatggccgactcggaccgatg

SEQ ID NO: 1300 - DNA, 203 bp, Homo sapiens
  source 1..203: mol_type = other DNA
ggcgcgccagtcctctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtccgactcggaccgatg

SEQ ID NO: 1301 - DNA, 203 bp, Homo sapiens
  source 1..203: mol_type = other DNA
ggcgcgccagtcctatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcacgactcggaccgatg

SEQ ID NO: 1302 - DNA, 203 bp, Homo sapiens
  source 1..203: mol_type = other DNA
ggcgcgccagtcctttgcgccacaaccagggcagcgtaaactacagttcccagagagcgccgcgtcgggagcggagccttttctcgctaacaccgctcgccctctccgagtcagttccgcggtagaggtgacctgactctctgaggctcattttgcagttgttgaaattgtccccgcagttttcaatccgactcggaccgatg

SEQ ID NO: 1303 - DNA, 203 bp, Homo sapiens
  source 1..203: mol_type = other DNA
ggcgcgccagtcctacttctgctttctgacttgattacaggcatctttcctttttcatgctgtgcaaaaacttgagctcagcctctcaccccaacacaattcaagacgcagccttgtcccagcatgagcgcagataacagcagcaccatctgtgtttgtagaagcgtgagacaggagcttggaattgccgactcggaccgatg

SEQ ID NO: 1304 - DNA, 203 bp, Homo sapiens
  source 1..203: mol_type = other DNA
ggcgcgccagtcctcggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggtgctggggggaccctgatgtggcaccaaatgaacgactcggaccgatg

SEQ ID NO: 1305 - DNA, 203 bp, Homo sapiens
  source 1..203: mol_type = other DNA
ggcgcgccagtcctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagcgactcggaccgatg

SEQ ID NO: 1306 - DNA, 203 bp, Homo sapiens
  source 1..203: mol_type = other DNA
ggcgcgccagtcctttcaacctcgaataaaaactgcagccaacttccgaggcagcctcattgcccagcggaccccagcctctgccaggttgggtccgccatcctcgtcccgtcctccgccggcccctgccccgcgcccagggatcctccagctcctttcgcccgcgccctccgttcgctccggacacccgactcggaccgatg

SEQ ID NO: 1307 - DNA, 203 bp, Homo sapiens
  source 1..203: mol_type = other DNA
ggcgcgccagtcctctgacaggagaaatagcagtgctgcccaggatcacagctcaccccgaggtggctgaggctggaattgggtgcccctttgcaggtgtcggctgctccttcaagggaagcccacagtctgtgcaagagcatgaggtcacctcccagacctcccacctaaacctgctgttggggttccgactcggaccgatg

SEQ ID NO: 1308 - DNA, 203 bp, Homo sapiens
  source 1..203: mol_type = other DNA
ggcgcgccagtcctgtgcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccgactcggaccgatg

SEQ ID NO: 1309 - DNA, 203 bp, Homo sapiens
  source 1..203: mol_type = other DNA
ggcgcgccagtccttacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggccgactcggaccgatg

SEQ ID NO: 1310 - DNA, 203 bp, Homo sapiens
  source 1..203: mol_type = other DNA
ggcgcgccagtcctgtggggttgacccgcacgtcccgccccgcctctcccttcgcgctccggacgggcgacggtagctcgagacccgggactccgcccgcctccccgcgagtatttgaggtccggggcggctccggcgcctctgcccgccgttctgctcgctcgctccccgctctggagtctgccatccgactcggaccgatg

SEQ ID NO: 1311 - DNA, 203 bp, Homo sapiens
  source 1..203: mol_type = other DNA
ggcgcgccagtcctactctcattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagcgactcggaccgatg

SEQ ID NO: 1312 - DNA, 203 bp, Homo sapiens
  source 1..203: mol_type = other DNA
ggcgcgccagtcctttcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtacgactcggaccgatg

SEQ ID NO: 1313 - DNA, 203 bp, Homo sapiens
  source 1..203: mol_type = other DNA
ggcgcgccagtcctgaccagattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcgcgactcggaccgatg

SEQ ID NO: 1314 - DNA, 203 bp, Homo sapiens
  source 1..203: mol_type = other DNA
ggcgcgccagtccttggtgtgacttagtttttgattgctggatttcactggagtgaagtggtcgtttattggctggccctctgatatgaggtggtggtgaattggtgggcgtcagtgcagtaagtgagcgagccggacgtcgattgactggtcttcagaagcagaaggactccatgaaagatgacagacgactcggaccgatg

SEQ ID NO: 1315 - DNA, 203 bp, Homo sapiens
  source 1..203: mol_type = other DNA
ggcgcgccagtcctacttaagcttcgacgcaggaggcggggctgctcagtcctccaggcgtcggtactcagcggtgttggaacttcgttgcttgcttgcctgtgcgcgcgtgcgcggacatggcctcaaacgattatacccaacaagcaacccaaagctatggggcctaccccacccagcccgggcagcgactcggaccgatg

SEQ ID NO: 1316 - DNA, 203 bp, Homo sapiens
  source 1..203: mol_type = other DNA
ggcgcgccagtcctccttctggaaggttctaagatagggtataagaggcagggtggcgggcggaaaccggtctcattgaactcgcctgcagctcttgggttttttgtggcttccttcgttattggagccaggcctacaccccagcaaccatgtccaagggacctgcagttggtattgatcttggcacccgactcggaccgatg

SEQ ID NO: 1317 - DNA, 203 bp, Homo sapiens
  source 1..203: mol_type = other DNA
ggcgcgccagtcctatttccggctcgaatgcccggcagccgtggcggctagagcgttcctccccagctcgaatgcccggcggccgaggcggctagagcgtcgcctcctcccggggaaccgcgtgtgaccttccagcccggggaccgatgctgccggcggccgctcgccccctgtgggggccttgccttcgactcggaccgatg

SEQ ID NO: 1318 - DNA, 203 bp, Homo sapiens
  source 1..203: mol_type = other DNA
ggcgcgccagtcctctgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtccgactcggaccgatg

SEQ ID NO: 1319 - DNA, 203 bp, Homo sapiens
  source 1..203: mol_type = other DNA
ggcgcgccagtcctgcggcaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggacgactcggaccgatg

SEQ ID NO: 1320 - DNA, 203 bp, Homo sapiens
  source 1..203: mol_type = other DNA
ggcgcgccagtcctccagctcagagggagcaggggcccagccagggacggaccctcattcctcccagggaccccagacctctgtctctctcggctgagtatttgtgccaggaagactgcgtgcagaaggtgactgtctcagtggagctgggtcatctcaggccttggctccttgaacttttggccgcccgactcggaccgatg

SEQ ID NO: 1321 - DNA, 203 bp, Homo sapiens
  source 1..203: mol_type = other DNA
ggcgcgccagtcctggctccacccagaggccagtcctgtgtgtctggggacaaggcgaaagagcagcagaagtgccccttctccaggatcaaggaactggggcggggggtgtttcctggaccccagtcctccgaatcagctcctagagtggaaccaggaaggattctggagccacagaagatagacagcgactcggaccgatg

SEQ ID NO: 1322 - DNA, 203 bp, Homo sapiens
  source 1..203: mol_type = other DNA
ggcgcgccagtcctgctgctgccttaagacgtgcagcctgggccgtggctgtcactgcgttcggacccagacccgctgcaggcagcagcagcccccgcccgcgcagcagcatggagctctggggggcctacctcctcctctgcctcttctccctcctgacccaggtcaccaccgagccaccaacccagcgactcggaccgatg

SEQ ID NO: 1323 - DNA, 203 bp, Homo sapiens
  source 1..203: mol_type = other DNA
ggcgcgccagtcctaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattcccgactcggaccgatg

SEQ ID NO: 1324 - DNA, 203 bp, Homo sapiens
  source 1..203: mol_type = other DNA
ggcgcgccagtcctcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgcccgactcggaccgatg

SEQ ID NO: 1325 - DNA, 203 bp, Homo sapiens
  source 1..203: mol_type = other DNA
ggcgcgccagtcctagaacaaatcattgtgggaagctgggaggagagagagagagaggaagtcggacgtgggcgaggggcggggtgtctggactggaacctctgggcccacatgccatggacaatattaccaggcagaaccaattctacgatacccaagtcatcaaacaagaaaacgagtcaggctaccgactcggaccgatg

SEQ ID NO: 1326 - DNA, 203 bp, Homo sapiens
  source 1..203: mol_type = other DNA
ggcgcgccagtcctccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcacgactcggaccgatg

SEQ ID NO: 1327 - DNA, 203 bp, Homo sapiens
  source 1..203: mol_type = other DNA
ggcgcgccagtcctcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagacgactcggaccgatg

SEQ ID NO: 1328 - DNA, 203 bp, Homo sapiens
  source 1..203: mol_type = other DNA
ggcgcgccagtcctagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggcgactcggaccgatg

SEQ ID NO: 1329 - DNA, 203 bp, Homo sapiens
  source 1..203: mol_type = other DNA
ggcgcgccagtcctgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagcccgactcggaccgatg

SEQ ID NO: 1330 - DNA, 203 bp, Homo sapiens
  source 1..203: mol_type = other DNA
ggcgcgccagtcctaaagcctcggctacttccgagggggtgagtggcttcaccgccggtcccttgcagcgctgcctttcgatctctccacatctcggtggcgcgggatctcaagatgcgcctccacctgctcctgctgctcgcgctgtgcggtgcaggcaccaccgccgcggagctcagttacagcttcgactcggaccgatg

SEQ ID NO: 1331 - DNA, 203 bp, Homo sapiens
  source 1..203: mol_type = other DNA
ggcgcgccagtcctaagcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagaccgactcggaccgatg

SEQ ID NO: 1332 - DNA, 203 bp, Homo sapiens
  source 1..203: mol_type = other DNA
ggcgcgccagtcctttgaagcaaggttgtggagaaaagcaaaggagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattcgactcggaccgatg

SEQ ID NO: 1333 - DNA, 203 bp, Homo sapiens
  source 1..203: mol_type = other DNA
ggcgcgccagtcctttgttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggcgactcggaccgatg

SEQ ID NO: 1334 - DNA, 203 bp, Homo sapiens
  source 1..203: mol_type = other DNA
ggcgcgccagtcctgactttaacatttctctttgtcttaacattagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattcgactcggaccgatg

SEQ ID NO: 1335 - DNA, 203 bp, Homo sapiens
  source 1..203: mol_type = other DNA
ggcgcgccagtcctcaattgataatcaaaggctaaatctcttctgggatccactgaatgccactagagggtctgctcgagagaattcctgattgaatgacaacggcgctaagaacaatccctgcccaagacgggtctggagcctgacttccgggtgtccatgaccctggcggctgcttcgggtccgcccgactcggaccgatg

SEQ ID NO: 1336 - DNA, 203 bp, Homo sapiens
  source 1..203: mol_type = other DNA
ggcgcgccagtcctgctgtttagaactattgtaccgctgccagtgactgtctgtattagggttgggagcaggaacatggatttgaagacattaaaactgtttaattctcagttgagatgtggttggctcttatacatttggaataaagcatttatggcacatctcagggttccacaagatgaatggaccgactcggaccgatg

SEQ ID NO: 1337 - DNA, 203 bp, Homo sapiens
  source 1..203: mol_type = other DNA
ggcgcgccagtcctctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaacgactcggaccgatg

SEQ ID NO: 1338 - DNA, 203 bp, Homo sapiens
  source 1..203: mol_type = other DNA
ggcgcgccagtcctataaaaccagctgagtatttgtgccaggaagactgcgtgcagaaggccttggctccttgaacttttggccgccatgtgcttcccgaaggtcctctctgatgacatgaagaagctgaaggcccgaatggtgatgtcgagcctggcagagctggaggacgacttcaaagagggctacgactcggaccgatg

SEQ ID NO: 1339 - DNA, 203 bp, Homo sapiens
  source 1..203: mol_type = other DNA
ggcgcgccagtcctacctgggaaaaggaagcacaaaaaggagaagcagcaacggctgctctgcttccttcccatctcgctcttgggtcatgcctggccagcagaaagcagctccataggggaggagagccacgcaggatctcacagctgcagtctaatagtaacacagaggattcagcagtggccacccgactcggaccgatg

SEQ ID NO: 1340 - DNA, 203 bp, Homo sapiens
  source 1..203: mol_type = other DNA
ggcgcgccagtcctgccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtcgactcggaccgatg

SEQ ID NO: 1341 - DNA, 203 bp, Homo sapiens
  source 1..203: mol_type = other DNA
ggcgcgccagtcctaacttgcgcctggccgccaagccggcctccaggctgaagaaggacccgccccggccttgacccgggccccgcccctccagccggggcaccgagccccggccctagctgctcgcccctactcgccggcactcgcccggctcgcccgctttcgcacccagttcacgcgccacagctcgactcggaccgatg

SEQ ID NO: 1342 - DNA, 203 bp, Homo sapiens
  source 1..203: mol_type = other DNA
ggcgcgccagtcctggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcacgactcggaccgatg

SEQ ID NO: 1343 - DNA, 203 bp, Homo sapiens
  source 1..203: mol_type = other DNA
ggcgcgccagtcctgtcttcaggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccgactcggaccgatg

SEQ ID NO: 1344 - DNA, 203 bp, Homo sapiens
  source 1..203: mol_type = other DNA
ggcgcgccagtcctacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagtgtttctgaaagatctatccagcactccgcgactcggaccgatg

SEQ ID NO: 1345 - DNA, 203 bp, Homo sapiens
  source 1..203: mol_type = other DNA
ggcgcgccagtcctcgggagcgtgcccggtccccgcccctgttcccactctccttccacctgggaccggccggggctccgcagagccaaagctcgcttgtccccggaaccgccctgctgccgccgcctgcttcctctgctcgcggttagcccgtcagtccctgctctgtgcgcgcctccatctgggcccgactcggaccgatg

SEQ ID NO: 1346 - DNA, 203 bp, Homo sapiens
  source 1..203: mol_type = other DNA
ggcgcgccagtcctttgatgtaacagagcagaggaccagcagatgaatggacaccttgaagcagaggagcagcaggaccagagatcacccctgacctgctacctcggccgccccggttgcttctattggtcaatccctttgggggtcggggcctggcctggcagtggtgtaagaaccacgtgcttccccgactcggaccgatg

SEQ ID NO: 1347 - DNA, 203 bp, Homo sapiens
  source 1..203: mol_type = other DNA
ggcgcgccagtcctagctaggcgcgaggctcggagtgcggccagcgggcggaggcggtctcgcatcggcggcgacggagggctcaggcgtcgtcgtttgggtggggggccgctgaactgacaagcgacatttcagctcctttcacccgccggaaccccggagccggggcccgctcagccggcgttacccgactcggaccgatg

SEQ ID NO: 1348 - DNA, 203 bp, Homo sapiens
  source 1..203: mol_type = other DNA
ggcgcgccagtcctcctagacggcggtgttgctccggcagcgttcctgggagccgagggccagagactaagttaaaaggcccctccccatcttcagaacagtcctgggttctgagcctgccatccaaggaactcaggaggaggagttgacagtctcttcgttcctaaccagtgtgggacgacttcagccgactcggaccgatg

SEQ ID NO: 1349 - DNA, 203 bp, Homo sapiens
  source 1..203: mol_type = other DNA
ggcgcgccagtcctggacgatcctctctcagcgtccagcctagacggcggtgttgctccggcagcgttcctgggagccgagggccagagactaagtaacagtcctgggttctgagcctgccatccaaggaactcaggaggaggagttgacagtctcttcgttcctaaccagtgtgggacgacttcagccgactcggaccgatg

SEQ ID NO: 1350 - DNA, 203 bp, Homo sapiens
  source 1..203: mol_type = other DNA
ggcgcgccagtcctgtcgtggacgatcctctctcagcgtccagcctagacggcggtgttgctccggcagcgttcctgggagccgagggccagagactaagttcctgggttctgagcctgccatccaaggaactcaggaggaggagttgacagtctcttcgttcctaaccagtgtgggacgacttcagccgactcggaccgatg

SEQ ID NO: 1351 - DNA, 203 bp, Homo sapiens
  source 1..203: mol_type = other DNA
ggcgcgccagtcctggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacacgactcggaccgatg

SEQ ID NO: 1352 - DNA, 203 bp, Homo sapiens
  source 1..203: mol_type = other DNA
ggcgcgccagtccttaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagttgtgggacgacttcagccgactcggaccgatg

SEQ ID NO: 1353 - DNA, 203 bp, Homo sapiens
  source 1..203: mol_type = other DNA
ggcgcgccagtcctaacatgttgagctctggcatagaagaggctggtggctattttgtccttgggctgcctgttttcaggcgccatgtcagaaccggctggggatgtccgtcagaacccatgcggcagcaaggcctgccgccgcctcttcggcccagtggacagcgagcagctgagccgcgactgtgacgactcggaccgatg

SEQ ID NO: 1354 - DNA, 203 bp, Homo sapiens
  source 1..203: mol_type = other DNA
ggcgcgccagtccttgggaactgggaacactggagacctgatttctaactgacgctaccgtcgcggccgccgtaaaaggcccctccccatcttcagaacagtcctgggttctgagcctgccatccaaggaactcaggaggaggagttgacagtctcttcgttcctaaccagtgtgggacgacttcagccgactcggaccgatg

SEQ ID NO: 1355 - DNA, 203 bp, Homo sapiens
  source 1..203: mol_type = other DNA
ggcgcgccagtcctcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggcgcccgactcggaccgatg

SEQ ID NO: 1356 - DNA, 203 bp, Homo sapiens
  source 1..203: mol_type = other DNA
ggcgcgccagtccttcgcactcctcgcagttggactggtgggaactgggaacactggagacctgatttctaactgacgctaccgtcgcggccgccgaacagtcctgggttctgagcctgccatccaaggaactcaggaggaggagttgacagtctcttcgttcctaaccagtgtgggacgacttcagccgactcggaccgatg

SEQ ID NO: 1357 - DNA, 203 bp, Homo sapiens
  source 1..203: mol_type = other DNA
ggcgcgccagtcctagcgccggaagtacggttttcggagggatcagactcagactcacgtcgcactcctcgcagttggactggtgggaactgggaacactggagacctgatttctaactgacgctaccgtcgcggccgccgtgtgggacgacttcagcatgtctcaggccaccaagaggaagcatgtgcgactcggaccgatg

SEQ ID NO: 1358 - DNA, 203 bp, Homo sapiens
  source 1..203: mol_type = other DNA
ggcgcgccagtcctgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccgccgcgactcggaccgatg

SEQ ID NO: 1359 - DNA, 203 bp, Homo sapiens
  source 1..203: mol_type = other DNA
ggcgcgccagtcctccggctgccgcctaggatgaatatcatggacttcaacgtgaagaagctggcggccgacgcaggcaccttcctcagtcgcgccgtgcagatgccaggatagaagaatttgtttatgagaaactggatagaaaagctccaagtcgtataaacaacccagaacttttgggacaatatcgactcggaccgatg

SEQ ID NO: 1360 - DNA, 203 bp, Homo sapiens
  source 1..203: mol_type = other DNA
ggcgcgccagtcctcctccgcgaggtctccctgagtctttgaggacacagcctcgctggaggcagtttctggtgccagtgacggggtggcccgtgagctgatgacgaggactggcttttaatccttggtggtgattaagagaaagcttattggggcctgggagcagctccccgccgacccccaccacccgactcggaccgatg

SEQ ID NO: 1361 - DNA, 203 bp, Homo sapiens
  source 1..203: mol_type = other DNA
ggcgcgccagtcctgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatcgactcggaccgatg

SEQ ID NO: 1362 - DNA, 203 bp, Homo sapiens
  source 1..203: mol_type = other DNA
ggcgcgccagtcctgaacacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggccgactcggaccgatg

SEQ ID NO: 1363 - DNA, 203 bp, Homo sapiens
  source 1..203: mol_type = other DNA
ggcgcgccagtccttaacctcggtgcccccttcaacctcccgccccaagcacctccagggtcgtcaggggtgtagttttgagtcgcgctcctaagcatccagacaggcaggacaccgtaacgacatctctgccgggagtcccttcagactgcggtctccagacaaaaatctacgtaccatcagaaactcgactcggaccgatg

SEQ ID NO: 1364 - DNA, 203 bp, Homo sapiens
  source 1..203: mol_type = other DNA
ggcgcgccagtcctggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatccgactcggaccgatg

SEQ ID NO: 1365 - DNA, 203 bp, Homo sapiens
  source 1..203: mol_type = other DNA
ggcgcgccagtcctttgtcttgcgcctgccttcctaacagccttcagttccccttctcccgtcagaccttcctgacctcccacctggttctctaggggcagggtggacaggaagcagctcagcccagcctgggagaggccaagggctgcctcctatcagagagcgcctgctcgctgtgcccccgggttcgactcggaccgatg

SEQ ID NO: 1366 - DNA, 203 bp, Homo sapiens
  source 1..203: mol_type = other DNA
ggcgcgccagtcctaaaaagcttttccaaaaaagtattggctgtcttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccacccgactcggaccgatg

SEQ ID NO: 1367 - DNA, 203 bp, Homo sapiens
  source 1..203: mol_type = other DNA
ggcgcgccagtcctgaaagggcgggaaaggcagttggagaagaggtaagcggttactcactccatggctgcagcaaggagaggcggcggcggcctcggctgaagaaagaagaaatcttcccaaggctgcagacaccgacggatttgctttgggagccagagtagctgccgccaccagagtccggagcccgactcggaccgatg

SEQ ID NO: 1368 - DNA, 203 bp, Homo sapiens
  source 1..203: mol_type = other DNA
ggcgcgccagtcctccccgacggcggcgctaacctctcggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggaccgactcggaccgatg

SEQ ID NO: 1369 - DNA, 203 bp, Homo sapiens
  source 1..203: mol_type = other DNA
ggcgcgccagtcctcggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagcgactcggaccgatg

SEQ ID NO: 1370 - DNA, 203 bp, Homo sapiens
  source 1..203: mol_type = other DNA
ggcgcgccagtcctatttcctctgggttacggcgcaggcgcaagataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggacgactcggaccgatg

SEQ ID NO: 1371 - DNA, 203 bp, Homo sapiens
  source 1..203: mol_type = other DNA
ggcgcgccagtcctgcccttcccgcctctggggaagggaacttccgcttgggaccgagggcagtaggctctcggctcctggtcccactgctgctcagcccagtggcctcacaggacaccagcttcccaggaggcgtctgacacagtatgatgatgaagatcccatggggcagcatcccagtactgatgcgactcggaccgatg

SEQ ID NO: 1372 - DNA, 203 bp, Homo sapiens
  source 1..203: mol_type = other DNA
ggcgcgccagtcctgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagccgactcggaccgatg

SEQ ID NO: 1373 - DNA, 203 bp, Homo sapiens
  source 1..203: mol_type = other DNA
ggcgcgccagtcctggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggcgactcggaccgatg

SEQ ID NO: 1374 - DNA, 203 bp, Homo sapiens
  source 1..203: mol_type = other DNA
ggcgcgccagtccttggcgcgggcgggcccgtcccccctgcccctgggtcgctctttttaagctcccctgagccggtgctgcgctcctctaattgggactccgagccggggctatttctggcgctggcgcggctccaagaaggccatcccagccatcactcttccacctgctccttagagaagggaagcgactcggaccgatg

SEQ ID NO: 1375 - DNA, 203 bp, Homo sapiens
  source 1..203: mol_type = other DNA
ggcgcgccagtcctacgtcaccggctgcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctacgactcggaccgatg

SEQ ID NO: 1376 - DNA, 203 bp, Homo sapiens
  source 1..203: mol_type = other DNA
ggcgcgccagtcctctcctacggcaagtcggaggtagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggcgactcggaccgatg

SEQ ID NO: 1377 - DNA, 203 bp, Homo sapiens
  source 1..203: mol_type = other DNA
ggcgcgccagtcctctggggctcgcccgctccttagagcactggcaatgatgtgcggatcctcgctgctgctgctgggaaactgttgagtggctgaatgaccccaggggaccctgggagagctctgaagccctcagccaccaagtggctgggctggcaagggttcattcattcattcaacaaatacgacgactcggaccgatg

SEQ ID NO: 1378 - DNA, 203 bp, Homo sapiens
  source 1..203: mol_type = other DNA
ggcgcgccagtcctgaaattgtagtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgaggcgactcggaccgatg

SEQ ID NO: 1379 - DNA, 203 bp, Homo sapiens
  source 1..203: mol_type = other DNA
ggcgcgccagtccttgccaggctctccacccccacttcccaattgaggaaaccgaggcagaggaggctcagcgccacgcactcctctttctgcctggccggccactcccgtctgctgtgacgcgcggacagagagctaccggtggacccacggtgcctccctccctgggatctacacagaccatggcccgactcggaccgatg

SEQ ID NO: 1380 - DNA, 203 bp, Homo sapiens
  source 1..203: mol_type = other DNA
ggcgcgccagtcctcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagacgactcggaccgatg

SEQ ID NO: 1381 - DNA, 203 bp, Homo sapiens
  source 1..203: mol_type = other DNA
ggcgcgccagtcctgattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtcgactcggaccgatg

SEQ ID NO: 1382 - DNA, 203 bp, Homo sapiens
  source 1..203: mol_type = other DNA
ggcgcgccagtccttcacttccctgtactctcatcgctctcggcctccgacacgaaaaggaagcaaatgagctgatggaagatctgtttgaaactagacagggtcttgccatgttctggaactcataggctcaagtaatcttcctgcctcaacctcccaaagtgctggaattacagttccaagatgagcgactcggaccgatg

SEQ ID NO: 1383 - DNA, 203 bp, Homo sapiens
  source 1..203: mol_type = other DNA
ggcgcgccagtcctcaccctgacccaagccgagacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgcgactcggaccgatg

SEQ ID NO: 1384 - DNA, 203 bp, Homo sapiens
  source 1..203: mol_type = other DNA
ggcgcgccagtcctgtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgttccaagatgagcgactcggaccgatg

SEQ ID NO: 1385 - DNA, 203 bp, Homo sapiens
  source 1..203: mol_type = other DNA
ggcgcgccagtcctagtcagttaggtaacaggccacgggccccgggctcaggccactgcacggacccagggaacgggctgacagtccagcagaggcctcagcgaggcggcggcgctgcgcacaaacctgaggacctaggcgggtgaggcggaaccaaccctcctggccatgggaggggccgtggtggacgactcggaccgatg

SEQ ID NO: 1386 - DNA, 203 bp, Homo sapiens
  source 1..203: mol_type = other DNA
ggcgcgccagtcctctgctgctgcctcccagggcgctggttcacagcacggtcccagcagggagaggctgagccggttggactagaccacccaaggtctcaggttgcagctccctggtgaggcggaaccaaccctcctggccatgggaggggccgtggtggacgagggccccacaggcgtcaaggccccgactcggaccgatg

SEQ ID NO: 1387 - DNA, 203 bp, Homo sapiens
  source 1..203: mol_type = other DNA
ggcgcgccagtcctagtgcagagggagtgggacccacagctgctagcctccctccaaaccctcctgcctccaccagacaccaggtgaggcggaaccaaccctcctggccatgggaggggccgtggtggacgagggccccacaggcgtcaaggcccctgacggcggctggggctgggccgtgctcttcgcgactcggaccgatg

SEQ ID NO: 1388 - DNA, 203 bp, Homo sapiens
  source 1..203: mol_type = other DNA
ggcgcgccagtcctccagggcagcgaggcgctggccggcagggggcgctgcggtgccagcctgaggctgggctgctccgcgaggatacagcggcccctgccctgtcctgtcctgccctgccctgtcctgtcctgccctgccctgccctgtcctgtcctgccctgccctgccctgtgtcctcagacaatcgactcggaccgatg

SEQ ID NO: 1389 - DNA, 203 bp, Homo sapiens
  source 1..203: mol_type = other DNA
ggcgcgccagtcctccccggggactgagcatccggctcagagcggcttggcagaggcccactgctcagtggagcgtggaggacgaggaggaggccgtccacgagcaatgccagcatgagagagacaggcagcttcaggcccaggacgaggagggaggcggccatgtccccgagcggccgaagcaggagcgactcggaccgatg

SEQ ID NO: 1390 - DNA, 203 bp, Homo sapiens
  source 1..203: mol_type = other DNA
ggcgcgccagtcctagctgggctttgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttccgactcggaccgatg

SEQ ID NO: 1391 - DNA, 203 bp, Homo sapiens
  source 1..203: mol_type = other DNA
ggcgcgccagtcctgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagcgactcggaccgatg

SEQ ID NO: 1392 - DNA, 203 bp, Homo sapiens
  source 1..203: mol_type = other DNA
ggcgcgccagtcctcggagggactttctgttagcagcatgagggcctgtggttagacctatagaggtatttcctttgatttaagccagaaagtcctgagagcggatcggggagcatttgcggatcggtcactttttcctcctttctgagtctcttatcccctaccacagggacggcccaggtggcaggcgactcggaccgatg

SEQ ID NO: 1393 - DNA, 203 bp, Homo sapiens
  source 1..203: mol_type = other DNA
ggcgcgccagtcctggcagagtggcgcccgcgcgtgactcccccctgccggctgcggaggtgggggggggacggcgcccccgccgtgtgcgtggggcggggatggagcacgcgccctggagccccggagccagatgctctgacctttgacccctgccgttcagctctagggcccgtgcaggccacacccgactcggaccgatg

SEQ ID NO: 1394 - DNA, 203 bp, Homo sapiens
  source 1..203: mol_type = other DNA
ggcgcgccagtccttctctcccggtttcagatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagcgactcggaccgatg

SEQ ID NO: 1395 - DNA, 203 bp, Homo sapiens
  source 1..203: mol_type = other DNA
ggcgcgccagtcctccagcggaagtaattctttcgactgccccggaacccaccggagcaggcagctgggggtgggggggcggccctgggataggggctgtggcagtacgcggggacccggctgcggtggctgcgggactgacgaatggagaggagaaaacctatggtggctgtgaaggacctgatgcccgactcggaccgatg

SEQ ID NO: 1396 - DNA, 203 bp, Homo sapiens
  source 1..203: mol_type = other DNA
ggcgcgccagtcctagcgagagccacaagccacagcgctgagctgcaggcgcggcgaaacttccctctacccgcccggcccgcggcgcgcaccgttggcgctggacgcttcctccttggaagcgcctctccctcagttatggagaaaacttgtatagatgcacttcctcttactatgaattcttcagacgactcggaccgatg

SEQ ID NO: 1397 - DNA, 203 bp, Homo sapiens
  source 1..203: mol_type = other DNA
ggcgcgccagtcctccagagtgcattgcggggccgcttcctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatcgactcggaccgatg

SEQ ID NO: 1398 - DNA, 203 bp, Homo sapiens
  source 1..203: mol_type = other DNA
ggcgcgccagtcctcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagcgactcggaccgatg

SEQ ID NO: 1399 - DNA, 203 bp, Homo sapiens
  source 1..203: mol_type = other DNA
ggcgcgccagtcctgcgcactctggggaaagcggagctgcaccccgccccgtattgctgctcagctcctcagctgtgcgtgcgagggacgtcgggggtggcgccgcagcagttgcccctggtaacgggggaggcagcaggaggaggaggaggaggagggactcggcgggaggatgggcttgctctcaacgactcggaccgatg

SEQ ID NO: 1400 - DNA, 203 bp, Homo sapiens
  source 1..203: mol_type = other DNA
ggcgcgccagtcctgggagcggccagccttggccaatcaggaagcgggggagagcggcgcgagaagcggcggccgcgtcctcaagccggcacctgagcggcggagacggctgtagcacaaggatctgcatctccaatggatactgaggggtttggtgagctccttcagcaagctgaacagcttgctgccgactcggaccgatg

SEQ ID NO: 1401 - DNA, 203 bp, Homo sapiens
  source 1..203: mol_type = other DNA
ggcgcgccagtcctgtttcccggcaggcctcgcgtcaagacggccggcgggacgggagctgcggcgctggctacgagagtgacccagtcagcgttggttcccgtcttggccatggcctcgttcgtgacagaagttttggcacactccgggaggctggaaaaggaggatctggggacccggatcagccgcgactcggaccgatg

SEQ ID NO: 1402 - DNA, 203 bp, Homo sapiens
  source 1..203: mol_type = other DNA
ggcgcgccagtcctggtatgagagcttccagggagacccgccaagatctccaggcaggccgggccaggctctctgggattccggactggcttcgcccaactggaaccccctcgatgagggggccccaggcagaccttatatgagcatcccagccatcactcttccacctgctccttagagaagggaagcgactcggaccgatg

SEQ ID NO: 1403 - DNA, 203 bp, Homo sapiens
  source 1..203: mol_type = other DNA
ggcgcgccagtcctgctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagcgactcggaccgatg

SEQ ID NO: 1404 - DNA, 203 bp, Homo sapiens
  source 1..203: mol_type = other DNA
ggcgcgccagtcctttttaaaagcttcagcttctccagcatctttgcattgtgaatatcttcctgcttctagtcaaagctttctctctagtgattggaatgctgctgtaagcctgattagaggtgcctgaggatatcaccttttacaaggaagccgtgtgtgcttgagaggatctttttaaatgcattcgactcggaccgatg

SEQ ID NO: 1405 - DNA, 203 bp, Homo sapiens
  source 1..203: mol_type = other DNA
ggcgcgccagtcctcagctgtctctcccctgtccccacatgtcttctaagctgttggagccggccggcgctcacttgtcttcaggaagctcggagcctttggtggagccggggagaggaagggtgggtgcaagagtgaaaggcgagaggggactgcaagcatccgggtcggctcctggccggagcaagcgactcggaccgatg

SEQ ID NO: 1406 - DNA, 203 bp, Homo sapiens
  source 1..203: mol_type = other DNA
ggcgcgccagtcctccgccatctccccgtaggtgaataccgcaagcctccgaatttggcgtggtgggcgactctcgtggaatgggcagctagacatcacaaccctacatttttaccctccatctctagattgaagtgttggggtgttgttttatcaaggaagctgattcatctgaaaactacattaagcgactcggaccgatg

SEQ ID NO: 1407 - DNA, 203 bp, Homo sapiens
  source 1..203: mol_type = other DNA
ggcgcgccagtccttgcgccgcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgacgactcggaccgatg

SEQ ID NO: 1408 - DNA, 203 bp, Homo sapiens
  source 1..203: mol_type = other DNA
ggcgcgccagtcctcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcacccgactcggaccgatg

SEQ ID NO: 1409 - DNA, 203 bp, Homo sapiens
  source 1..203: mol_type = other DNA
ggcgcgccagtcctcgcctctacgcgcgcccgccgttcccgcgaggcccacctagagccgggcggcgcaggcgcagagtccccgggccaagatggctgcgcggtgctccacacgctggttgctggtggttgtggggaccccgcggctgccggctatatcgggtagaggggcccggccgcccagggaggcgactcggaccgatg

SEQ ID NO: 1410 - DNA, 203 bp, Homo sapiens
  source 1..203: mol_type = other DNA
ggcgcgccagtcctggaggcggtgcggcgcggcgggtgcggttcagtcggtcggcggcggcagcggaggaggaggaggaggaggaggaggaggaggatgaggaggatgtgggccacgcaggggctggcggtggcgctggctctgagcgtgctgccgggcagccgggcgctgcggccgggcgactgcgacgactcggaccgatg

SEQ ID NO: 1411 - DNA, 203 bp, Homo sapiens
  source 1..203: mol_type = other DNA
ggcgcgccagtcctctccttatttccccgcctccttccctcccccaccttcccctcctccggctttttcctcccaactcggggaggtccttcccggtggccgccctgacgaggtctgagcacctaggcggaggcggcgcaggctttttgtagtgaggtttgcgcctgcgcagcgcgcctgcctccgcccgactcggaccgatg

SEQ ID NO: 1412 - DNA, 203 bp, Homo sapiens
  source 1..203: mol_type = other DNA
ggcgcgccagtcctgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaacgactcggaccgatg

SEQ ID NO: 1413 - DNA, 203 bp, Homo sapiens
  source 1..203: mol_type = other DNA
ggcgcgccagtcctcgcaggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagccccgactcggaccgatg

SEQ ID NO: 1414 - DNA, 203 bp, Homo sapiens
  source 1..203: mol_type = other DNA
ggcgcgccagtcctctcccagcgttcgcaaaggagggaggagccggaaactcagggcgcgaggcctgtgggcccagcggtgaggcagcagctgggggcggggggagggcggacctagcttcccagggcaggtgattcgtcggccccggtggcggcggcgcgtgcgacggtcacctcggtttggggaagcgactcggaccgatg

SEQ ID NO: 1415 - DNA, 203 bp, Homo sapiens
  source 1..203: mol_type = other DNA
ggcgcgccagtcctaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacacgactcggaccgatg

SEQ ID NO: 1416 - DNA, 203 bp, Homo sapiens
  source 1..203: mol_type = other DNA
ggcgcgccagtcctaaaggcgaaagcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagacgactcggaccgatg

SEQ ID NO: 1417 - DNA, 203 bp, Homo sapiens
  source 1..203: mol_type = other DNA
ggcgcgccagtcctggatttgggcgggaagcggagccccgccagcgcccgccctggcagctgcgggctccgcgccgaccctccggcttcccctctcccccctcggccccgtcaggtggacgcggatctgtcaacatgggtaaaggagaccccaacaagccgcggggcaaaatgtcctcgtacgccttccgactcggaccgatg

SEQ ID NO: 1418 - DNA, 203 bp, Homo sapiens
  source 1..203: mol_type = other DNA
ggcgcgccagtccttctgcaactggacttctgctgtgagcacagactatattctggcctatgtcttgactccgtattcctgggaaagtgctcgactgagaccttgggagtcttgggaagtccaatgggtagggtagccgaatctgagggctgatccctgagggcactgggcagtaattggggcatgggcgactcggaccgatg

SEQ ID NO: 1419 - DNA, 203 bp, Homo sapiens
  source 1..203: mol_type = other DNA
ggcgcgccagtccttcccttgacgaccctcctctctgggccccgcccctcccgcttcggggtcaagccccagagagcgccgcgaaaaccacatttcccagagtgcaccgcgacggcaggggtcctcagaccggcgctcgctcgccggcgccatccctatagagaagaacggaggtacggcctgtggtccgactcggaccgatg

SEQ ID NO: 1420 - DNA, 203 bp, Homo sapiens
  source 1..203: mol_type = other DNA
ggcgcgccagtcctggctgggctgctctgtgatggcttccgggaggagggaggtggcctgctgtaggaaaatgctgggtggaagaagggagagaaggctggagaggtaggaaggaactgaagtatctgaagtgacaaggtgggtgtctggactcgtcgggtccccttccatctccctgctgcctccaccgactcggaccgatg

SEQ ID NO: 1421 - DNA, 203 bp, Homo sapiens
  source 1..203: mol_type = other DNA
ggcgcgccagtcctgggaggctcaggagggcgagagtcatgacacggaggaactggaggggcaaaagctgaggggccccgaggagggactgagttgaatggccttaggggagagattcttcagaggaggcccctccagccactcagaacttcatcattccaaaaaaggagatccacacagttccagaccgactcggaccgatg

SEQ ID NO: 1422 - DNA, 203 bp, Homo sapiens
  source 1..203: mol_type = other DNA
ggcgcgccagtcctcacagccatcttgggatctgggcaagtgagcgagctccttcctcaccgggctgactagcctctcctttccctgtccccctccatcgctgctctgcaggaagccagcccccagggccagtcccggaggggctgatccgcatctacagcatgaggttctgcccctattctcacaggcgactcggaccgatg

SEQ ID NO: 1423 - DNA, 203 bp, Homo sapiens
  source 1..203: mol_type = other DNA
ggcgcgccagtcctgttccggcgccggctttggcggaggggtgggacttgcaccggcgtctcttcttctaactgcagtttgtggcagcgccattttgaatgtgcagctgcagcgggcgcctgtatccggtgtccgaggcgaactcagtaagatgatgttaagaggaaacctgaagcaagtgcgcattgcgactcggaccgatg

SEQ ID NO: 1424 - DNA, 203 bp, Homo sapiens
  source 1..203: mol_type = other DNA
ggcgcgccagtcctcagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagcgactcggaccgatg

SEQ ID NO: 1425 - DNA, 203 bp, Homo sapiens
  source 1..203: mol_type = other DNA
ggcgcgccagtcctatgtaaatccttgtttttcctggtgaggcaggggaggccatagccacaatgcttaactgcatgcatctaacatggggctggttttaaccccagcgctctgacctaaactgctcagctcccggaaattccaagggacctggtggccttagtctttcaggtggaacggtgtgcgaccgactcggaccgatg

SEQ ID NO: 1426 - DNA, 203 bp, Homo sapiens
  source 1..203: mol_type = other DNA
ggcgcgccagtcctaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaacgactcggaccgatg

SEQ ID NO: 1427 - DNA, 203 bp, Homo sapiens
  source 1..203: mol_type = other DNA
ggcgcgccagtcctcctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacacgactcggaccgatg

SEQ ID NO: 1428 - DNA, 203 bp, Homo sapiens
  source 1..203: mol_type = other DNA
ggcgcgccagtccttttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagcgactcggaccgatg

SEQ ID NO: 1429 - DNA, 203 bp, Homo sapiens
  source 1..203: mol_type = other DNA
ggcgcgccagtcctacatacacatacacatgcacacacacactcatatacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacgactcggaccgatg

SEQ ID NO: 1430 - DNA, 203 bp, Homo sapiens
  source 1..203: mol_type = other DNA
ggcgcgccagtcctctgcgtggaacgattctgtggcgagtgccggccgaaagctaggtccggattgcacgtggagggccgcccgaagggcactctcggacattaacccgcattctggtgggtctagaggaaattgggggacgaagagtggcagcactgacctggtctgggacgtggggagaaggtacccgactcggaccgatg

SEQ ID NO: 1431 - DNA, 203 bp, Homo sapiens
  source 1..203: mol_type = other DNA
ggcgcgccagtcctctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtctgccatccgactcggaccgatg

SEQ ID NO: 1432 - DNA, 203 bp, Homo sapiens
  source 1..203: mol_type = other DNA
ggcgcgccagtcctggagctggagtccggctgggccgcagccgctgggagaccggcggttgccgtggggaccggtcgggcccctccctcctccggtcccccgccccaggtccttccccaccgagacgcgccgggggaccgcgggcgagtgcagccggtgacccggcgagaggcggcgccgctcccaagcgactcggaccgatg

SEQ ID NO: 1433 - DNA, 203 bp, Homo sapiens
  source 1..203: mol_type = other DNA
ggcgcgccagtcctccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccacgactcggaccgatg

SEQ ID NO: 1434 - DNA, 203 bp, Homo sapiens
  source 1..203: mol_type = other DNA
ggcgcgccagtcctaggtggacatttccatttgaattaaaagtcctttaggctgggcgtggtgcatggctgtaatctcagcaccttgggaggctgaggcaggaagatcacttgaggccaggcgttggagagcagcctgggcaaggtggcaagaaccttgtctctacaaaaaaaaaagcgtctgccatccgactcggaccgatg

SEQ ID NO: 1435 - DNA, 203 bp, Homo sapiens
  source 1..203: mol_type = other DNA
ggcgcgccagtcctggagttcggggaggcacagggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccgactcggaccgatg

SEQ ID NO: 1436 - DNA, 203 bp, Homo sapiens
  source 1..203: mol_type = other DNA
ggcgcgccagtccttgccagagggcggggccgcaggagggcggggcgcgagcgagagctgggagaaggcagtgagcgagcaggcggcaggcagggtccgtgcggagcaggcgagcgagcgggaagacgcagccaccttcctcaccagccagcccacagcggtttgttccccttctcgggagtgcgccacgactcggaccgatg

SEQ ID NO: 1437 - DNA, 203 bp, Homo sapiens
  source 1..203: mol_type = other DNA
ggcgcgccagtcctatgattgttccacataaagtcagaagggaggaaaggcgcacgcgcattggggacttgactctggaaagcgtccagaccaaggtcagcggagagtaggccgtcgctttcgggttctctcatcgcttcgtcgttcgccaatgtttgaggagaaggccagcagtccttcagggaagacgactcggaccgatg

SEQ ID NO: 1438 - DNA, 203 bp, Homo sapiens
  source 1..203: mol_type = other DNA
ggcgcgccagtcctgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggccgactcggaccgatg

SEQ ID NO: 1439 - DNA, 203 bp, Homo sapiens
  source 1..203: mol_type = other DNA
ggcgcgccagtcctcggaagaacttccttgattagcatagtatcgaccctggggccgcgctgcgaggcggaggttcggtcccagctggggtgaagtgtgcagaccggttgcgattgtggtcagacgcagcacctacttctaatctgaggacccgcgatttacacttttgctgaataggacactgtggacgactcggaccgatg

SEQ ID NO: 1440 - DNA, 203 bp, Homo sapiens
  source 1..203: mol_type = other DNA
ggcgcgccagtcctctctcctgaacaaaggcgggaacagctctaggccagagtttctgggatgtgcctcaccgggtctcactgcctgcaaaggtagatggaacgcagctgagaggtctgacaagatgtaccaggtcccactaccactggatcgggatgggaccctggtacggctccgcttcaccatggcgactcggaccgatg

SEQ ID NO: 1441 - DNA, 203 bp, Homo sapiens
  source 1..203: mol_type = other DNA
ggcgcgccagtcctccctgctaacaaagggagccacttccttcctctctgcacataccccatgtctcaccacgatgatggagctacagtgggacttggaatccagatgtgtgaaggatggagggttgaagccgcactcagcttcctgccccaccagaggaagtggggagagacggcaggtgcagtgatcgactcggaccgatg

SEQ ID NO: 1442 - DNA, 203 bp, Homo sapiens
  source 1..203: mol_type = other DNA
ggcgcgccagtcctttgagcgtctccacccagtaagtgggcaagaggcggcaggaagtgggtacgcaggggcgcaaggcgcacagcctctagacgactcgctttccctccggccaacctctgaagccgcgtcctactttgacagctgcagggccgcggcctggtcttctgtgcttcaccatctacatacgactcggaccgatg

SEQ ID NO: 1443 - DNA, 203 bp, Homo sapiens
  source 1..203: mol_type = other DNA
ggcgcgccagtcctggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggacccgactcggaccgatg

SEQ ID NO: 1444 - DNA, 203 bp, Homo sapiens
  source 1..203: mol_type = other DNA
ggcgcgccagtcctcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccatcttctgtgcttcaccatctacatacgactcggaccgatg

SEQ ID NO: 1445 - DNA, 203 bp, Homo sapiens
  source 1..203: mol_type = other DNA
ggcgcgccagtcctccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagccgactcggaccgatg

SEQ ID NO: 1446 - DNA, 203 bp, Homo sapiens
  source 1..203: mol_type = other DNA
ggcgcgccagtcctgacgcgcggggccacactgcccgccccctagcctggcgctgggcctccgggacaagttggctgggtccgggcttggggactgcaacgcggtcttctgtgcttcaccatctacataatgaatcccagtatgaagcagaaacaagaagaaatcaaagagaatataaagaatagttccgactcggaccgatg

SEQ ID NO: 1447 - DNA, 203 bp, Homo sapiens
  source 1..203: mol_type = other DNA
ggcgcgccagtcctggtttcattgtgttggccaggctggtctcgaactcctgacctcgtgatccgcccgccttggcctcccaaagtgctaggattacaagtgtgagccaccgcgtccggcctttcaaatggtatttttgattttcctcttccagtccttaaagcagctgatttagaagaatacaaatccgactcggaccgatg

SEQ ID NO: 1448 - DNA, 203 bp, Homo sapiens
  source 1..203: mol_type = other DNA
ggcgcgccagtcctcgctgacgtcatcgtgcgtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgacgactcggaccgatg

SEQ ID NO: 1449 - DNA, 203 bp, Homo sapiens
  source 1..203: mol_type = other DNA
ggcgcgccagtcctcggcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggccgactcggaccgatg

SEQ ID NO: 1450 - DNA, 203 bp, Homo sapiens
  source 1..203: mol_type = other DNA
ggcgcgccagtcctagagggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttcgactcggaccgatg

SEQ ID NO: 1451 - DNA, 203 bp, Homo sapiens
  source 1..203: mol_type = other DNA
ggcgcgccagtcctcacttctgccgcccctgtttcaagggataagaaaccctgcgacaaaacctcctccttttccaagcggctgccgaagatggcggaggtgcaggtcctggtgcttgatggtcgaggccatctcctgggccgcctggcggccatcgtggctaaacaggtactgctgggccggaaggtcgactcggaccgatg

SEQ ID NO: 1452 - DNA, 203 bp, Homo sapiens
  source 1..203: mol_type = other DNA
ggcgcgccagtcctgtgtgaggggaacctgggagggcctcatgggggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgccgactcggaccgatg

SEQ ID NO: 1453 - DNA, 203 bp, Homo sapiens
  source 1..203: mol_type = other DNA
ggcgcgccagtcctcgcccctgtttcaagggataagaaaccctgcgacaaaacctcctccttttccaagcggctgccgaagatggcggaggtgcaggtcctggtgcttgatggtcgaggccatctcctgggccgcctggcggccatcgtggctaaacagtgaagtacctggctttcctccgcaagcggcgactcggaccgatg

SEQ ID NO: 1454 - DNA, 203 bp, Homo sapiens
  source 1..203: mol_type = other DNA
ggcgcgccagtcctagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggccgactcggaccgatg

SEQ ID NO: 1455 - DNA, 203 bp, Homo sapiens
  source 1..203: mol_type = other DNA
ggcgcgccagtcctagtagagtccagagcggggaagcgggcgcctgcgcagagacatagtgaccgtccgctcgccgccccgcctctgccaagccgcgccagcgcagtgaataacgagccagcagagacagcgtctgcgcagccgtggctgaggagcctgtggcggcagcggcgatggaaccagcggagcgactcggaccgatg

SEQ ID NO: 1456 - DNA, 203 bp, Homo sapiens
  source 1..203: mol_type = other DNA
ggcgcgccagtcctccactcagagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagcccgactcggaccgatg

SEQ ID NO: 1457 - DNA, 203 bp, Homo sapiens
  source 1..203: mol_type = other DNA
ggcgcgccagtcctgcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaacgactcggaccgatg

SEQ ID NO: 1458 - DNA, 203 bp, Homo sapiens
  source 1..203: mol_type = other DNA
ggcgcgccagtcctcaaatccaggcctgcgggctcctcccccaggacccccactcgcagtccctcaagcctgtgctcccggaaaggcactgggcgaccgcacccgtggctttctctgggcgaccgggtcccagactccccccagcacagcagagcgcttccctgcccacccgcggaaaccgccccaggcgactcggaccgatg

SEQ ID NO: 1459 - DNA, 203 bp, Homo sapiens
  source 1..203: mol_type = other DNA
ggcgcgccagtcctcctctgaggaggcgttgtaagtccgcccagctccccacttgctgtgctctcactcaatgcgaagggaaccaaggtaccagggccaagtgggtccagacatccacacggattctgaaagggcaggtcaagcagactttgtccagccatcagccacggcctctcgacagcaccaagcgactcggaccgatg

SEQ ID NO: 1460 - DNA, 203 bp, Homo sapiens
  source 1..203: mol_type = other DNA
ggcgcgccagtcctgagggctggcggcttttctggcgcgggccagggggaggaggagaaaggagctcccgggatcccctcgccccctcccccaactgcccggtgcggctggtgatcgccgagaagggcctggtgtgcgaggagcgggacgtgagcctgccacagagcgagcacaaggagccctggttccgactcggaccgatg

SEQ ID NO: 1461 - DNA, 203 bp, Homo sapiens
  source 1..203: mol_type = other DNA
ggcgcgccagtcctcaccatgccgccacattatctccattcctccagtgcccgcctgacactggccctgaatcagggctggagggggcaggcatttctcatttactaaagtgctggatgcagcccttgaggttcggcagaagcagaaagctgcgtcttgaaagcgccacaagcagcagctgctgagcccgactcggaccgatg

SEQ ID NO: 1462 - DNA, 203 bp, Homo sapiens
  source 1..203: mol_type = other DNA
ggcgcgccagtcctttatctccattcctccagtgcccgcctgacactggccctgaatcagggctggagggggcaggcatttctcatttactaaagtgctggatgcagcccttgaggttcggcagaagcagaaagctgcggtgagtctggctgtgtcttgaaagcgccacaagcagcagctgctgagcccgactcggaccgatg

SEQ ID NO: 1463 - DNA, 203 bp, Homo sapiens
  source 1..203: mol_type = other DNA
ggcgcgccagtcctgctgactgccactaccagccggagccagggcctggtcgagacaactatttttgaggtatctgaggctaccccacagcactctctggcattggcaagactcgtggctgtgacccatgggcctctgaggaggcgttgtaagtccgcccagctccccacttgctgtgctctcactcacgactcggaccgatg

SEQ ID NO: 1464 - DNA, 203 bp, Homo sapiens
  source 1..203: mol_type = other DNA
ggcgcgccagtccttctttttgtttgcacccgcctccgacccggaactgctttcttgggaagatggcggctgtgtcggtgtatgctccaccagttggaggcttctcttttgataactgccgcaggaatgccgtcttggaagccgattttgcaaagaggggatacaagcttccaaaggtccggaaaactcgactcggaccgatg

SEQ ID NO: 1465 - DNA, 203 bp, Homo sapiens
  source 1..203: mol_type = other DNA
ggcgcgccagtcctagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatcgactcggaccgatg

SEQ ID NO: 1466 - DNA, 203 bp, Homo sapiens
  source 1..203: mol_type = other DNA
ggcgcgccagtcctgagcccggcctcaggccccgggccgcggagggtgcagcgccgggcctggcctcccgataaagaacaggaaaaagagaaaaaatcagtgagacggcgtcttgctgtgttgcccaggctggcctccaactcctgggctcaagtgatcctctggcatcagcctcctgagtagctgtgcgactcggaccgatg

SEQ ID NO: 1467 - DNA, 203 bp, Homo sapiens
  source 1..203: mol_type = other DNA
ggcgcgccagtcctatcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgcgactcggaccgatg

SEQ ID NO: 1468 - DNA, 203 bp, Homo sapiens
  source 1..203: mol_type = other DNA
ggcgcgccagtcctggcagagctggagctggagtaatgtgggtgggggcggcttgggaagaggctgagcccggccaagggagcagagggctgggactggctgggggttgggaggggaggaacgaagcaggaaggctgtcggatcgggggcccagggtgtccgagtgaactgggtgattcagagacacgcgactcggaccgatg

SEQ ID NO: 1469 - DNA, 203 bp, Homo sapiens
  source 1..203: mol_type = other DNA
ggcgcgccagtcctacgcagagagaaagttacgaggttcgtggccgcggtttccccaggcagctggcgctggaggcttcggcgtcacgtgctgaaactcgttttcatcttcttggtttcatcttaataccaacgtcatgtctggttctaatggttccaaagaaaattctcacaataaggctcggacgtcgactcggaccgatg

SEQ ID NO: 1470 - DNA, 203 bp, Homo sapiens
  source 1..203: mol_type = other DNA
ggcgcgccagtcctgagttcagtgcggctgcgcagtagcgggggtgggcgggagcgcccttccaggagatgggttggctgcagtagtgagaggctgggggtgcggctctttccctgcagtcctgccgaggaagcgtgcgtccctggcgcttccttcttctcttccggcggagagcttgggatgtggtacgactcggaccgatg

SEQ ID NO: 1471 - DNA, 203 bp, Homo sapiens
  source 1..203: mol_type = other DNA
ggcgcgccagtcctcctacggtaggatggggaaacctcacagaccacattgtcacccggcctcagctctccgccccggcgctcagagggtaactctcacccacctcgtccgcttctctgaaccagagtgacccaggctgcgctccgccccgctctcctaccccgagttggcacggaggcccggcagcccgactcggaccgatg

SEQ ID NO: 1472 - DNA, 203 bp, Homo sapiens
  source 1..203: mol_type = other DNA
ggcgcgccagtcctagcggaagtcacttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgaccgactcggaccgatg

SEQ ID NO: 1473 - DNA, 203 bp, Homo sapiens
  source 1..203: mol_type = other DNA
ggcgcgccagtcctggaccagagttcagtgcggctgcgcagtagcgggggtgggcgggagcgcccttccaggagatgggttggctgcagtagtgagaggctgggggtgcggctctttccctgcagtcctgccgaggaagcgtgcgtccctggcgcttccttcttctcttccggcggagaggacctaatcgactcggaccgatg

SEQ ID NO: 1474 - DNA, 203 bp, Homo sapiens
  source 1..203: mol_type = other DNA
ggcgcgccagtcctgcgggtttccgggtgggaggggccgggaatcggggccgtgaagggaagccctcgagggccggccgggagcccggaaaccgaggtcccccttcggccagttttaatccccccgccctcccctctgccccaggcccggcagccatggcggtggaaggaggaatgaaatgtgtgaagcgactcggaccgatg

SEQ ID NO: 1475 - DNA, 203 bp, Homo sapiens
  source 1..203: mol_type = other DNA
ggcgcgccagtcctcgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagcgactcggaccgatg

SEQ ID NO: 1476 - DNA, 203 bp, Homo sapiens
  source 1..203: mol_type = other DNA
ggcgcgccagtcctgccggtggctggctgcgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagcgactcggaccgatg

SEQ ID NO: 1477 - DNA, 203 bp, Homo sapiens
  source 1..203: mol_type = other DNA
ggcgcgccagtcctgccgtcgcggagccgcgcagccctcggagcacgaatatatacagccctgctctgggacacacctccattggatttaaaagacagtcctcgtcagcactgactttcagctatggaatcgacggttgatgatgaagcgccggccgtgtaaatgaagatcgggtgaggagcaggacgcgactcggaccgatg

SEQ ID NO: 1478 - DNA, 203 bp, Homo sapiens
  source 1..203: mol_type = other DNA
ggcgcgccagtcctgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttcgactcggaccgatg

SEQ ID NO: 1479 - DNA, 203 bp, Homo sapiens
  source 1..203: mol_type = other DNA
ggcgcgccagtcctctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggggacaagcgactcggaccgatg

SEQ ID NO: 1480 - DNA, 203 bp, Homo sapiens
  source 1..203: mol_type = other DNA
ggcgcgccagtcctcaggcgggacgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctcgactcggaccgatg

SEQ ID NO: 1481 - DNA, 203 bp, Homo sapiens
  source 1..203: mol_type = other DNA
ggcgcgccagtccttgccagtcccactgcctgcgcgcccacctgggccagtctccgcttgccgcgtcctcccatcccctagtctgcaggcctggtgcccttgaattcacccgcttctgttgcgttggggaccgcgagctgcactgcttcctgcccaagcccaagctcctcgcagcagtaggggacaagcgactcggaccgatg

SEQ ID NO: 1482 - DNA, 203 bp, Homo sapiens
  source 1..203: mol_type = other DNA
ggcgcgccagtcctgctcagaggagcagggctgggagcgaggtgctgctggggcagtgtctgggcgggaagccgggccccagggcctgatgtgcctgtgggggcactccacagcccctgcccacaccctctcctccccgcctctgctgttctgctccctgccctgtgccctccacttgcagccagggacgactcggaccgatg

SEQ ID NO: 1483 - DNA, 203 bp, Homo sapiens
  source 1..203: mol_type = other DNA
ggcgcgccagtcctactccactagggcacgcaggcgacgagcacactggcagagggcctcccgcagggcccactccccacctggctctcgccccaccatggcccgggaagcaggccaggtttgtgccaggcctgccgtgcccagggggaggaagggctctgtgttctttgcctgtgtctctgtggtgacgactcggaccgatg

SEQ ID NO: 1484 - DNA, 203 bp, Homo sapiens
  source 1..203: mol_type = other DNA
ggcgcgccagtcctcccgggtccgcaaagccggtggcgcccggaggctgcacggagagcggtgcccgcgtcagagcctcgccctgtcaccaggctggagtacagtggcgcgatctcggctcactgcaacttccacctgctgggttcaagcaattcttctgacctcagtgaccgaaggaagagaccaagcgactcggaccgatg

SEQ ID NO: 1485 - DNA, 203 bp, Homo sapiens
  source 1..203: mol_type = other DNA
ggcgcgccagtcctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctcccgactcggaccgatg

SEQ ID NO: 1486 - DNA, 203 bp, Homo sapiens
  source 1..203: mol_type = other DNA
ggcgcgccagtcctctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgcgactcggaccgatg

SEQ ID NO: 1487 - DNA, 203 bp, Homo sapiens
  source 1..203: mol_type = other DNA
ggcgcgccagtcctgagaggcgcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcacgactcggaccgatg

SEQ ID NO: 1488 - DNA, 203 bp, Homo sapiens
  source 1..203: mol_type = other DNA
ggcgcgccagtcctagatggcgtgcttgttggagaccccaatccgcatgagcgtcctttcgtttttttaaagaaaaagacgactttcacctttcactatgttgctcttgaaccaggaccaggaatgaaagttactgggagataacttcgaaggattttgcaacaaattcgagctgtccgactctgagacgactcggaccgatg

SEQ ID NO: 1489 - DNA, 203 bp, Homo sapiens
  source 1..203: mol_type = other DNA
ggcgcgccagtcctcctttgccccggacccgccaccccagagtcaagctgagggcatcggcatgccgcagggaagacgatcaggactgtttttaatcgggcagtcgcgcggatggccttttccctctcgcctccttccgccccgcccccactctcagcccggccgcgctgattgtcctgggtcacatacgactcggaccgatg

SEQ ID NO: 1490 - DNA, 203 bp, Homo sapiens
  source 1..203: mol_type = other DNA
ggcgcgccagtcctaagacgggagaaaaggaggggcgtacgcgggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagcgactcggaccgatg

SEQ ID NO: 1491 - DNA, 203 bp, Homo sapiens
  source 1..203: mol_type = other DNA
ggcgcgccagtcctcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgcgactcggaccgatg

SEQ ID NO: 1492 - DNA, 203 bp, Homo sapiens
  source 1..203: mol_type = other DNA
ggcgcgccagtcctatcacaacttggttcaatgggtagcctcaccatgaaatcacagcttcagatcactgtatcgttacccctgtgagtaaattacattttcgtgtgtggagtcaccagacactgaaatctgatgttttgttgggaactgctgcattagatatttatgaaacattaaagtcaaacaatcgactcggaccgatg

SEQ ID NO: 1493 - DNA, 203 bp, Homo sapiens
  source 1..203: mol_type = other DNA
ggcgcgccagtcctatggtaacgaggaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgcgactcggaccgatg

SEQ ID NO: 1494 - DNA, 203 bp, Homo sapiens
  source 1..203: mol_type = other DNA
ggcgcgccagtccttgacacctctcctactccttctctttaatgtacagctgagactgggatacccttagactgaaaggaaggacacggctatgtagaaaagaattgactgaaggggaggagtactcgtgaaccccttgcttcagcctcccaatgttctgagagaggaggagccaggcgcagtggctccgactcggaccgatg

SEQ ID NO: 1495 - DNA, 203 bp, Homo sapiens
  source 1..203: mol_type = other DNA
ggcgcgccagtcctgcgtgtgtggctgcagcctgcaccgttgctgcccgctgcccaggacgcggggtgggggacaggagccagagtggtgcctcctacagaccaatctgcggccccaaggtggggggccctacagagatgctccgagagccaaggacatgaagaacaagctggggatcttcagacggccgactcggaccgatg

SEQ ID NO: 1496 - DNA, 203 bp, Homo sapiens
  source 1..203: mol_type = other DNA
ggcgcgccagtccttctggaggcccttcctgagaagccgtcgccagagttacgtcgcggttttcttaactttagagcctgggggccggagaccctgattgcactcgacctggctctgccctactctctgcgtgacttccactgttcatcaaagaaaaagggttcttttggtcacccaccactggcccccgactcggaccgatg

SEQ ID NO: 1497 - DNA, 203 bp, Homo sapiens
  source 1..203: mol_type = other DNA
ggcgcgccagtcctggccccgcggcccgcgcgctcctgggcgggggatgttgtgatggagaagccgcggcggagcccgaaccccgcagcctgagccacctccgtcatctgggcccggggcctcaccgcgcaggagctgccaaggccatgtctgttccatcatcactgagccagtcggccattaatgcccgactcggaccgatg

SEQ ID NO: 1498 - DNA, 203 bp, Homo sapiens
  source 1..203: mol_type = other DNA
ggcgcgccagtcctagacgctctgccctggtgagaagggggcgggatgagcttttctctgcagcccagcaccaggctgtgagcccagctggctgggctggaggggctgtgaggagggagggtggaggcaggaggggccgggaatgagcgccatgttctcccaggactttttcctggccattatcctgccgactcggaccgatg

SEQ ID NO: 1499 - DNA, 203 bp, Homo sapiens
  source 1..203: mol_type = other DNA
ggcgcgccagtcctggccccaggcagctggggtattccttaggggctgagtctcctggtatccctaagactgggcttggcttaggcactgaggactttttcctggccattatcctgcaggacagcagcgcagattccttctggaaccccaacgccttcgagacggattccgacctgccggctggatggcgactcggaccgatg

SEQ ID NO: 1500 - DNA, 203 bp, Homo sapiens
  source 1..203: mol_type = other DNA
ggcgcgccagtcctggtctcagaatatctgggagacctcgggctcttgatctccgagacaccccgtttcgtagtggagaacagtccagatcggggaagtttattttgcccaaagccggttagaggccccctggccctcgattcccagtgcggggctcagagctcccctgaacagcagctgcagcagcccgactcggaccgatg

SEQ ID NO: 1501 - DNA, 203 bp, Homo sapiens
  source 1..203: mol_type = other DNA
ggcgcgccagtcctacgctgaactttaggagccagtctaaggcctaggcgcagacgcactgagcctaagcagccggtgatggcggcagcggctgtggtggctgcggcgggtccgggcccatgaggcgacgaaggaggcgggacggcttttacccagccccggacttccgagacagggaagctgaggaccgactcggaccgatg

SEQ ID NO: 1502 - DNA, 203 bp, Homo sapiens
  source 1..203: mol_type = other DNA
ggcgcgccagtcctccacgcgcctgccaagccaatcggctaggagcagcgagcggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctcgactcggaccgatg

SEQ ID NO: 1503 - DNA, 203 bp, Homo sapiens
  source 1..203: mol_type = other DNA
ggcgcgccagtcctagcacccaaacttaccctgtccaggtggcccacgaagctacccaagacatctctgcacagccctagcctttttggcttcacccactccgttcgggagttggggacccggcctctacattccttaggggaactccagctccaggtctgagagtcactggagctaccagaagcatccgactcggaccgatg

SEQ ID NO: 1504 - DNA, 203 bp, Homo sapiens
  source 1..203: mol_type = other DNA
ggcgcgccagtcctaactacagctcccagcatgccccggggcccgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgactcggaccgatg

SEQ ID NO: 1505 - DNA, 203 bp, Homo sapiens
  source 1..203: mol_type = other DNA
ggcgcgccagtcctgcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagacgactcggaccgatg

SEQ ID NO: 1506 - DNA, 203 bp, Homo sapiens
  source 1..203: mol_type = other DNA
ggcgcgccagtcctgtcactatacagagacagtccatgttggggggcctggccgcggcggcgggaacccggataatgggaaaggagatagaagcagaagcacagaggcccctgaggcaaacatggagacctggccagccaccagcgatgacagcaaagacgatgagctcgcggctcacggcgctcctgcgactcggaccgatg

SEQ ID NO: 1507 - DNA, 203 bp, Homo sapiens
  source 1..203: mol_type = other DNA
ggcgcgccagtcctcagccgccgccggcgccgaacttgggctcgggaagccgggggaccgcgtcctgcgccggagcaggggcatggtctagtggcccagtcaggacgcggaaacactccctggaggttctgacccactccctctcagcctccgcctggtctctggtgtagtcgccgccgccagccgcccgactcggaccgatg

SEQ ID NO: 1508 - DNA, 203 bp, Homo sapiens
  source 1..203: mol_type = other DNA
ggcgcgccagtcctagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgcccgactcggaccgatg

SEQ ID NO: 1509 - DNA, 203 bp, Homo sapiens
  source 1..203: mol_type = other DNA
ggcgcgccagtcctgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatcgactcggaccgatg

SEQ ID NO: 1510 - DNA, 203 bp, Homo sapiens
  source 1..203: mol_type = other DNA
ggcgcgccagtccttatgctgtgttcggggctgtctgtcggcgccacagggaatgggggctggggcatggtctagtggcccagtcaggacgcggaaacactccctggaggttctgacccactccctctcagcctccgcctggtctctggtgtagtcgccgccgccagccgccatgggcaaacagaacacgactcggaccgatg

SEQ ID NO: 1511 - DNA, 203 bp, Homo sapiens
  source 1..203: mol_type = other DNA
ggcgcgccagtcctggggtcccccccgcaggtactccactctcagtctgcaaaagtgtacgcccgcagagccgccccaggtgcctgggtgttgtgtgattgacgcggggaaggaggggtcagccgatccctccccaaccctccatcccatccctgaggattgggctggtacccgcgtctctcggacagcgactcggaccgatg

SEQ ID NO: 1512 - DNA, 203 bp, Homo sapiens
  source 1..203: mol_type = other DNA
ggcgcgccagtcctccactgcgccagcgctgagcctgccagggctggggctggggatcaccttgggatgatggtgtcagtcccagggggcaggagatcgagtgtcctctgagctggcgactgggcctgtagaagggaaccggcatttgtggagtgtctactgagtgccaagcacgtggtgaggtgtgtcgactcggaccgatg

SEQ ID NO: 1513 - DNA, 203 bp, Homo sapiens
  source 1..203: mol_type = other DNA
ggcgcgccagtcctgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggcccgactcggaccgatg

SEQ ID NO: 1514 - DNA, 203 bp, Homo sapiens
  source 1..203: mol_type = other DNA
ggcgcgccagtcctagcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgcgactcggaccgatg

SEQ ID NO: 1515 - DNA, 203 bp, Homo sapiens
  source 1..203: mol_type = other DNA
ggcgcgccagtcctcaactcgggaatccccggtgactttgtcgcagcctccgttaccctgtgatctgcaagtcctgggagacgcacagctaagatgcccggacatcctggaagctgggaaatggtattgctgtctctaagccagacctgatcacctgtctggagcaagaaaaagagccttgggagcctcgactcggaccgatg

SEQ ID NO: 1516 - DNA, 203 bp, Homo sapiens
  source 1..203: mol_type = other DNA
ggcgcgccagtcctggcttccgggatgtggcggggcctttgtctctggctgcagttggagctctgcgtctcgtcttcgttcttctgtgtcctctgctgctagaggtccagcctctgtggctctgtgacctgcgggtattgggggatccacagctaagacgccaggaccccccggaagcctagaaatggcgactcggaccgatg

SEQ ID NO: 1517 - DNA, 203 bp, Homo sapiens
  source 1..203: mol_type = other DNA
ggcgcgccagtccttttgtctccagctcccgctagaccttgggacccgcctctgcttttccgcgttctccaactcgggaatccccggtgactttgtcgcagcctccgttaccctgtgatctgcaagtcctgggagacgcacagctaagatgcccggacatcctggaagctgggaaatgggaccattgacgactcggaccgatg

SEQ ID NO: 1518 - DNA, 203 bp, Homo sapiens
  source 1..203: mol_type = other DNA
ggcgcgccagtcctcgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacgatgctgtacgactcggaccgatg

SEQ ID NO: 1519 - DNA, 203 bp, Homo sapiens
  source 1..203: mol_type = other DNA
ggcgcgccagtcctttcttctgtgtcctctgctgctagaggtccagcctctgtggctctgtgacctgcgggtattgggggatccacagctaagacgccaggaccccccggaagcctagaaatggtattgctgtctctaagccagacctgatcacctgtctggagcaagaaaaagagccttgggagcctcgactcggaccgatg

SEQ ID NO: 1520 - DNA, 203 bp, Homo sapiens
  source 1..203: mol_type = other DNA
ggcgcgccagtcctacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcacccgactcggaccgatg

SEQ ID NO: 1521 - DNA, 203 bp, Homo sapiens
  source 1..203: mol_type = other DNA
ggcgcgccagtccttcccccgccccaggtccttccccaccgagacgcgccgggggaccgcgggcgagtgcagccggtgacccggcgagaggcggcgccgctcccaagatgtcgcagacggccatgtccgaaacctagggtccgtgacgagaagttattaccgaggcgcggccggggctctcctcgtctcgactcggaccgatg

SEQ ID NO: 1522 - DNA, 203 bp, Homo sapiens
  source 1..203: mol_type = other DNA
ggcgcgccagtcctcgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtctgagagtcactggagctaccagaagcatccgactcggaccgatg

SEQ ID NO: 1523 - DNA, 203 bp, Homo sapiens
  source 1..203: mol_type = other DNA
ggcgcgccagtccttcccttgcttgttctcactctgtgcccccggcaacgaccccgcgcgcctacactcccgtgccgcctcagctactagtccgcaacttctagccccaaaacgctggagctcagaacccagctcaggcaagactaactcggtgttgctcctcccggcgctgacttcgaggcccggctcgactcggaccgatg

SEQ ID NO: 1524 - DNA, 203 bp, Homo sapiens
  source 1..203: mol_type = other DNA
ggcgcgccagtcctgagtttttattattacagagaagaaggaaactcacttcctgtcgtcgcagagcacagcctagttctgatgcagaggggactgttttcagatggagacactagtaagaagaagaaaaatgtcaccatgcgatccatcaagaccacccgggaccgagtgcctacatatcagtacaacgactcggaccgatg

SEQ ID NO: 1525 - DNA, 203 bp, Homo sapiens
  source 1..203: mol_type = other DNA
ggcgcgccagtcctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagcgactcggaccgatg

SEQ ID NO: 1526 - DNA, 203 bp, Homo sapiens
  source 1..203: mol_type = other DNA
ggcgcgccagtcctcatttggggagaatgagggagaaaagaacgggcattccgagccaagagcactgcatgagcaaggagttgggaggttgcttacttgttgaacatatttgttgcgtatttgcatatttgctaaacaggttttcgtaacaccccagggcctgtaaggtttggtgtttccctttcaagcgactcggaccgatg

SEQ ID NO: 1527 - DNA, 203 bp, Homo sapiens
  source 1..203: mol_type = other DNA
ggcgcgccagtcctcgcgacttttgctttacccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgcccgactcggaccgatg

SEQ ID NO: 1528 - DNA, 203 bp, Homo sapiens
  source 1..203: mol_type = other DNA
ggcgcgccagtcctcgaacgcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagcgactcggaccgatg

SEQ ID NO: 1529 - DNA, 203 bp, Homo sapiens
  source 1..203: mol_type = other DNA
ggcgcgccagtcctagttctcaggctcacattcccaccacccacctctgagcccagccctccctagcatcaccacttccatcccattcctcagccaagagccaggaatcctgattccagatcccacgcttccctgcctccctcaggtcccagctcttgctcctgcctgtttgcctggaaatggccacgcgactcggaccgatg

SEQ ID NO: 1530 - DNA, 203 bp, Homo sapiens
  source 1..203: mol_type = other DNA
ggcgcgccagtcctcctttccccttggggccctgtccttcccagtcttgccccagcctcgggaggtggtggagtgacctggccccagtgctgcgtccttatcagccgagccggtcccagctcttgctcctgcctgtttgcctggaaatggccacgcttctccttctccttggggtgctggtggtaagccgactcggaccgatg

SEQ ID NO: 1531 - DNA, 203 bp, Homo sapiens
  source 1..203: mol_type = other DNA
ggcgcgccagtcctacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtgcatatcttttaccatatttaatactacttcgactcggaccgatg

SEQ ID NO: 1532 - DNA, 203 bp, Homo sapiens
  source 1..203: mol_type = other DNA
ggcgcgccagtcctattttttgataattggcctcgaccctcctcacctactccttccttagccaaatctactgagaaaagacttggagggggactctccctccacccctccgtgggcaaactcctgacggactgtaagaccttggccgccctctcgcctggcctgggtccctcgaatgaatgtacatccgactcggaccgatg

SEQ ID NO: 1533 - DNA, 203 bp, Homo sapiens
  source 1..203: mol_type = other DNA
ggcgcgccagtcctccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtccgactcggaccgatg

SEQ ID NO: 1534 - DNA, 203 bp, Homo sapiens
  source 1..203: mol_type = other DNA
ggcgcgccagtcctgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctcgactcggaccgatg

SEQ ID NO: 1535 - DNA, 203 bp, Homo sapiens
  source 1..203: mol_type = other DNA
ggcgcgccagtcctgctccacctcgtccgtggccctgcccacccaggccgcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcacgactcggaccgatg

SEQ ID NO: 1536 - DNA, 203 bp, Homo sapiens
  source 1..203: mol_type = other DNA
ggcgcgccagtcctaggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgcgactcggaccgatg

SEQ ID NO: 1537 - DNA, 203 bp, Homo sapiens
  source 1..203: mol_type = other DNA
ggcgcgccagtccttaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaacgactcggaccgatg

SEQ ID NO: 1538 - DNA, 203 bp, Homo sapiens
  source 1..203: mol_type = other DNA
ggcgcgccagtcctggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacacccgactcggaccgatg

SEQ ID NO: 1539 - DNA, 203 bp, Homo sapiens
  source 1..203: mol_type = other DNA
ggcgcgccagtcctagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccacccgactcggaccgatg

SEQ ID NO: 1540 - DNA, 203 bp, Homo sapiens
  source 1..203: mol_type = other DNA
ggcgcgccagtccttgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggccactcttcacctccacccgactcggaccgatg

SEQ ID NO: 1541 - DNA, 203 bp, Homo sapiens
  source 1..203: mol_type = other DNA
ggcgcgccagtcctccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggccactcttcacctccacccgactcggaccgatg

SEQ ID NO: 1542 - DNA, 203 bp, Homo sapiens
  source 1..203: mol_type = other DNA
ggcgcgccagtcctgagttgcggcgatgggcggggcaggcgcgcggggattggcgggatgccgcgcgccgcgcgtgaacctccttggcctgggcgaagctgtgtggaccaagcaagtcaggagtgtggccatgttttctgagcaggctgcccagagggcccacactctactgtccccaccatcagccacgactcggaccgatg

SEQ ID NO: 1543 - DNA, 203 bp, Homo sapiens
  source 1..203: mol_type = other DNA
ggcgcgccagtcctttccttttctctttttggatgaccgctacaggtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggcccgactcggaccgatg

SEQ ID NO: 1544 - DNA, 203 bp, Homo sapiens
  source 1..203: mol_type = other DNA
ggcgcgccagtccttattcccccaaagaagcggcctcccgggaaggagcgccctggcggagaagactcgaacggctcccacagccgggcgttgggggaaagaatctccggcctgtgaaactgtgaggggattcggccaagacgtcctcttccctctgcctcccacccaggccactcttcacctccacccgactcggaccgatg

SEQ ID NO: 1545 - DNA, 203 bp, Homo sapiens
  source 1..203: mol_type = other DNA
ggcgcgccagtcctcaggacccgggctttctgctgtacagacttctcgtgggcagcctcccctcggaactcgggcatcatggcctcaggcccagccaccatcagtcacgtcactcctgggactgaggaggcaggggagggataaggggcagagatggaggccccactccccgaggttgcctagacaaccgactcggaccgatg

SEQ ID NO: 1546 - DNA, 203 bp, Homo sapiens
  source 1..203: mol_type = other DNA
ggcgcgccagtcctcctgaccacgcccacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccacccgactcggaccgatg

SEQ ID NO: 1547 - DNA, 203 bp, Homo sapiens
  source 1..203: mol_type = other DNA
ggcgcgccagtcctccaccccgaccccagtagcgctgggcctaggagcactcgggagttgctcagtggctctgcaccgctggcgcgggaaggggagaaaggggctgccagaggcgggaatttggtccccacgcgctgctccagggacgagaagccagggaccggcggttctgggagcagctgtgctggcgactcggaccgatg

SEQ ID NO: 1548 - DNA, 203 bp, Homo sapiens
  source 1..203: mol_type = other DNA
ggcgcgccagtcctccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcacccgactcggaccgatg

SEQ ID NO: 1549 - DNA, 203 bp, Homo sapiens
  source 1..203: mol_type = other DNA
ggcgcgccagtcctgattccgtagagacactcctccgctgcctgagtcctcggcgaacatggcggcccccgagtcagggccggctttgagtccaggcactgcagagggtgaggaggagacgattctctatgacttgttggtcaacaccgagtggccaccggagactgaagtacagcctagaggcaacccgactcggaccgatg

SEQ ID NO: 1550 - DNA, 203 bp, Homo sapiens
  source 1..203: mol_type = other DNA
ggcgcgccagtcctgaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgcccgactcggaccgatg

SEQ ID NO: 1551 - DNA, 203 bp, Homo sapiens
  source 1..203: mol_type = other DNA
ggcgcgccagtcctagtatgcaggtcgctgcagggacccgaggcgacacgcgcctgcaggaggtggcactcctgccgcagctcttcgatctgcttgtccttggccagcggcgcgctcgcctgctccgacaggtcccgagcgcgctggcgggcaaagacttggcacagctccaggccggcgcaactctccgactcggaccgatg

SEQ ID NO: 1552 - DNA, 203 bp, Homo sapiens
  source 1..203: mol_type = other DNA
ggcgcgccagtcctcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggcgactcggaccgatg

SEQ ID NO: 1553 - DNA, 203 bp, Homo sapiens
  source 1..203: mol_type = other DNA
ggcgcgccagtccttttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcacgactcggaccgatg

SEQ ID NO: 1554 - DNA, 203 bp, Homo sapiens
  source 1..203: mol_type = other DNA
ggcgcgccagtcctctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagcgactcggaccgatg

SEQ ID NO: 1555 - DNA, 203 bp, Homo sapiens
  source 1..203: mol_type = other DNA
ggcgcgccagtcctcatcctactaaagccctgggaaaagagacaaatggtgaagaggagaatgaaaggttgcaggagggagctcctgttttagccctgccacctacctgggggccctctggctaccagtgtccttggaggggcttccttgctgcttctcccactaaggagctctggagccttaggacccgactcggaccgatg

SEQ ID NO: 1556 - DNA, 203 bp, Homo sapiens
  source 1..203: mol_type = other DNA
ggcgcgccagtccttgatgccatcatcccctctttcccctgcaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtccgactcggaccgatg

SEQ ID NO: 1557 - DNA, 203 bp, Homo sapiens
  source 1..203: mol_type = other DNA
ggcgcgccagtcctggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagaggcacacaaagcgtagtttctaagctgacgactcggaccgatg

SEQ ID NO: 1558 - DNA, 203 bp, Homo sapiens
  source 1..203: mol_type = other DNA
ggcgcgccagtcctacacccagtgcgcatgcgcagcaccccggcccggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctcgactcggaccgatg

SEQ ID NO: 1559 - DNA, 203 bp, Homo sapiens
  source 1..203: mol_type = other DNA
ggcgcgccagtccttttcacgacaacttccggaagaggtcgccatggcttcccgggaggaggtactcgccttacaagctgaagttgcccaacgtgaggaggaattgaattcgctgaagcagaagctggcgtcggctcttttggctgagcaggaaccgcagccagaacggctggttccggtgtcgccgccgactcggaccgatg

SEQ ID NO: 1560 - DNA, 203 bp, Homo sapiens
  source 1..203: mol_type = other DNA
ggcgcgccagtcctctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcacgactcggaccgatg

SEQ ID NO: 1561 - DNA, 203 bp, Homo sapiens
  source 1..203: mol_type = other DNA
ggcgcgccagtcctgcggagtgagtgaccaggaatgtgggggaaatttatgtcagtcatcaggcaggtactagaagatgctaggggcctcacagacagcttgttcccggctgttaacatggagcagagcgttccctggggctgagcatgggagcccagcacttcttatagtgtttccagagcctggcacgactcggaccgatg

SEQ ID NO: 1562 - DNA, 203 bp, Homo sapiens
  source 1..203: mol_type = other DNA
ggcgcgccagtcctagaaaacccggcgtccggaagcccgtgctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggcccgactcggaccgatg

SEQ ID NO: 1563 - DNA, 203 bp, Homo sapiens
  source 1..203: mol_type = other DNA
ggcgcgccagtcctttttggctgttctgaagagtgttactgtgaacattcatgcacaaatttttatgtggaggcagtagcagaatcccatggtagccaggtgggtgaaggggagcgaggacgttctacctgccttgaagaagacacctgacctgcggagtgagtgaccagtgtttccagagcctggcacgactcggaccgatg

SEQ ID NO: 1564 - DNA, 203 bp, Homo sapiens
  source 1..203: mol_type = other DNA
ggcgcgccagtcctgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgaccgactcggaccgatg

SEQ ID NO: 1565 - DNA, 203 bp, Homo sapiens
  source 1..203: mol_type = other DNA
ggcgcgccagtccttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaacgactcggaccgatg

SEQ ID NO: 1566 - DNA, 203 bp, Homo sapiens
  source 1..203: mol_type = other DNA
ggcgcgccagtccttctaggagacaggggccacggggagagcacagccacccggcgcgaagagccctctgtaccccgcttcctcttgaggccctgggaccgtccaggaaatgtctgggagcccgcctgcggagggcatagcgccgaccctcgctccccgcccaggacccgaatgaacctggagagcggcgactcggaccgatg

SEQ ID NO: 1567 - DNA, 203 bp, Homo sapiens
  source 1..203: mol_type = other DNA
ggcgcgccagtcctatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttcgactcggaccgatg

SEQ ID NO: 1568 - DNA, 203 bp, Homo sapiens
  source 1..203: mol_type = other DNA
ggcgcgccagtccttacgagttggcccggagcaaggcggcccaggacaggcaggggctgcacgcggtgaagaaaccaagacgcagagaggccaagccccttgccttgggtcacacagccaaaggaggcagagccagaactcacaaccaggcagtcacccgcagggccaaggtggctcccgctgagaggcgactcggaccgatg

SEQ ID NO: 1569 - DNA, 203 bp, Homo sapiens
  source 1..203: mol_type = other DNA
ggcgcgccagtcctgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacacccgactcggaccgatg

SEQ ID NO: 1570 - DNA, 203 bp, Homo sapiens
  source 1..203: mol_type = other DNA
ggcgcgccagtcctgtcattcacccgcgccacccggaagccgcggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgacgactcggaccgatg

SEQ ID NO: 1571 - DNA, 203 bp, Homo sapiens
  source 1..203: mol_type = other DNA
ggcgcgccagtcctcgcggggcggggctccagagccgcaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccgactcggaccgatg

SEQ ID NO: 1572 - DNA, 203 bp, Homo sapiens
  source 1..203: mol_type = other DNA
ggcgcgccagtcctggaggcgtcggggctgcgccgtacaacttccggctgtaaagatggcggcttcctagtgagtcggcggctgatttagaaggaggttcaggctacggtgagccgaagccacacaggagccatggaagtggcagagcccagcagccccactgaagaggaggaggaggaagaggagcacgactcggaccgatg

SEQ ID NO: 1573 - DNA, 203 bp, Homo sapiens
  source 1..203: mol_type = other DNA
ggcgcgccagtccttcccgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaagcgactcggaccgatg

SEQ ID NO: 1574 - DNA, 203 bp, Homo sapiens
  source 1..203: mol_type = other DNA
ggcgcgccagtcctaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacacgactcggaccgatg

SEQ ID NO: 1575 - DNA, 203 bp, Homo sapiens
  source 1..203: mol_type = other DNA
ggcgcgccagtcctgagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtaatgtcgactcggaccgatg

SEQ ID NO: 1576 - DNA, 203 bp, Homo sapiens
  source 1..203: mol_type = other DNA
ggcgcgccagtcctgtgaccccaggccctggtcactccatgctttggagggtgcttttgtcaaagaggcctcctttccctcacccagagctggatttccaagaggctcccatacctagctgccctggcagactcccagggaggaaaaacagcgtggccttggcagctgccccgaggaaggagcccacacgactcggaccgatg

SEQ ID NO: 1577 - DNA, 203 bp, Homo sapiens
  source 1..203: mol_type = other DNA
ggcgcgccagtcctcctctcggcgccgccgcagtgcgcagaacagctctggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccacgactcggaccgatg

SEQ ID NO: 1578 - DNA, 203 bp, Homo sapiens
  source 1..203: mol_type = other DNA
ggcgcgccagtcctcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctccgactcggaccgatg

SEQ ID NO: 1579 - DNA, 203 bp, Homo sapiens
  source 1..203: mol_type = other DNA
ggcgcgccagtcctagtgtgctctacgtggggcggggctcaggtgcggacgccgccggttgtcctcttcgctgctccgtagtgacggggattgttgtgttgcagaaatccggcaatcgacctgaggacttgcgagccgctcagctcccgggacgtttggagctgctgctaaataatttctgctcagcccgactcggaccgatg

SEQ ID NO: 1580 - DNA, 203 bp, Homo sapiens
  source 1..203: mol_type = other DNA
ggcgcgccagtcctcccgggacgtttggtgcgtcttctaagggcgtgggcgagtttacgcgggccagttgttgctggtcgcatgggagctgctgctaaataatttctgctcagccatgtcgccggctccagatgcagccccggctcctgcgtcgatctccctgtttgacctcagcgcggatgctccggcgactcggaccgatg

SEQ ID NO: 1581 - DNA, 203 bp, Homo sapiens
  source 1..203: mol_type = other DNA
ggcgcgccagtcctagttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacgactcggaccgatg

SEQ ID NO: 1582 - DNA, 203 bp, Homo sapiens
  source 1..203: mol_type = other DNA
ggcgcgccagtcctccctcccctcccgctctgtgccccgccgggcggggaccgtgggagccgcggacaagcccaaggccggagcggttccaggaggaccctggtctgcacctgtggttgccaggtaggtggatgtgagagaccctacccttctggttctctagaagccatcccatcgccgctagcatccgactcggaccgatg

SEQ ID NO: 1583 - DNA, 203 bp, Homo sapiens
  source 1..203: mol_type = other DNA
ggcgcgccagtcctcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgacccgactcggaccgatg

SEQ ID NO: 1584 - DNA, 203 bp, Homo sapiens
  source 1..203: mol_type = other DNA
ggcgcgccagtcctcgcagcaggcggctggggcggcggctggggcagcggctgcagcagcggcggacgctctgcattacccagtcttgcgtcctcggcaggcgcccgaagctgagtgcgcatcctctaccgcacccaagcttcgtctgtctcgtcaagctcttcatgctgcccaactaaaaggaaaaccgactcggaccgatg

SEQ ID NO: 1585 - DNA, 203 bp, Homo sapiens
  source 1..203: mol_type = other DNA
ggcgcgccagtcctggggcgtgctcgcggctataaggggcggaggctgggcggcgttgctctgcgctctgcggctgacggcgcttttgtctccgggtccagaggcctttcagaaggagaaggcagctctgtttctctgcagaggagtagggtcctttcagccatgaagcatgtgttgaacctctacctcgactcggaccgatg

SEQ ID NO: 1586 - DNA, 203 bp, Homo sapiens
  source 1..203: mol_type = other DNA
ggcgcgccagtcctcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatccgactcggaccgatg

SEQ ID NO: 1587 - DNA, 203 bp, Homo sapiens
  source 1..203: mol_type = other DNA
ggcgcgccagtcctcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggacgactcggaccgatg

SEQ ID NO: 1588 - DNA, 203 bp, Homo sapiens
  source 1..203: mol_type = other DNA
ggcgcgccagtcctctcacaatggcttgggtccagactgcgccacagcctctcgggagacgtgggccctcggaacctttttagtgccggactccgggccgcaggcagtcccgcggcagcaggatcacaggtggcagggactcagctcggaattctgtatagaaaaagcacctggatcccagtctttcacgactcggaccgatg

SEQ ID NO: 1589 - DNA, 203 bp, Homo sapiens
  source 1..203: mol_type = other DNA
ggcgcgccagtcctctgctgggtgactcgggtccaggtgcctcaccacctgctgagctctgtgtgatttctggacacttctgctcgttgcctttgggctcagtgaagagtctggagtttatctggagtgaggtggccggttcttggtgggatctgagcaggacagcgtctggctccttccctcggctccgactcggaccgatg

SEQ ID NO: 1590 - DNA, 203 bp, Homo sapiens
  source 1..203: mol_type = other DNA
ggcgcgccagtcctatggagaacgttgataattctctggatggcagtgatgtgtcagaaccagcaaaaccagaagccggacttgaagtggctcagtcgatcctgagtaagttctctatgaaatccctatttgggtttacgagtaaattagaatctgtgaatccagaagaggaagatgctgtgctgaaacgactcggaccgatg

SEQ ID NO: 1591 - DNA, 203 bp, Homo sapiens
  source 1..203: mol_type = other DNA
ggcgcgccagtcctcgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccacccgactcggaccgatg

SEQ ID NO: 1592 - DNA, 203 bp, Homo sapiens
  source 1..203: mol_type = other DNA
ggcgcgccagtcctcccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacacgactcggaccgatg

SEQ ID NO: 1593 - DNA, 203 bp, Homo sapiens
  source 1..203: mol_type = other DNA
ggcgcgccagtcctcccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatcgactcggaccgatg

SEQ ID NO: 1594 - DNA, 203 bp, Homo sapiens
  source 1..203: mol_type = other DNA
ggcgcgccagtcctccacaactggagcagccgggaacagctctgaccacagtggttccggggagaagcctttccaggacccatgtgtaggcacaactgttttccctgatcaggatacttgcggcactcaacagaggaaagaaattcctaagggaacactgctcagaaagtactgcagcatgtcttcaacgactcggaccgatg

SEQ ID NO: 1595 - DNA, 203 bp, Homo sapiens
  source 1..203: mol_type = other DNA
ggcgcgccagtcctgggtacaaatgtattttggatcaaagaaactccagtattcaaagataggaactgacaggattttaggtcactttgtaggtcaccacctagaggggaggaagacctcgctttggagagtgggaataaaacgctcgtggaaaagggtacacgcttttctgggaaagtgaggccacccgactcggaccgatg

SEQ ID NO: 1596 - DNA, 203 bp, Homo sapiens
  source 1..203: mol_type = other DNA
ggcgcgccagtcctccccgcgctgcgtgcccacgttgcgccggcctcgcgccagtccgctgggctgcagggactgcggcgcctgagggagtcgctgacgggcacgctgactggaggctggcggacaggcgacagcgacctgcggcaggaccagaggagcgagagcagcaagaaccacacccagcagcacgactcggaccgatg

SEQ ID NO: 1597 - DNA, 203 bp, Homo sapiens
  source 1..203: mol_type = other DNA
ggcgcgccagtcctagcgacctgcggcagagtcttgctgcgacacccaggctggagtgcaatggcgctatctcggctcactgcaacctccgcttcccggattcaagcgattctcctgcctcagcctcccgagtaggtgggactacaggaccagaggagcgagagcagcaagaaccacacccagcagcacgactcggaccgatg

SEQ ID NO: 1598 - DNA, 203 bp, Homo sapiens
  source 1..203: mol_type = other DNA
ggcgcgccagtcctaggcgcgggcggagggcgggctgaagcagctgaagcggcggtagcggcggcggctcgggcagaggggcgggagctgaggcgggagcggacaggctggtgggcgagcgagaggcggcggaatggtggactaccacgcggcgaaccagtcgtaccagtacggccccagcagcgcggcgactcggaccgatg

SEQ ID NO: 1599 - DNA, 203 bp, Homo sapiens
  source 1..203: mol_type = other DNA
ggcgcgccagtcctcttctcagatcctttgcgggtagccctggcgtcccgcggagaccccaccccctggctacctgagtgaagatggagaaaccagtgaccaccagatgaaccacagcatggacgcaggttctccaaacctatccccgaatccgatgtccccagcacataataacttggacctgcagccgactcggaccgatg

SEQ ID NO: 1600 - DNA, 203 bp, Homo sapiens
  source 1..203: mol_type = other DNA
ggcgcgccagtcctacaaacatgtcttgcctgcaccctaggcaaacgtggaaaggcgcagctctggtacaccggaaagcatggtggatggggaggtccctggatggccggttgcaggtgtcccatcggaaggggctccctcatgtcatctactgccgcctgtggcgatggccagacctgcacagccaccgactcggaccgatg

SEQ ID NO: 1601 - DNA, 203 bp, Homo sapiens
  source 1..203: mol_type = other DNA
ggcgcgccagtccttaagagccgcggagtcggggacggtagaaggggccgcgcgtgcgcagtggcgtccgctgtgcttccggtgcgccgggcgcggacgcgggcacgcacacacgcaagcacgcctccacttaactcgcgccgccgcggcagctcgagtccaccagcagcgccgtccgcttgaccgagcgactcggaccgatg

SEQ ID NO: 1602 - DNA, 203 bp, Homo sapiens
  source 1..203: mol_type = other DNA
ggcgcgccagtcctggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtcgactcggaccgatg

SEQ ID NO: 1603 - DNA, 203 bp, Homo sapiens
  source 1..203: mol_type = other DNA
ggcgcgccagtcctaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgcccgactcggaccgatg

SEQ ID NO: 1604 - DNA, 203 bp, Homo sapiens
  source 1..203: mol_type = other DNA
ggcgcgccagtccttagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggccgactcggaccgatg

SEQ ID NO: 1605 - DNA, 203 bp, Homo sapiens
  source 1..203: mol_type = other DNA
ggcgcgccagtcctgggccactgctctccaggaagataaggcttttaaagcagcctagcactagaaggtgaggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 1606 - DNA, 203 bp, Homo sapiens
  source 1..203: mol_type = other DNA
ggcgcgccagtcctcctgctgctgctcgctgttcggcccggggcggggacacggccgcggacgtccttgtgggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 1607 - DNA, 203 bp, Homo sapiens
  source 1..203: mol_type = other DNA
ggcgcgccagtcctgcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 1608 - DNA, 203 bp, Homo sapiens
  source 1..203: mol_type = other DNA
ggcgcgccagtcctataggccccgcccctgtatcccaagaccctgcctcctcttgcggtggggggaaagcggcctcttactctaggcctttcggtttgcgcgagcgggcaggaaagcgtgcgtgcggctaagagagtgggcgctctcgcggccgctgacgatggaagaactggagcaaggcctgttgacgactcggaccgatg

SEQ ID NO: 1609 - DNA, 203 bp, Homo sapiens
  source 1..203: mol_type = other DNA
ggcgcgccagtcctaaaggaagaccaggttcctgaaagggttattctgacttaatctggctataaaaatgctattggctgttatttggcatggccaaagtgcacccagaatgtcttctctctccattcagtgcacgcgttactttggctaaaaggaggtgagcggcactctgcccttccagagcaagccgactcggaccgatg

SEQ ID NO: 1610 - DNA, 203 bp, Homo sapiens
  source 1..203: mol_type = other DNA
ggcgcgccagtccttcgggagctcggactcctacgcagtcaccgggaagggccgccgccccgcccgcggctgctggcccgggtgacgcttccgcctgctataagagcagcggccctcggtgcctccttcctgacctcgcacccagctcggagcccggagcgtgcctcggcggcctgtcggttttcacccgactcggaccgatg

SEQ ID NO: 1611 - DNA, 203 bp, Homo sapiens
  source 1..203: mol_type = other DNA
ggcgcgccagtcctgctggagctctgcccgggtgtggaaacctcgtcttccaacacgtagctgcccttcagccacccgcccgcagcctgggagtgccctgagggtgggtcgggggagctgcgcagggacatctctacaccgttcccatccgggaacagggcaacatctacaagcccaacaacaaggcccgactcggaccgatg

SEQ ID NO: 1612 - DNA, 203 bp, Homo sapiens
  source 1..203: mol_type = other DNA
ggcgcgccagtcctttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggcccgactcggaccgatg

SEQ ID NO: 1613 - DNA, 203 bp, Homo sapiens
  source 1..203: mol_type = other DNA
ggcgcgccagtcctttagcctcccgcccgccgcctctgtctccctctctccacaaactgcccaggagtgagtagctgctttgggtccgccggacacaccggacagatagacgtgcggacggcccaccaccccagcccgccaactagtcagcctgcgcctggcgcctcccctctccaggtccatccgcccgactcggaccgatg

SEQ ID NO: 1614 - DNA, 203 bp, Homo sapiens
  source 1..203: mol_type = other DNA
ggcgcgccagtcctactttactgcaagccttagtcagagtacaaagggttcctgcttggtggttttgctgcagcttcagagtttagcctgaactgtggcaggattttgtaacttgcacattttttgagaagtctgatggaggtataatgtccacggtcgattatttgaacagtgtttctggagatcatcgactcggaccgatg

SEQ ID NO: 1615 - DNA, 203 bp, Homo sapiens
  source 1..203: mol_type = other DNA
ggcgcgccagtcctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtcgactcggaccgatg

SEQ ID NO: 1616 - DNA, 203 bp, Homo sapiens
  source 1..203: mol_type = other DNA
ggcgcgccagtcctaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatcgactcggaccgatg

SEQ ID NO: 1617 - DNA, 203 bp, Homo sapiens
  source 1..203: mol_type = other DNA
ggcgcgccagtccttaaggtccacaccccgggagctgagtgattgcagaaactggccttccatctctctcagacaccaagctgcagatccaggtcaccacctagaggggaggaagacctcgctttggagagtgggaataaaacgctcgtggaaaagggtacacgcttttctgggaaagtgaggccacccgactcggaccgatg

SEQ ID NO: 1618 - DNA, 203 bp, Homo sapiens
  source 1..203: mol_type = other DNA
ggcgcgccagtcctaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgcgactcggaccgatg

SEQ ID NO: 1619 - DNA, 203 bp, Homo sapiens
  source 1..203: mol_type = other DNA
ggcgcgccagtcctcccgggagctgagtgattgcagaaactggccttccatctctctcagacaccaagctgcagatccaggtcactttgtaggtcaccacctagaggggaggaagacctcgctttggagagtgggaataaaacgctcgtggaaaagggtacacgcttttctgggaaagtgaggccacccgactcggaccgatg

SEQ ID NO: 1620 - DNA, 203 bp, Homo sapiens
  source 1..203: mol_type = other DNA
ggcgcgccagtcctaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaacgactcggaccgatg

SEQ ID NO: 1621 - DNA, 203 bp, Homo sapiens
  source 1..203: mol_type = other DNA
ggcgcgccagtcctacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgaccgactcggaccgatg

SEQ ID NO: 1622 - DNA, 203 bp, Homo sapiens
  source 1..203: mol_type = other DNA
ggcgcgccagtcctttcaagtctttttcttttaacggattgatcttttgctagatagagacaaaatatcagtgtgaattacagcaaacccctattccatgctgttatgggtgaaactctgggagattctcctattgacccagaaagcgattccttcactgatacactgtctgcaaacatatcacaagacgactcggaccgatg

SEQ ID NO: 1623 - DNA, 203 bp, Homo sapiens
  source 1..203: mol_type = other DNA
ggcgcgccagtcctatatatttcgagactaaagaacccaggaacccaagaagactccttgaccacaacaaagatggcgaaatctgcctgttgctcgtgctagattgaggttacgtagattggcgtgctgcaaaccagctctaggcggctctggccccaaaaggagcataaaccagggactttgatatccgactcggaccgatg

SEQ ID NO: 1624 - DNA, 203 bp, Homo sapiens
  source 1..203: mol_type = other DNA
ggcgcgccagtcctgatctcagctcactgcagcctccgcctcccgggttcaagcgattcttctgcctcagcctcccgagtagcagattatgagcttacagaaagcctggcctacattttactctttttggatttcttcctcatcaagagactgctgcagtgcctgtcatgtgacagcggcatggacatcgactcggaccgatg

SEQ ID NO: 1625 - DNA, 203 bp, Homo sapiens
  source 1..203: mol_type = other DNA
ggcgcgccagtcctgattcacagggcctctgagcattatcccccatactcctccccatcattctccacccagctgttggagccatctgtctgatcaccttggactccatagtacactggggcaaagcacagccccagtttctggaggcagatgggtaaccaggaaaaggcatgaatgagggggccccacgactcggaccgatg

SEQ ID NO: 1626 - DNA, 203 bp, Homo sapiens
  source 1..203: mol_type = other DNA
ggcgcgccagtcctgaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaacgactcggaccgatg

SEQ ID NO: 1627 - DNA, 203 bp, Homo sapiens
  source 1..203: mol_type = other DNA
ggcgcgccagtccttaggtgcgtgcgacgacctgggacgctggaaacccggagctgcgcgctgggcggaaaggactcctagtgggcccggctgagaaggcggaggtggcgcgcgaggggcgggctcgtgccaacgctggtgggtggggctagaacgggaggggcggggctagccggatccgctgactgcgactcggaccgatg

SEQ ID NO: 1628 - DNA, 203 bp, Homo sapiens
  source 1..203: mol_type = other DNA
ggcgcgccagtcctcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgcgactcggaccgatg

SEQ ID NO: 1629 - DNA, 203 bp, Homo sapiens
  source 1..203: mol_type = other DNA
ggcgcgccagtccttttaaatggcagagagaaggagaaaacttagatcttctgataccaaatcactggaccttagaaggtcagaaatctttcaagccctgcaggaccgtaaaatgcgcatgtgtccaacggaagcactggggcatgagtggggaaggaatagaaacagaaagaggttgatattcactgcgactcggaccgatg

SEQ ID NO: 1630 - DNA, 203 bp, Homo sapiens
  source 1..203: mol_type = other DNA
ggcgcgccagtcctgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaacgactcggaccgatg

SEQ ID NO: 1631 - DNA, 203 bp, Homo sapiens
  source 1..203: mol_type = other DNA
ggcgcgccagtcctcaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagccgactcggaccgatg

SEQ ID NO: 1632 - DNA, 203 bp, Homo sapiens
  source 1..203: mol_type = other DNA
ggcgcgccagtcctattcagcaaatgtttgcggaatgaatggggtgagctggagccaggacctgcaggaagggatctccgcctggttcggcccgcctgcctccactcctgcctctaccatgtccatcagggtgacccagaagtcctacaaggtgtccacctctggcccccgggccttcagcagccgctcgactcggaccgatg

SEQ ID NO: 1633 - DNA, 203 bp, Homo sapiens
  source 1..203: mol_type = other DNA
ggcgcgccagtcctggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggcgactcggaccgatg

SEQ ID NO: 1634 - DNA, 203 bp, Homo sapiens
  source 1..203: mol_type = other DNA
ggcgcgccagtcctttctccagaacaagcctcctggtctttctgggagagctctggcagcatcactgtgcctgtgcagggagagcgggaacccacttcctgcaccggctttctctgagttcttcaggatgaattcgctctggtctagcggagctggagtttgttcagatcatcatcatcgtggtggtgcgactcggaccgatg

SEQ ID NO: 1635 - DNA, 203 bp, Homo sapiens
  source 1..203: mol_type = other DNA
ggcgcgccagtcctaaatgatcaagtgttgggtataagccaaggagctgagagagggggagaccagcgcaggtctgaggagctgagaagggaggcttacgtgaagggaatttagataatgggctgtgtgcaatgtaaggataaagaagcaacaaaactgacggaggagagggacggcagcctgaaccacgactcggaccgatg

SEQ ID NO: 1636 - DNA, 203 bp, Homo sapiens
  source 1..203: mol_type = other DNA
ggcgcgccagtcctgggcgtgtctacgcgagttcccgtctttcctggtcgtcctccttgggttcgggtgaaagcgcttgggggttcagtgggccatgatccccgagctgctggagaactgaaggcggacagtctcctgcgaaaccagcggagctggagtttgttcagatcatcatcatcgtggtggtgcgactcggaccgatg

SEQ ID NO: 1637 - DNA, 203 bp, Homo sapiens
  source 1..203: mol_type = other DNA
ggcgcgccagtcctgcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagcgactcggaccgatg

SEQ ID NO: 1638 - DNA, 203 bp, Homo sapiens
  source 1..203: mol_type = other DNA
ggcgcgccagtcctgaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcgactcggaccgatg

SEQ ID NO: 1639 - DNA, 203 bp, Homo sapiens
  source 1..203: mol_type = other DNA
ggcgcgccagtcctaccctctacacccgccatagcaatggagaccccgcctcctgctacagttaattaatccttcttttttgcttcacaataaaaatagcatggctcttctgattgtaaaaagtgatatacactccttatttaacgaaaaattcaaagaatttgataaatgacaggcgaaaagtcaaacgactcggaccgatg

SEQ ID NO: 1640 - DNA, 203 bp, Homo sapiens
  source 1..203: mol_type = other DNA
ggcgcgccagtcctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcacccgactcggaccgatg

SEQ ID NO: 1641 - DNA, 203 bp, Homo sapiens
  source 1..203: mol_type = other DNA
ggcgcgccagtcctaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagccccgactcggaccgatg

SEQ ID NO: 1642 - DNA, 203 bp, Homo sapiens
  source 1..203: mol_type = other DNA
ggcgcgccagtccttccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccacgactcggaccgatg

SEQ ID NO: 1643 - DNA, 203 bp, Homo sapiens
  source 1..203: mol_type = other DNA
ggcgcgccagtcctcaatctccgcctctgattggctgagcccccggctccccgctccccctctcctccatccccggtgaaaactgcgggctccgagctgggtgcagcaaccggaggcggcggcgcgtctggaggaggctgcagcagcggaagaccccagtccagatccaggactgagatcccagaacccgactcggaccgatg

SEQ ID NO: 1644 - DNA, 203 bp, Homo sapiens
  source 1..203: mol_type = other DNA
ggcgcgccagtcctatgctgtccacttcctctgtaaagctctcaaccctgtccccttccccctctctcctgggaaagagccctcccatgcctagctgctgctcttagggaccctgtggctaggtgcgcggatggaaatccaggatctccgcctggttcggcccgcctgcctccactcctgcctctacccgactcggaccgatg

SEQ ID NO: 1645 - DNA, 203 bp, Homo sapiens
  source 1..203: mol_type = other DNA
ggcgcgccagtcctgcagcctcgagggccaacaacacctgctgtccgtgtccatgcccggttggccaccccgtttctgggggcatgagcttcaccactcgctccaccttctccaccaactaccggtccctgggctctgtccaggcgcccagctacggcgcccggccggtcagcagcgcggccagcgtccgactcggaccgatg

SEQ ID NO: 1646 - DNA, 203 bp, Homo sapiens
  source 1..203: mol_type = other DNA
ggcgcgccagtcctagtgcttctgcggcaggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcacccgactcggaccgatg

SEQ ID NO: 1647 - DNA, 203 bp, Homo sapiens
  source 1..203: mol_type = other DNA
ggcgcgccagtcctctggttcctaggcctcctctccctgctggcagatgggaacaggttcttcttgaggaaactgaggcaaagaggagggcaggtctgagggaccccgcttgggctggcctcacccgcacactgggagggcagccaggtggggactctgacctgggggcttctggaggagaggatgagcgactcggaccgatg

SEQ ID NO: 1648 - DNA, 203 bp, Homo sapiens
  source 1..203: mol_type = other DNA
ggcgcgccagtcctgtggcagtgggcgcagggcggggcgagctcagcggagggcgggtttgaatgtgccccggcgggagagggaagctgcagcgagagcgcgcggatctcagcgcgggagcagtgcttctgcggcaggcccctgagggagggagctgtcagccagggaaaaccgagaacaccatcacccgactcggaccgatg

SEQ ID NO: 1649 - DNA, 203 bp, Homo sapiens
  source 1..203: mol_type = other DNA
ggcgcgccagtcctcactcctgtgtttgacctgaagtcctctcgagctgcagaagcctgaagaccaaggagtggaaagttctccggcagccctgagatctcaagagtgacatttgtgagaccagctaatttgattaaaattctcttggaatcagctttgctagtatcatacctgtgccagatttcatccgactcggaccgatg

SEQ ID NO: 1650 - DNA, 203 bp, Homo sapiens
  source 1..203: mol_type = other DNA
ggcgcgccagtcctgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagcgactcggaccgatg

SEQ ID NO: 1651 - DNA, 203 bp, Homo sapiens
  source 1..203: mol_type = other DNA
ggcgcgccagtcctagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtgacagtgatgtgtgttctgaaattgtgaacccgactcggaccgatg

SEQ ID NO: 1652 - DNA, 203 bp, Homo sapiens
  source 1..203: mol_type = other DNA
ggcgcgccagtcctcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtccaacgagcgctcctccaagcggagcccgactcggaccgatg

SEQ ID NO: 1653 - DNA, 203 bp, Homo sapiens
  source 1..203: mol_type = other DNA
ggcgcgccagtcctacggggacgagcaggagcgctctcgacttttctagagcctcagcgtcctaggactcacctttccctgatcctgcaccgtccctctcctggccccagactctccctcccactgttcacgaagcccaggtacccactgatggtaatgctggcctgctggctgaaccccagattgcccgactcggaccgatg

SEQ ID NO: 1654 - DNA, 203 bp, Homo sapiens
  source 1..203: mol_type = other DNA
ggcgcgccagtcctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgcgactcggaccgatg

SEQ ID NO: 1655 - DNA, 203 bp, Homo sapiens
  source 1..203: mol_type = other DNA
ggcgcgccagtcctgacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaacgactcggaccgatg

SEQ ID NO: 1656 - DNA, 203 bp, Homo sapiens
  source 1..203: mol_type = other DNA
ggcgcgccagtccttcaccacggcggcagccctttaaacccctcacccagccagcgccccatcctgtctgtccgaacccagacacaagtcttcactccttcctgcgagccctgaggaagccttctttccccagacatggccaacaagggtccttcctatggcatgagccgcgaagtgcagtccaaaatcgactcggaccgatg

SEQ ID NO: 1657 - DNA, 203 bp, Homo sapiens
  source 1..203: mol_type = other DNA
ggcgcgccagtcctgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgccgactcggaccgatg

SEQ ID NO: 1658 - DNA, 203 bp, Homo sapiens
  source 1..203: mol_type = other DNA
ggcgcgccagtccttgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggagctttccccagaccgactcggaccgatg

SEQ ID NO: 1659 - DNA, 203 bp, Homo sapiens
  source 1..203: mol_type = other DNA
ggcgcgccagtcctcaccctgggaccggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagccgactcggaccgatg

SEQ ID NO: 1660 - DNA, 203 bp, Homo sapiens
  source 1..203: mol_type = other DNA
ggcgcgccagtcctcatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaacgactcggaccgatg

SEQ ID NO: 1661 - DNA, 203 bp, Homo sapiens
  source 1..203: mol_type = other DNA
ggcgcgccagtcctcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagccgactcggaccgatg

SEQ ID NO: 1662 - DNA, 203 bp, Homo sapiens
  source 1..203: mol_type = other DNA
ggcgcgccagtcctgtctgagcagacggggaggcttttccaaacccaggcagcttcgtggcgtgtgcggtttcgacccggtcacacaaagcttcagcatgtcatgtggtaggtgaggccggcgcctgtaggctggcggtttccttcctcttggtctttgtagagacagtttgcagaacagcggagaaacgactcggaccgatg

SEQ ID NO: 1663 - DNA, 203 bp, Homo sapiens
  source 1..203: mol_type = other DNA
ggcgcgccagtcctgagtatttgaggctcggagccaccgccccgccggcgcccgcagcacctcctcgccagcagccgtccggagccagccaacgagcggaaaatggcagacaatttttcgctccatgatgcgttatctgggtctggaaacccaaaccctcaaggatggcctggcgcatgggggaaccacgactcggaccgatg

SEQ ID NO: 1664 - DNA, 203 bp, Homo sapiens
  source 1..203: mol_type = other DNA
ggcgcgccagtcctgactgagagcagggagcagcaggcatggggcatgccgggtgccagttcaaagccctgctgtggaagaattggctctgcagactcaggaacccggtccttttccttgctgaattcttctggccttgtatcctgtttgtaattctgacagttcttcgttttcaagaacctcccagacgactcggaccgatg

SEQ ID NO: 1665 - DNA, 203 bp, Homo sapiens
  source 1..203: mol_type = other DNA
ggcgcgccagtcctctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgcgactcggaccgatg

SEQ ID NO: 1666 - DNA, 203 bp, Homo sapiens
  source 1..203: mol_type = other DNA
ggcgcgccagtcctggagtctcactgtgttgcccaggctggagtgcagtggcgccatcttggctcactgcagtgcgcctctgccccccgagttcaagcgattctcctgcctcaggctcctgagtagctgggactacaggtcatcatcagatttgaaatatttaaagtggatacaaaactatttcagcacgactcggaccgatg

SEQ ID NO: 1667 - DNA, 203 bp, Homo sapiens
  source 1..203: mol_type = other DNA
ggcgcgccagtcctgccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgaccgactcggaccgatg

SEQ ID NO: 1668 - DNA, 203 bp, Homo sapiens
  source 1..203: mol_type = other DNA
ggcgcgccagtcctccgctgagctgctctgttcccggcttagaggaccaggagaagggggagctggaggctggagcctgtaacaccgtggctcgtctcactctggatggtggtggcaacagagatggcagcgcagctggagtgttaggagggcggcctgagcggtaggagtggggctggagcagtaagcgactcggaccgatg

SEQ ID NO: 1669 - DNA, 203 bp, Homo sapiens
  source 1..203: mol_type = other DNA
ggcgcgccagtcctaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggcgactcggaccgatg

SEQ ID NO: 1670 - DNA, 203 bp, Homo sapiens
  source 1..203: mol_type = other DNA
ggcgcgccagtcctctcactctcctggaaacccaccgagaacctccaccctctgacaccatggtcaactcctgttgtggctctgtgtgctctgaccagggctgtggcctggagaactgctgccgccccagctgctgccagaccacctgctgcaggaccacctgctgccgccccagctgctgtgtgtcccgactcggaccgatg

SEQ ID NO: 1671 - DNA, 203 bp, Homo sapiens
  source 1..203: mol_type = other DNA
ggcgcgccagtcctggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccagaagcgactcggaccgatg

SEQ ID NO: 1672 - DNA, 203 bp, Homo sapiens
  source 1..203: mol_type = other DNA
ggcgcgccagtcctgccaggctccacgtcaaatccagtttgaaacacagaccctaggaccacgcaggaggtggtgggctcgcaggaaggttcctctcccagtggccatgggtagcaacagtgggcaggctggccgccacatctataaatccctagctgatgatggcccctttgactctgtggagccgccgactcggaccgatg

SEQ ID NO: 1673 - DNA, 203 bp, Homo sapiens
  source 1..203: mol_type = other DNA
ggcgcgccagtcctgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtggaaaccgcggcccgactcggaccgatg

SEQ ID NO: 1674 - DNA, 203 bp, Homo sapiens
  source 1..203: mol_type = other DNA
ggcgcgccagtcctgaagagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgcccgactcggaccgatg

SEQ ID NO: 1675 - DNA, 203 bp, Homo sapiens
  source 1..203: mol_type = other DNA
ggcgcgccagtcctctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagacgactcggaccgatg

SEQ ID NO: 1676 - DNA, 203 bp, Homo sapiens
  source 1..203: mol_type = other DNA
ggcgcgccagtcctcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatccgactcggaccgatg

SEQ ID NO: 1677 - DNA, 203 bp, Homo sapiens
  source 1..203: mol_type = other DNA
ggcgcgccagtccttgcagaggatccagtccagatcccaggagagcccctctgccccttcggacctcgtctcccatctacaaaacgtgaagattggcccagttagcgtgtctctacaaaaaggtgcatataccactgccccgctgcaggctgatctgagaaagcctctggcccagggcagataccgcccgactcggaccgatg

SEQ ID NO: 1678 - DNA, 203 bp, Homo sapiens
  source 1..203: mol_type = other DNA
ggcgcgccagtcctaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactcgactcggaccgatg

SEQ ID NO: 1679 - DNA, 203 bp, Homo sapiens
  source 1..203: mol_type = other DNA
ggcgcgccagtcctagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggcgactcggaccgatg

SEQ ID NO: 1680 - DNA, 203 bp, Homo sapiens
  source 1..203: mol_type = other DNA
ggcgcgccagtcctgcactccgctcctttcctgcgtcaccgctacacatgcgccttgcaaggaagggcgagatttcgggggcagggcggggggcgggcctaggccggggtctcacagcgactgcgcggacgggttcctgagtggaacatggcgacttgcgccgaaatcctgcggagcgagttccccgacgactcggaccgatg

SEQ ID NO: 1681 - DNA, 203 bp, Homo sapiens
  source 1..203: mol_type = other DNA
ggcgcgccagtcctcaccaggctgagctaagcagggccgccttgggcaggcctacgtggtggtgcaggcgagacccaggctgggcaaggcgcagtttcagtttccatcttgggtctctgagctgagcagagtggcaccaggctgagttaagtgggactgccctgggcagacctacctactagagcagacgactcggaccgatg

SEQ ID NO: 1682 - DNA, 203 bp, Homo sapiens
  source 1..203: mol_type = other DNA
ggcgcgccagtcctggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagatttgagtcgactcggaccgatg

SEQ ID NO: 1683 - DNA, 203 bp, Homo sapiens
  source 1..203: mol_type = other DNA
ggcgcgccagtcctccctgcgtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattcgactcggaccgatg

SEQ ID NO: 1684 - DNA, 203 bp, Homo sapiens
  source 1..203: mol_type = other DNA
ggcgcgccagtcctgctgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcgactcggaccgatg

SEQ ID NO: 1685 - DNA, 203 bp, Homo sapiens
  source 1..203: mol_type = other DNA
ggcgcgccagtcctggttgggatctgaggggtcctctctgtgcccatcacagtttgagcttcagggaaaagaagaagaggtctttgcccttcgtttttccacgggaggagaatcaagagtgagccatggagctacgtgtggggaacaagtaccgcctgggacggaagatcgggagcgggtccttcggacgactcggaccgatg

SEQ ID NO: 1686 - DNA, 203 bp, Homo sapiens
  source 1..203: mol_type = other DNA
ggcgcgccagtcctccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctcgactcggaccgatg

SEQ ID NO: 1687 - DNA, 203 bp, Homo sapiens
  source 1..203: mol_type = other DNA
ggcgcgccagtcctgaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaaccgactcggaccgatg

SEQ ID NO: 1688 - DNA, 203 bp, Homo sapiens
  source 1..203: mol_type = other DNA
ggcgcgccagtcctccagcgaccgcggcaccgcctgtgcccgcccgcccctccgcagccgctacttaagaggctccagcgccggccccgccctagtgcgttacttacctcgactcttagcttgtcggggacggtaaccgggacccggtgtctgctcctgtcgccttcgcctcctaatccctagccactcgactcggaccgatg

SEQ ID NO: 1689 - DNA, 203 bp, Homo sapiens
  source 1..203: mol_type = other DNA
ggcgcgccagtcctctccgcactgcaccccgacccaccccgcaccctccctttctgcaccctcgcacccacacccctcgcggttccagggggcggcggccccgggcggagcgctttcgcgtgcagccaccactccagaagacttaatgaagtagccagctgcagaagaatctggatcattagataaaacgactcggaccgatg

SEQ ID NO: 1690 - DNA, 203 bp, Homo sapiens
  source 1..203: mol_type = other DNA
ggcgcgccagtcctccgccgcccgccctcgctctctcgcgctaccctcccgccgcccgcggtcctccgtcggttctctcgttagtccacggtctggtcttcagctacccgccttcgtctccgagtttgcgactcggggaccggcgtccccggcgcgaagaggctggactcggattcgttgcctgagcacgactcggaccgatg

SEQ ID NO: 1691 - DNA, 203 bp, Homo sapiens
  source 1..203: mol_type = other DNA
ggcgcgccagtcctctccccgcctccttttcgggcgtcccgaggccgctccccaaccgacaaccaagaccccgcaggccacgcagccctggagccgaggccccccgacggcggaggcgcccgcgggtcccctacagccaaggtccctgagtgccagaggtggtggtgttgcttatcttctggaacccccgactcggaccgatg

SEQ ID NO: 1692 - DNA, 203 bp, Homo sapiens
  source 1..203: mol_type = other DNA
ggcgcgccagtcctgcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacacgactcggaccgatg

SEQ ID NO: 1693 - DNA, 203 bp, Homo sapiens
  source 1..203: mol_type = other DNA
ggcgcgccagtcctacgttcctgccgggcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcgactcggaccgatg

SEQ ID NO: 1694 - DNA, 203 bp, Homo sapiens
  source 1..203: mol_type = other DNA
ggcgcgccagtccttggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccacccgactcggaccgatg

SEQ ID NO: 1695 - DNA, 203 bp, Homo sapiens
  source 1..203: mol_type = other DNA
ggcgcgccagtcctccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcgactcggaccgatg

SEQ ID NO: 1696 - DNA, 203 bp, Homo sapiens
  source 1..203: mol_type = other DNA
ggcgcgccagtcctgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgactcggaccgatg

SEQ ID NO: 1697 - DNA, 203 bp, Homo sapiens
  source 1..203: mol_type = other DNA
ggcgcgccagtcctggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaacgactcggaccgatg

SEQ ID NO: 1698 - DNA, 203 bp, Homo sapiens
  source 1..203: mol_type = other DNA
ggcgcgccagtcctctggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacacgactcggaccgatg

SEQ ID NO: 1699 - DNA, 203 bp, Homo sapiens
  source 1..203: mol_type = other DNA
ggcgcgccagtcctgcagggcggggcctgagcactaggcggcggcggctggcgtggggctgcttagatgcgccacggtttcggtagcgacggtatctctagccgggcctgagctgtgctagcacctcccccaggagaccgttgcagtcggccagcccccttctccacggccttgcccactaggtaacccgactcggaccgatg

SEQ ID NO: 1700 - DNA, 203 bp, Homo sapiens
  source 1..203: mol_type = other DNA
ggcgcgccagtcctgagcggtcacgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattcgactcggaccgatg

SEQ ID NO: 1701 - DNA, 203 bp, Homo sapiens
  source 1..203: mol_type = other DNA
ggcgcgccagtcctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctgcgactcggaccgatg

SEQ ID NO: 1702 - DNA, 203 bp, Homo sapiens
  source 1..203: mol_type = other DNA
ggcgcgccagtcctgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggaccctgacgtggctgaagcggccccgggagccgactcggaccgatg

SEQ ID NO: 1703 - DNA, 203 bp, Homo sapiens
  source 1..203: mol_type = other DNA
ggcgcgccagtcctctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagaaaaaactatccaagcgactcggaccgatg

SEQ ID NO: 1704 - DNA, 203 bp, Homo sapiens
  source 1..203: mol_type = other DNA
ggcgcgccagtcctacggaaacgggcgtgccatttccgcgcacgtctgcagatgcggtagtcgattggtcaagtctcccatggctcctccttcatcaggaggtgggcaaaccgcgccatgatagggtcgggattggctggctctggaggcgcaggtggtccttcttctactgtcacatggtgcgcgctcgactcggaccgatg

SEQ ID NO: 1705 - DNA, 203 bp, Homo sapiens
  source 1..203: mol_type = other DNA
ggcgcgccagtcctaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgcctctctgctcctgtcttttgtttggcgactcggaccgatg

SEQ ID NO: 1706 - DNA, 203 bp, Homo sapiens
  source 1..203: mol_type = other DNA
ggcgcgccagtcctgggattggctggctctggaggcgcaggtggtccttcttctactgtcacatggtgcgcgctgttttctaatcacgtggctgccacccaggtaagaagaggccgctcttcctggggttgtttctccgtgtgacgtgtggcctttgagatcaactctcctgtaccagcgtaggccgccgactcggaccgatg

SEQ ID NO: 1707 - DNA, 203 bp, Homo sapiens
  source 1..203: mol_type = other DNA
ggcgcgccagtccttgggctcgcgcttccactccgccgcgccttcctcccagtttccgtccgctcgccgcaccggcttcgttcccccaaatctgggaccgtcccttcgcgccccctccccgtccgcccccagtgctgcgttctccccctcttggctctcctgcggctgggggaggggcgggggtcacccgactcggaccgatg

SEQ ID NO: 1708 - DNA, 203 bp, Homo sapiens
  source 1..203: mol_type = other DNA
ggcgcgccagtcctcagccggccctcggcgggacgtgacgcagcgcccggggcgcgggtttgatatttgacaaattgatctaaaatggctgggtttttatctgaataactcactgatgccatcccagaaagtcggcaccaggtgtatttgatatagtgtttgcaacaaattcgacccaggtgatcaaacgactcggaccgatg

SEQ ID NO: 1709 - DNA, 203 bp, Homo sapiens
  source 1..203: mol_type = other DNA
ggcgcgccagtcctccgagcgcccgccaggctcctcccgctcccgcgccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaacgactcggaccgatg

SEQ ID NO: 1710 - DNA, 203 bp, Homo sapiens
  source 1..203: mol_type = other DNA
ggcgcgccagtcctgcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggtcgactcggaccgatg

SEQ ID NO: 1711 - DNA, 203 bp, Homo sapiens
  source 1..203: mol_type = other DNA
ggcgcgccagtcctcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgcgggaccgggaggaggggagggggcgcgactcggaccgatg

SEQ ID NO: 1712 - DNA, 203 bp, Homo sapiens
  source 1..203: mol_type = other DNA
ggcgcgccagtcctgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgactcggaccgatg

SEQ ID NO: 1713 - DNA, 203 bp, Homo sapiens
  source 1..203: mol_type = other DNA
ggcgcgccagtcctaatggactctagcctcctctgatagcctcatgccaggccccgtgcacattgctttgcttgcctccctcaatcctcatagcttctctttgggaagcctttgggtctgaagtgtctgtgagacctcacagaagagcacccctgggctccacttacctgccccctgctccttcagggcgactcggaccgatg

SEQ ID NO: 1714 - DNA, 203 bp, Homo sapiens
  source 1..203: mol_type = other DNA
ggcgcgccagtcctgggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgcgactcggaccgatg

SEQ ID NO: 1715 - DNA, 203 bp, Homo sapiens
  source 1..203: mol_type = other DNA
ggcgcgccagtcctctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagcgactcggaccgatg

SEQ ID NO: 1716 - DNA, 203 bp, Homo sapiens
  source 1..203: mol_type = other DNA
ggcgcgccagtcctattggctgagcccggctgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacatcgactcggaccgatg

SEQ ID NO: 1717 - DNA, 203 bp, Homo sapiens
  source 1..203: mol_type = other DNA
ggcgcgccagtcctctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatgcgactcggaccgatg

SEQ ID NO: 1718 - DNA, 203 bp, Homo sapiens
  source 1..203: mol_type = other DNA
ggcgcgccagtcctgaactcgggttgcgcacttcccggcgctgggaacgcggagcggacgcagtctggccgccattgcgctgcggggaaagcggcctcttgtgtgagggcctgtgggattctccggatatggccggagtgtttccttatcgagggccgggtaacccggtgcctggccctctagccccgcgactcggaccgatg

SEQ ID NO: 1719 - DNA, 203 bp, Homo sapiens
  source 1..203: mol_type = other DNA
ggcgcgccagtcctggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtggatctaggatccggcttccaaccgactcggaccgatg

SEQ ID NO: 1720 - DNA, 203 bp, Homo sapiens
  source 1..203: mol_type = other DNA
ggcgcgccagtcctcgatgtcgcaccgcggcgtgcgcggtgtcggcagtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagcgactcggaccgatg

SEQ ID NO: 1721 - DNA, 203 bp, Homo sapiens
  source 1..203: mol_type = other DNA
ggcgcgccagtcctcagcaggggggaaaaaagagacaaaaacaaaacaaaaaacaacaaaaagcaacaccccccccttttattttcaaaagtagctagaggaaaaaaaaataaaacaacagccaaccaagtgaatcccaacccaaccccctgaagggctgaaaattctcgccttcttcagagcggggccgactcggaccgatg

SEQ ID NO: 1722 - DNA, 203 bp, Homo sapiens
  source 1..203: mol_type = other DNA
ggcgcgccagtcctggctgaggcaacctgaaggaggagctctcattaccttctgcccatcacttaataaatagccagccaattcatcaacattctggtacactgttggagagatgagacagtcacaccagctgcccctagtggggctcttactgttttcttttattccaagccaactatgcgagatttcgactcggaccgatg

SEQ ID NO: 1723 - DNA, 203 bp, Homo sapiens
  source 1..203: mol_type = other DNA
ggcgcgccagtcctcaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaaccgactcggaccgatg

SEQ ID NO: 1724 - DNA, 203 bp, Homo sapiens
  source 1..203: mol_type = other DNA
ggcgcgccagtcctgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcgactcggaccgatg

SEQ ID NO: 1725 - DNA, 203 bp, Homo sapiens
  source 1..203: mol_type = other DNA
ggcgcgccagtcctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaaccgactcggaccgatg

SEQ ID NO: 1726 - DNA, 203 bp, Homo sapiens
  source 1..203: mol_type = other DNA
ggcgcgccagtccttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcgactcggaccgatg

SEQ ID NO: 1727 - DNA, 203 bp, Homo sapiens
  source 1..203: mol_type = other DNA
ggcgcgccagtcctcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcgactcggaccgatg

SEQ ID NO: 1728 - DNA, 203 bp, Homo sapiens
  source 1..203: mol_type = other DNA
ggcgcgccagtcctgtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtcgactcggaccgatg

SEQ ID NO: 1729 - DNA, 203 bp, Homo sapiens
  source 1..203: mol_type = other DNA
ggcgcgccagtcctaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctcgactcggaccgatg

SEQ ID NO: 1730 - DNA, 203 bp, Homo sapiens
  source 1..203: mol_type = other DNA
ggcgcgccagtcctccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaagcgactcggaccgatg

SEQ ID NO: 1731 - DNA, 203 bp, Homo sapiens
  source 1..203: mol_type = other DNA
ggcgcgccagtcctgaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgcttttcgactcggaccgatg

SEQ ID NO: 1732 - DNA, 203 bp, Homo sapiens
  source 1..203: mol_type = other DNA
ggcgcgccagtccttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacacgactcggaccgatg

SEQ ID NO: 1733 - DNA, 203 bp, Homo sapiens
  source 1..203: mol_type = other DNA
ggcgcgccagtcctcaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacgactcggaccgatg

SEQ ID NO: 1734 - DNA, 203 bp, Homo sapiens
  source 1..203: mol_type = other DNA
ggcgcgccagtcctatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttgcgactcggaccgatg

SEQ ID NO: 1735 - DNA, 203 bp, Homo sapiens
  source 1..203: mol_type = other DNA
ggcgcgccagtcctgtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacgactcggaccgatg

SEQ ID NO: 1736 - DNA, 203 bp, Homo sapiens
  source 1..203: mol_type = other DNA
ggcgcgccagtcctgcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgcgactcggaccgatg

SEQ ID NO: 1737 - DNA, 203 bp, Homo sapiens
  source 1..203: mol_type = other DNA
ggcgcgccagtcctatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggacgactcggaccgatg

SEQ ID NO: 1738 - DNA, 203 bp, Homo sapiens
  source 1..203: mol_type = other DNA
ggcgcgccagtcctcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctacgactcggaccgatg

SEQ ID NO: 1739 - DNA, 203 bp, Homo sapiens
  source 1..203: mol_type = other DNA
ggcgcgccagtccttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattcgactcggaccgatg

SEQ ID NO: 1740 - DNA, 203 bp, Homo sapiens
  source 1..203: mol_type = other DNA
ggcgcgccagtcctttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctcccgactcggaccgatg

SEQ ID NO: 1741 - DNA, 203 bp, Homo sapiens
  source 1..203: mol_type = other DNA
ggcgcgccagtcctagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtagaaaaaaaaaaaacgactcggaccgatg

SEQ ID NO: 1742 - DNA, 203 bp, Homo sapiens
  source 1..203: mol_type = other DNA
ggcgcgccagtcctaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccgactcggaccgatg

SEQ ID NO: 1743 - DNA, 203 bp, Homo sapiens
  source 1..203: mol_type = other DNA
ggcgcgccagtcctgctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttgcgactcggaccgatg

SEQ ID NO: 1744 - DNA, 203 bp, Homo sapiens
  source 1..203: mol_type = other DNA
ggcgcgccagtcctgagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcacgactcggaccgatg

SEQ ID NO: 1745 - DNA, 203 bp, Homo sapiens
  source 1..203: mol_type = other DNA
ggcgcgccagtcctcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgacgactcggaccgatg

SEQ ID NO: 1746 - DNA, 203 bp, Homo sapiens
  source 1..203: mol_type = other DNA
ggcgcgccagtcctcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagcgactcggaccgatg

SEQ ID NO: 1747 - DNA, 203 bp, Homo sapiens
  source 1..203: mol_type = other DNA
ggcgcgccagtccttttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatgcgactcggaccgatg

SEQ ID NO: 1748 - DNA, 203 bp, Homo sapiens
  source 1..203: mol_type = other DNA
ggcgcgccagtcctaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctcgactcggaccgatg

SEQ ID NO: 1749 - DNA, 203 bp, Homo sapiens
  source 1..203: mol_type = other DNA
ggcgcgccagtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacaccgactcggaccgatg

SEQ ID NO: 1750 - DNA, 203 bp, Homo sapiens
  source 1..203: mol_type = other DNA
ggcgcgccagtcctttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgatacgactcggaccgatg

SEQ ID NO: 1751 - DNA, 203 bp, Homo sapiens
  source 1..203: mol_type = other DNA
ggcgcgccagtcctcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatacgactcggaccgatg

SEQ ID NO: 1752 - DNA, 203 bp, Homo sapiens
  source 1..203: mol_type = other DNA
ggcgcgccagtccttatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctcgactcggaccgatg

SEQ ID NO: 1753 - DNA, 203 bp, Homo sapiens
  source 1..203: mol_type = other DNA
ggcgcgccagtcctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgttcgactcggaccgatg

SEQ ID NO: 1754 - DNA, 203 bp, Homo sapiens
  source 1..203: mol_type = other DNA
ggcgcgccagtccttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccaccgactcggaccgatg

SEQ ID NO: 1755 - DNA, 203 bp, Homo sapiens
  source 1..203: mol_type = other DNA
ggcgcgccagtcctctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaacgactcggaccgatg

SEQ ID NO: 1756 - DNA, 203 bp, Homo sapiens
  source 1..203: mol_type = other DNA
ggcgcgccagtcctagtctgaagagaggcgggacgcggggtgataacagctggctctggtgggcgggcgggagctggggaggaggagcaggagaggcccacaggcttcatttggagtcaggcctggctgttgctcaggtgaccagcttgtgtctctgggagggcgctgctttccccggccacccggcgcgactcggaccgatg

SEQ ID NO: 1757 - DNA, 203 bp, Homo sapiens
  source 1..203: mol_type = other DNA
ggcgcgccagtcctccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgacgactcggaccgatg

SEQ ID NO: 1758 - DNA, 203 bp, Homo sapiens
  source 1..203: mol_type = other DNA
ggcgcgccagtcctacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccacgactcggaccgatg

SEQ ID NO: 1759 - DNA, 203 bp, Homo sapiens
  source 1..203: mol_type = other DNA
ggcgcgccagtcctacagacgcggagagaccctctgctcaggcttctgcctctggcgcgagggggaccagctgaccaaggtatcctactacaaccaggccaccccaggtgttctcaactatgtgaccaccaacgtggccggcctctcctctgagttctacaccaccttcaaggcttgtgagcagtttccgactcggaccgatg

SEQ ID NO: 1760 - DNA, 203 bp, Homo sapiens
  source 1..203: mol_type = other DNA
ggcgcgccagtcctggagggctgcgggctccgctatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttcgactcggaccgatg

SEQ ID NO: 1761 - DNA, 203 bp, Homo sapiens
  source 1..203: mol_type = other DNA
ggcgcgccagtccttgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccgactcggaccgatg

SEQ ID NO: 1762 - DNA, 203 bp, Homo sapiens
  source 1..203: mol_type = other DNA
ggcgcgccagtcctactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggcaacagcgactcggaccgatg

SEQ ID NO: 1763 - DNA, 203 bp, Homo sapiens
  source 1..203: mol_type = other DNA
ggcgcgccagtccttgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgtcgactcggaccgatg

SEQ ID NO: 1764 - DNA, 203 bp, Homo sapiens
  source 1..203: mol_type = other DNA
ggcgcgccagtccttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctcgactcggaccgatg

SEQ ID NO: 1765 - DNA, 203 bp, Homo sapiens
  source 1..203: mol_type = other DNA
ggcgcgccagtcctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgcgactcggaccgatg

SEQ ID NO: 1766 - DNA, 203 bp, Homo sapiens
  source 1..203: mol_type = other DNA
ggcgcgccagtcctggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggcgactcggaccgatg

SEQ ID NO: 1767 - DNA, 203 bp, Homo sapiens
  source 1..203: mol_type = other DNA
ggcgcgccagtcctatgtgggaagaccccatgggggcccggggccagtgcatgtctggtgcctctcggctgccctccctcttctcccagaacatcatccccgagtacggcatgttccagggcatgcgaggtgggggcgccttcccgggcggctcccgctttggtttcgggtttggcaatggcatgaagcgactcggaccgatg

SEQ ID NO: 1768 - DNA, 203 bp, Homo sapiens
  source 1..203: mol_type = other DNA
ggcgcgccagtcctttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccgactcggaccgatg

SEQ ID NO: 1769 - DNA, 203 bp, Homo sapiens
  source 1..203: mol_type = other DNA
ggcgcgccagtcctgatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctagcgactcggaccgatg

SEQ ID NO: 1770 - DNA, 203 bp, Homo sapiens
  source 1..203: mol_type = other DNA
ggcgcgccagtcctaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccacgactcggaccgatg

SEQ ID NO: 1771 - DNA, 203 bp, Homo sapiens
  source 1..203: mol_type = other DNA
ggcgcgccagtcctgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgcgactcggaccgatg

SEQ ID NO: 1772 - DNA, 203 bp, Homo sapiens
  source 1..203: mol_type = other DNA
ggcgcgccagtccttcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtcgactcggaccgatg

SEQ ID NO: 1773 - DNA, 203 bp, Homo sapiens
  source 1..203: mol_type = other DNA
ggcgcgccagtcctaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagcgactcggaccgatg

SEQ ID NO: 1774 - DNA, 203 bp, Homo sapiens
  source 1..203: mol_type = other DNA
ggcgcgccagtcctgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgaccgactcggaccgatg

SEQ ID NO: 1775 - DNA, 203 bp, Homo sapiens
  source 1..203: mol_type = other DNA
ggcgcgccagtcctgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggccgactcggaccgatg

SEQ ID NO: 1776 - DNA, 203 bp, Homo sapiens
  source 1..203: mol_type = other DNA
ggcgcgccagtccttgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctcgcgcgcccctccgactcggaccgatg

SEQ ID NO: 1777 - DNA, 203 bp, Homo sapiens
  source 1..203: mol_type = other DNA
ggcgcgccagtcctccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttccgactcggaccgatg

SEQ ID NO: 1778 - DNA, 203 bp, Homo sapiens
  source 1..203: mol_type = other DNA
ggcgcgccagtccttggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgagcgactcggaccgatg

SEQ ID NO: 1779 - DNA, 203 bp, Homo sapiens
  source 1..203: mol_type = other DNA
ggcgcgccagtcctctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcgactcggaccgatg

SEQ ID NO: 1780 - DNA, 203 bp, Homo sapiens
  source 1..203: mol_type = other DNA
ggcgcgccagtccttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttccgactcggaccgatg

SEQ ID NO: 1781 - DNA, 203 bp, Homo sapiens
  source 1..203: mol_type = other DNA
ggcgcgccagtccttccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtccgactcggaccgatg

SEQ ID NO: 1782 - DNA, 203 bp, Homo sapiens
  source 1..203: mol_type = other DNA
ggcgcgccagtcctgcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccacgactcggaccgatg

SEQ ID NO: 1783 - DNA, 203 bp, Homo sapiens
  source 1..203: mol_type = other DNA
ggcgcgccagtcctcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacccgactcggaccgatg

SEQ ID NO: 1784 - DNA, 203 bp, Homo sapiens
  source 1..203: mol_type = other DNA
ggcgcgccagtccttggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaatcgactcggaccgatg

SEQ ID NO: 1785 - DNA, 203 bp, Homo sapiens
  source 1..203: mol_type = other DNA
ggcgcgccagtcctaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgcgactcggaccgatg

SEQ ID NO: 1786 - DNA, 203 bp, Homo sapiens
  source 1..203: mol_type = other DNA
ggcgcgccagtcctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaacgactcggaccgatg

SEQ ID NO: 1787 - DNA, 203 bp, Homo sapiens
  source 1..203: mol_type = other DNA
ggcgcgccagtccttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgcgactcggaccgatg

SEQ ID NO: 1788 - DNA, 203 bp, Homo sapiens
  source 1..203: mol_type = other DNA
ggcgcgccagtccttctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacacccgactcggaccgatg

SEQ ID NO: 1789 - DNA, 203 bp, Homo sapiens
  source 1..203: mol_type = other DNA
ggcgcgccagtcctaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttatcgactcggaccgatg

SEQ ID NO: 1790 - DNA, 203 bp, Homo sapiens
  source 1..203: mol_type = other DNA
ggcgcgccagtccttttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgcgactcggaccgatg

SEQ ID NO: 1791 - DNA, 203 bp, Homo sapiens
  source 1..203: mol_type = other DNA
ggcgcgccagtcctatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattcgactcggaccgatg

SEQ ID NO: 1792 - DNA, 203 bp, Homo sapiens
  source 1..203: mol_type = other DNA
ggcgcgccagtcctatccttgcaccctggcaggaagctggtagctcacactttaacgggaggccttcacatattccagaaaagaaaccactttgcagtgccagactggaagaagtaacggtcactctgaaaacagggtgggagagctgcctctctttgaacctctcccaggaccaactctaacccaggcgactcggaccgatg

SEQ ID NO: 1793 - DNA, 203 bp, Homo sapiens
  source 1..203: mol_type = other DNA
ggcgcgccagtcctaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagcgactcggaccgatg

SEQ ID NO: 1794 - DNA, 203 bp, Homo sapiens
  source 1..203: mol_type = other DNA
ggcgcgccagtcctgaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgactcggaccgatg

SEQ ID NO: 1795 - DNA, 203 bp, Homo sapiens
  source 1..203: mol_type = other DNA
ggcgcgccagtcctcgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctcgactcggaccgatg

SEQ ID NO: 1796 - DNA, 203 bp, Homo sapiens
  source 1..203: mol_type = other DNA
ggcgcgccagtccttgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgcgactcggaccgatg

SEQ ID NO: 1797 - DNA, 203 bp, Homo sapiens
  source 1..203: mol_type = other DNA
ggcgcgccagtccttgagttgtgttttggctgctttcctattgctcccattcttgccaatcagccaccccctttcctgtgaaaatctgccaccttgaggagaggaacaagagtttaaaagggctaatgatctccctcccggtcttcccttggaacatggatgttgatatatgtgcgggtggtttcctgcgactcggaccgatg

SEQ ID NO: 1798 - DNA, 203 bp, Homo sapiens
  source 1..203: mol_type = other DNA
ggcgcgccagtcctgtttaaaagggctaatgatctccctcccggtcttcccttggaacatggatgttgatatatgtgcgggtggtttcctgtcttgcttatcttcctttgccctgagctgatggctaaagggcagttttcggactattaaagactgaaatgtaagaatgagccttctaggctgggcgccgactcggaccgatg

SEQ ID NO: 1799 - DNA, 203 bp, Homo sapiens
  source 1..203: mol_type = other DNA
ggcgcgccagtccttcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaacgactcggaccgatg

SEQ ID NO: 1800 - DNA, 203 bp, Homo sapiens
  source 1..203: mol_type = other DNA
ggcgcgccagtcctacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccacgactcggaccgatg

SEQ ID NO: 1801 - DNA, 203 bp, Homo sapiens
  source 1..203: mol_type = other DNA
ggcgcgccagtcctttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggacgactcggaccgatg

SEQ ID NO: 1802 - DNA, 203 bp, Homo sapiens
  source 1..203: mol_type = other DNA
ggcgcgccagtcctgtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttgcgactcggaccgatg

SEQ ID NO: 1803 - DNA, 203 bp, Homo sapiens
  source 1..203: mol_type = other DNA
ggcgcgccagtccttttcctccgaagctctgtggtccgatctggggtccgcttgctttccctgcccggtcccgagcgctcagcctgaagcgccgctttcgagggcaccctgcatacactggccgcgcctcagggatctcattgcccgcgctttctcattgcctctttccgtgttcgattcggctgatccgactcggaccgatg

SEQ ID NO: 1804 - DNA, 203 bp, Homo sapiens
  source 1..203: mol_type = other DNA
ggcgcgccagtccttgaaatggaaaatagtttatctgatcctgagaatgaacagacagttcagaaaagaaaatctaatgttgttatacaggaggaagaattagaattggctgttttggaagctggaagttctgaagctgtgaaaccaaaatgcactctagaagaaagacagcaatttatgaaagcattcgactcggaccgatg

SEQ ID NO: 1805 - DNA, 203 bp, Homo sapiens
  source 1..203: mol_type = other DNA
ggcgcgccagtccttgatgaaagcagtcaagatacatctgaaaaatctcaggattgtgatgttcaatgtaaagcaaagcgtgacttcctaatgagtggtttgccagatttgttgaaacggcaaattgcaaagaaagctgctgcgctggatgtgtacaatgcagtgagtaccagtttccagagagtcgtcgactcggaccgatg

SEQ ID NO: 1806 - DNA, 203 bp, Homo sapiens
  source 1..203: mol_type = other DNA
ggcgcgccagtcctggaggctgatgtcagccataaagaaaccaaaaggaaactcgtagaagcagaaaattctaagtcaaaaagaaagaaaccaaatgagtattcaaaaaatctggagaagaccaataggaagtcagaagaacttagcaaaagaaacaactcttctgggataaagctagattcttccaacgactcggaccgatg

SEQ ID NO: 1807 - DNA, 203 bp, Homo sapiens
  source 1..203: mol_type = other DNA
ggcgcgccagtccttacaagtgacccaacatttagtttaatgtttgatggctgctttgaagaaatcaagttcagtactccttccctgctaaatgttgccagctacctacaaatgatttgcttaactgagaattttagaactgatgtaaaagactttgtaaccttgttaactgcaaatacttgtgatatcgactcggaccgatg

SEQ ID NO: 1808 - DNA, 203 bp, Homo sapiens
  source 1..203: mol_type = other DNA
ggcgcgccagtcctgaaaacattggtaatattagatgatagtgatctatttgacactgacttggactttcctgatcaatctattagcctgtcctctgtatcatcttcctcaaatgcagaagaaagcaaaaccggagacgaagaaagcaaagccagagacaaaggaaacaatccagagacaaagaaatccgactcggaccgatg

SEQ ID NO: 1809 - DNA, 203 bp, Homo sapiens
  source 1..203: mol_type = other DNA
ggcgcgccagtcctaacccttcgaaacatctgtaagactgagaagctaaaagaacaaggaaaaagtaaaagaagattcctgcactattttgaaggaattcatcttgacattccaaaagagactgtgaatactttggcagctgacttcccttaatgttccatactaacaatgctttgtatagattatcacgactcggaccgatg

SEQ ID NO: 1810 - DNA, 203 bp, Homo sapiens
  source 1..203: mol_type = other DNA
ggcgcgccagtccttctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtcgactcggaccgatg

SEQ ID NO: 1811 - DNA, 203 bp, Homo sapiens
  source 1..203: mol_type = other DNA
ggcgcgccagtccttgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgcgactcggaccgatg

SEQ ID NO: 1812 - DNA, 203 bp, Homo sapiens
  source 1..203: mol_type = other DNA
ggcgcgccagtccttcccaggtacacccctgcatccaggcagcagcccaggccaccccctcctcactggcccttggctcctttcttgatgcctctgttgcttgtcccccaggagtcggagaagctggaaagtgtgaatgctgaactgaaggctcagattgaggagctcaagaacgagaagcagcatttcgactcggaccgatg

SEQ ID NO: 1813 - DNA, 203 bp, Homo sapiens
  source 1..203: mol_type = other DNA
ggcgcgccagtcctcccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttagcgactcggaccgatg

SEQ ID NO: 1814 - DNA, 203 bp, Homo sapiens
  source 1..203: mol_type = other DNA
ggcgcgccagtccttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccgactcggaccgatg

SEQ ID NO: 1815 - DNA, 203 bp, Homo sapiens
  source 1..203: mol_type = other DNA
ggcgcgccagtcctcaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtcgactcggaccgatg

SEQ ID NO: 1816 - DNA, 203 bp, Homo sapiens
  source 1..203: mol_type = other DNA
ggcgcgccagtccttgaaaggaaaaagaggcgacgagaaagaaataagattgcagctgcaaagtgccgaaacaagaagaaggagaagacggagtgcctgcagaaactcccaaggcccttttgggtccagaagacctgcatatgggctgttgactcatgcaaatgaggtatctgaactgcagcttcagtcgactcggaccgatg

SEQ ID NO: 1817 - DNA, 203 bp, Homo sapiens
  source 1..203: mol_type = other DNA
ggcgcgccagtcctattagcagagccacaggccgcctctgtggcatcaccagggtttctctgaagaagagggtctgcattttcctaaacccagtgctgctctcccatctcccatcttcctctcgcagcttgatgagccccggtgtgtcccaggtacacccctgcatccaggcagcagcccaggccacccgactcggaccgatg

SEQ ID NO: 1818 - DNA, 203 bp, Homo sapiens
  source 1..203: mol_type = other DNA
ggcgcgccagtcctccctcctcactggcccttggctcctttcttgatgcctctgttgcttgtcccccaggagtcggagaagctggaaagtgtgaatgctgaactgaaggctcagattgaggagctcaagaacgagaagcagcatttgatatacatgctcaaccttcatcggcccacgtgtattgtccgcgactcggaccgatg

SEQ ID NO: 1819 - DNA, 203 bp, Homo sapiens
  source 1..203: mol_type = other DNA
ggcgcgccagtcctctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccacgactcggaccgatg

SEQ ID NO: 1820 - DNA, 203 bp, Homo sapiens
  source 1..203: mol_type = other DNA
ggcgcgccagtcctaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggcgactcggaccgatg

SEQ ID NO: 1821 - DNA, 203 bp, Homo sapiens
  source 1..203: mol_type = other DNA
ggcgcgccagtcctttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcacgactcggaccgatg

SEQ ID NO: 1822 - DNA, 203 bp, Homo sapiens
  source 1..203: mol_type = other DNA
ggcgcgccagtcctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacgactcggaccgatg

SEQ ID NO: 1823 - DNA, 203 bp, Homo sapiens
  source 1..203: mol_type = other DNA
ggcgcgccagtcctctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaaccgactcggaccgatg

SEQ ID NO: 1824 - DNA, 203 bp, Homo sapiens
  source 1..203: mol_type = other DNA
ggcgcgccagtcctgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggacgactcggaccgatg

SEQ ID NO: 1825 - DNA, 203 bp, Homo sapiens
  source 1..203: mol_type = other DNA
ggcgcgccagtcctcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagacgactcggaccgatg

SEQ ID NO: 1826 - DNA, 203 bp, Homo sapiens
  source 1..203: mol_type = other DNA
ggcgcgccagtcctagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgaaatgaggggacaggattctccgactcggaccgatg

SEQ ID NO: 1827 - DNA, 203 bp, Homo sapiens
  source 1..203: mol_type = other DNA
ggcgcgccagtcctgaaaaggaacttgggattcaaattgatttttcaaatcatttttaaagagacatcatcctgactaaatcttagcctgaaccttcctcccctgtgtgtattccccggtagtcaccgcagcgagatgctggtgagactgccgtggtggcatttagcatcgttaaaactggaaaactccgactcggaccgatg

SEQ ID NO: 1828 - DNA, 203 bp, Homo sapiens
  source 1..203: mol_type = other DNA
ggcgcgccagtcctgaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactcgactcggaccgatg

SEQ ID NO: 1829 - DNA, 203 bp, Homo sapiens
  source 1..203: mol_type = other DNA
ggcgcgccagtccttaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcacgactcggaccgatg

SEQ ID NO: 1830 - DNA, 203 bp, Homo sapiens
  source 1..203: mol_type = other DNA
ggcgcgccagtcctctgaggggggagtgttagagatgccatttcaccaggatctttttgctcaggttgtacccatgccaattgaagaacgtgttaaagatgaggaggagagatgtaccattctctcccttaataatgatgttggtttgcaaaacctaaagaaataataacaacagactatttcatactcgactcggaccgatg

SEQ ID NO: 1831 - DNA, 203 bp, Homo sapiens
  source 1..203: mol_type = other DNA
ggcgcgccagtcctacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggccgactcggaccgatg

SEQ ID NO: 1832 - DNA, 203 bp, Homo sapiens
  source 1..203: mol_type = other DNA
ggcgcgccagtcctcagccacgagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactgcgactcggaccgatg

SEQ ID NO: 1833 - DNA, 203 bp, Homo sapiens
  source 1..203: mol_type = other DNA
ggcgcgccagtcctatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgcgactcggaccgatg

SEQ ID NO: 1834 - DNA, 203 bp, Homo sapiens
  source 1..203: mol_type = other DNA
ggcgcgccagtccttttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagcgactcggaccgatg

SEQ ID NO: 1835 - DNA, 203 bp, Homo sapiens
  source 1..203: mol_type = other DNA
ggcgcgccagtcctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcacgactcggaccgatg

SEQ ID NO: 1836 - DNA, 203 bp, Homo sapiens
  source 1..203: mol_type = other DNA
ggcgcgccagtccttgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccgactcggaccgatg

SEQ ID NO: 1837 - DNA, 203 bp, Homo sapiens
  source 1..203: mol_type = other DNA
ggcgcgccagtccttgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccgactcggaccgatg

SEQ ID NO: 1838 - DNA, 203 bp, Homo sapiens
  source 1..203: mol_type = other DNA
ggcgcgccagtcctcactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgacgactcggaccgatg

SEQ ID NO: 1839 - DNA, 203 bp, Homo sapiens
  source 1..203: mol_type = other DNA
ggcgcgccagtccttggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacgactcggaccgatg

SEQ ID NO: 1840 - DNA, 203 bp, Homo sapiens
  source 1..203: mol_type = other DNA
ggcgcgccagtcctgggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcgactcggaccgatg

SEQ ID NO: 1841 - DNA, 203 bp, Homo sapiens
  source 1..203: mol_type = other DNA
ggcgcgccagtcctcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtcgactcggaccgatg

SEQ ID NO: 1842 - DNA, 203 bp, Homo sapiens
  source 1..203: mol_type = other DNA
ggcgcgccagtcctatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgccgactcggaccgatg

SEQ ID NO: 1843 - DNA, 203 bp, Homo sapiens
  source 1..203: mol_type = other DNA
ggcgcgccagtcctcggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcacccgactcggaccgatg

SEQ ID NO: 1844 - DNA, 203 bp, Homo sapiens
  source 1..203: mol_type = other DNA
ggcgcgccagtcctgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgcgactcggaccgatg

SEQ ID NO: 1845 - DNA, 203 bp, Homo sapiens
  source 1..203: mol_type = other DNA
ggcgcgccagtcctagctgtttggacctctgggtgctttctttgggctggtgagagctctaatttgccttgggccagtttcaggtttataggccccctcagtcttcagatacatgagggcttctttgctcttgtgatcgtgtagtcccatagctgtaaaaccagaatcaccaggaggttgcacctagtcgactcggaccgatg

SEQ ID NO: 1846 - DNA, 203 bp, Homo sapiens
  source 1..203: mol_type = other DNA
ggcgcgccagtcctcaggaatattgggaatggcctagaacaaggtgtttggcacataagtagaccacttatccctcattgtgacctaattccagagcatctggctgggttgttgggttctagactttgtcctcacctcccagtgaccctgactagccacaggccatgagataccagggggccgttcctcgactcggaccgatg

SEQ ID NO: 1847 - DNA, 203 bp, Homo sapiens
  source 1..203: mol_type = other DNA
ggcgcgccagtcctcatttgaacctgggaggtagaggttgctgtgagccgagattacgcccctgcactccagcctgggtcacagagtgagactccatctcagaaaaaaaaaaaattgagtcaggtgcagtagctccttcctgtagtcccagctacttgggaggctgaggctagaggatcacttgagcccgactcggaccgatg

SEQ ID NO: 1848 - DNA, 203 bp, Homo sapiens
  source 1..203: mol_type = other DNA
ggcgcgccagtccttagtcataatttatgcttaataacattgatagtagccctttgcgctataactctacctaaagactcacatcatttggcagagagagagtcgttgaagtcccaggaattcaggactgggcaggttaagacctcagacaaggtagtagaggtagacttgtggacaaggctcgggtccgactcggaccgatg

SEQ ID NO: 1849 - DNA, 203 bp, Homo sapiens
  source 1..203: mol_type = other DNA
ggcgcgccagtcctcccattctctgatttttttcctcttgtcctctgcctctccctctagctcccacttcctctctgctctagttcattttctttagagcagcccgagtgatcatgaagtgcaaatcttgccatgtcagtcccctgcttagaaccctccaatggctcactttctctttaggcaaaagtcgactcggaccgatg

SEQ ID NO: 1850 - DNA, 203 bp, Homo sapiens
  source 1..203: mol_type = other DNA
ggcgcgccagtcctctttaccccatgccttctcccatctcatctcaaccccctcatttgttggctgtctgctgtcagccactcttctttcaggtcctcagatgcactgcaccctctcctgcctgggggtctttgctcctgctactacctctgcttgaacagctcctcaccttccttcctccaaccctacgactcggaccgatg

SEQ ID NO: 1851 - DNA, 203 bp, Homo sapiens
  source 1..203: mol_type = other DNA
ggcgcgccagtccttttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttcgactcggaccgatg

SEQ ID NO: 1852 - DNA, 203 bp, Homo sapiens
  source 1..203: mol_type = other DNA
ggcgcgccagtcctgacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgccgactcggaccgatg

SEQ ID NO: 1853 - DNA, 203 bp, Homo sapiens
  source 1..203: mol_type = other DNA
ggcgcgccagtcctctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgctacgactcggaccgatg

SEQ ID NO: 1854 - DNA, 203 bp, Homo sapiens
  source 1..203: mol_type = other DNA
ggcgcgccagtcctaacgctggtcctcggccgggcgcgctgacgtcatcgtgcgtcagagtgagcccggatggggcggcgggcttcgggagcgcccgggctgatccgagccgagcgggccgtatctccttgtcggcgccgctgattcccggctctgcggaggcctctaggcagccgcgcagcttccgtcgactcggaccgatg

SEQ ID NO: 1855 - DNA, 203 bp, Homo sapiens
  source 1..203: mol_type = other DNA
ggcgcgccagtcctgacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactcccgactcggaccgatg

SEQ ID NO: 1856 - DNA, 203 bp, Homo sapiens
  source 1..203: mol_type = other DNA
ggcgcgccagtcctaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagacgactcggaccgatg

SEQ ID NO: 1857 - DNA, 203 bp, Homo sapiens
  source 1..203: mol_type = other DNA
ggcgcgccagtccttagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagcgactcggaccgatg

SEQ ID NO: 1858 - DNA, 203 bp, Homo sapiens
  source 1..203: mol_type = other DNA
ggcgcgccagtcctagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatccgactcggaccgatg

SEQ ID NO: 1859 - DNA, 203 bp, Homo sapiens
  source 1..203: mol_type = other DNA
ggcgcgccagtcctcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggacgactcggaccgatg

SEQ ID NO: 1860 - DNA, 203 bp, Homo sapiens
  source 1..203: mol_type = other DNA
ggcgcgccagtcctctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgcgactcggaccgatg

SEQ ID NO: 1861 - DNA, 203 bp, Homo sapiens
  source 1..203: mol_type = other DNA
ggcgcgccagtcctgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcgactcggaccgatg

SEQ ID NO: 1862 - DNA, 203 bp, Homo sapiens
  source 1..203: mol_type = other DNA
ggcgcgccagtcctaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacccgactcggaccgatg

SEQ ID NO: 1863 - DNA, 203 bp, Homo sapiens
  source 1..203: mol_type = other DNA
ggcgcgccagtcctgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctcgactcggaccgatg

SEQ ID NO: 1864 - DNA, 203 bp, Homo sapiens
  source 1..203: mol_type = other DNA
ggcgcgccagtcctaagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacgactcggaccgatg

SEQ ID NO: 1865 - DNA, 203 bp, Homo sapiens
  source 1..203: mol_type = other DNA
ggcgcgccagtccttgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccgactcggaccgatg

SEQ ID NO: 1866 - DNA, 203 bp, Homo sapiens
  source 1..203: mol_type = other DNA
ggcgcgccagtcctcagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgacgactcggaccgatg

SEQ ID NO: 1867 - DNA, 203 bp, Homo sapiens
  source 1..203: mol_type = other DNA
ggcgcgccagtcctggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggccgactcggaccgatg

SEQ ID NO: 1868 - DNA, 203 bp, Homo sapiens
  source 1..203: mol_type = other DNA
ggcgcgccagtcctctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagacgactcggaccgatg

SEQ ID NO: 1869 - DNA, 203 bp, Homo sapiens
  source 1..203: mol_type = other DNA
ggcgcgccagtcctaagatgaatgcagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagattcgactcggaccgatg

SEQ ID NO: 1870 - DNA, 203 bp, Homo sapiens
  source 1..203: mol_type = other DNA
ggcgcgccagtcctcagaaaggaaaagtcttgcacgaggagcatgttgaactcttgatggaggaattcgctttcctgaaaaaagaagtggtggggaaagacctgctgaaagggtcgctcctcttcacagctggcccgttggaagaagagcggtttggcttccctgcattcagcggcatctctcgcctgcgactcggaccgatg

SEQ ID NO: 1871 - DNA, 203 bp, Homo sapiens
  source 1..203: mol_type = other DNA
ggcgcgccagtcctacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttacgactcggaccgatg

SEQ ID NO: 1872 - DNA, 203 bp, Homo sapiens
  source 1..203: mol_type = other DNA
ggcgcgccagtcctatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgacgactcggaccgatg

SEQ ID NO: 1873 - DNA, 203 bp, Homo sapiens
  source 1..203: mol_type = other DNA
ggcgcgccagtccttggagacagagaagaaaagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactctcgactcggaccgatg

SEQ ID NO: 1874 - DNA, 203 bp, Homo sapiens
  source 1..203: mol_type = other DNA
ggcgcgccagtcctaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcgactcggaccgatg

SEQ ID NO: 1875 - DNA, 203 bp, Homo sapiens
  source 1..203: mol_type = other DNA
ggcgcgccagtcctcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagttcgactcggaccgatg

SEQ ID NO: 1876 - DNA, 203 bp, Homo sapiens
  source 1..203: mol_type = other DNA
ggcgcgccagtcctctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcacgactcggaccgatg

SEQ ID NO: 1877 - DNA, 203 bp, Homo sapiens
  source 1..203: mol_type = other DNA
ggcgcgccagtcctacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgcgactcggaccgatg

SEQ ID NO: 1878 - DNA, 203 bp, Homo sapiens
  source 1..203: mol_type = other DNA
ggcgcgccagtcctaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggcgactcggaccgatg

SEQ ID NO: 1879 - DNA, 203 bp, Homo sapiens
  source 1..203: mol_type = other DNA
ggcgcgccagtcctacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcacccgactcggaccgatg

SEQ ID NO: 1880 - DNA, 203 bp, Homo sapiens
  source 1..203: mol_type = other DNA
ggcgcgccagtcctcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccgactcggaccgatg

SEQ ID NO: 1881 - DNA, 203 bp, Homo sapiens
  source 1..203: mol_type = other DNA
ggcgcgccagtccttgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggcgactcggaccgatg

SEQ ID NO: 1882 - DNA, 203 bp, Homo sapiens
  source 1..203: mol_type = other DNA
ggcgcgccagtccttcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgcgactcggaccgatg

SEQ ID NO: 1883 - DNA, 203 bp, Homo sapiens
  source 1..203: mol_type = other DNA
ggcgcgccagtccttggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgactcggaccgatg

SEQ ID NO: 1884 - DNA, 203 bp, Homo sapiens
  source 1..203: mol_type = other DNA
ggcgcgccagtcctcgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgtcgactcggaccgatg

SEQ ID NO: 1885 - DNA, 203 bp, Homo sapiens
  source 1..203: mol_type = other DNA
ggcgcgccagtccttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaatccgaataacttcatcaacccgactcggaccgatg

SEQ ID NO: 1886 - DNA, 203 bp, Homo sapiens
  source 1..203: mol_type = other DNA
ggcgcgccagtcctgtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgatacgactcggaccgatg

SEQ ID NO: 1887 - DNA, 203 bp, Homo sapiens
  source 1..203: mol_type = other DNA
ggcgcgccagtcctagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagacgactcggaccgatg

SEQ ID NO: 1888 - DNA, 203 bp, Homo sapiens
  source 1..203: mol_type = other DNA
ggcgcgccagtcctctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagcccgactcggaccgatg

SEQ ID NO: 1889 - DNA, 203 bp, Homo sapiens
  source 1..203: mol_type = other DNA
ggcgcgccagtcctgccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccacccccccgactcggaccgatg

SEQ ID NO: 1890 - DNA, 203 bp, Homo sapiens
  source 1..203: mol_type = other DNA
ggcgcgccagtcctatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactcgactcggaccgatg

SEQ ID NO: 1891 - DNA, 203 bp, Homo sapiens
  source 1..203: mol_type = other DNA
ggcgcgccagtcctcagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatcgactcggaccgatg

SEQ ID NO: 1892 - DNA, 203 bp, Homo sapiens
  source 1..203: mol_type = other DNA
ggcgcgccagtcctgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacgactcggaccgatg

SEQ ID NO: 1893 - DNA, 203 bp, Homo sapiens
  source 1..203: mol_type = other DNA
ggcgcgccagtcctaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccgactcggaccgatg

SEQ ID NO: 1894 - DNA, 203 bp, Homo sapiens
  source 1..203: mol_type = other DNA
ggcgcgccagtccttgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgccgactcggaccgatg

SEQ ID NO: 1895 - DNA, 203 bp, Homo sapiens
  source 1..203: mol_type = other DNA
ggcgcgccagtcctaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtcgactcggaccgatg

SEQ ID NO: 1896 - DNA, 203 bp, Homo sapiens
  source 1..203: mol_type = other DNA
ggcgcgccagtcctcagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgccgactcggaccgatg

SEQ ID NO: 1897 - DNA, 203 bp, Homo sapiens
  source 1..203: mol_type = other DNA
ggcgcgccagtcctagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacgactcggaccgatg

SEQ ID NO: 1898 - DNA, 203 bp, Homo sapiens
  source 1..203: mol_type = other DNA
ggcgcgccagtcctctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatccgactcggaccgatg

SEQ ID NO: 1899 - DNA, 203 bp, Homo sapiens
  source 1..203: mol_type = other DNA
ggcgcgccagtcctttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgccgactcggaccgatg

SEQ ID NO: 1900 - DNA, 203 bp, Homo sapiens
  source 1..203: mol_type = other DNA
ggcgcgccagtcctaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcgactcggaccgatg

SEQ ID NO: 1901 - DNA, 203 bp, Homo sapiens
  source 1..203: mol_type = other DNA
ggcgcgccagtcctgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtctcgactcggaccgatg

SEQ ID NO: 1902 - DNA, 203 bp, Homo sapiens
  source 1..203: mol_type = other DNA
ggcgcgccagtccttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgactcggaccgatg

SEQ ID NO: 1903 - DNA, 203 bp, Homo sapiens
  source 1..203: mol_type = other DNA
ggcgcgccagtcctaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcccgactcggaccgatg

SEQ ID NO: 1904 - DNA, 203 bp, Homo sapiens
  source 1..203: mol_type = other DNA
ggcgcgccagtcctcccggggcccgcttgcctcagcttcttgctgccgccagcacgctaagctccagtcggcgccgaaggagagcttcccgaccctcgtgtccagtagccgcaatcccaggctgggagggtgaggcgccgcgctctgccgcccccccgcccctcgctccctgtgtcctggcggatttgcgactcggaccgatg

SEQ ID NO: 1905 - DNA, 203 bp, Homo sapiens
  source 1..203: mol_type = other DNA
ggcgcgccagtcctcacgtaatctatccgaaagcccagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacacgactcggaccgatg

SEQ ID NO: 1906 - DNA, 203 bp, Homo sapiens
  source 1..203: mol_type = other DNA
ggcgcgccagtcctccgttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagacgactcggaccgatg

SEQ ID NO: 1907 - DNA, 203 bp, Homo sapiens
  source 1..203: mol_type = other DNA
ggcgcgccagtcctgccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgccgactcggaccgatg

SEQ ID NO: 1908 - DNA, 203 bp, Homo sapiens
  source 1..203: mol_type = other DNA
ggcgcgccagtccttactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataacgactcggaccgatg

SEQ ID NO: 1909 - DNA, 203 bp, Homo sapiens
  source 1..203: mol_type = other DNA
ggcgcgccagtccttcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcgactcggaccgatg

SEQ ID NO: 1910 - DNA, 203 bp, Homo sapiens
  source 1..203: mol_type = other DNA
ggcgcgccagtcctaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagccgactcggaccgatg

SEQ ID NO: 1911 - DNA, 203 bp, Homo sapiens
  source 1..203: mol_type = other DNA
ggcgcgccagtcctgcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcgactcggaccgatg

SEQ ID NO: 1912 - DNA, 203 bp, Homo sapiens
  source 1..203: mol_type = other DNA
ggcgcgccagtcctctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagaccgactcggaccgatg

SEQ ID NO: 1913 - DNA, 203 bp, Homo sapiens
  source 1..203: mol_type = other DNA
ggcgcgccagtcctgcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagacgactcggaccgatg

SEQ ID NO: 1914 - DNA, 203 bp, Homo sapiens
  source 1..203: mol_type = other DNA
ggcgcgccagtcctagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggcgactcggaccgatg

SEQ ID NO: 1915 - DNA, 203 bp, Homo sapiens
  source 1..203: mol_type = other DNA
ggcgcgccagtcctagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagccgactcggaccgatg

SEQ ID NO: 1916 - DNA, 203 bp, Homo sapiens
  source 1..203: mol_type = other DNA
ggcgcgccagtcctagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagacgactcggaccgatg

SEQ ID NO: 1917 - DNA, 203 bp, Homo sapiens
  source 1..203: mol_type = other DNA
ggcgcgccagtcctgggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggcgactcggaccgatg

SEQ ID NO: 1918 - DNA, 203 bp, Homo sapiens
  source 1..203: mol_type = other DNA
ggcgcgccagtcctaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcgactcggaccgatg

SEQ ID NO: 1919 - DNA, 203 bp, Homo sapiens
  source 1..203: mol_type = other DNA
ggcgcgccagtcctaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggcgactcggaccgatg

SEQ ID NO: 1920 - DNA, 203 bp, Homo sapiens
  source 1..203: mol_type = other DNA
ggcgcgccagtcctctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagcgactcggaccgatg

SEQ ID NO: 1921 - DNA, 203 bp, Homo sapiens
  source 1..203: mol_type = other DNA
ggcgcgccagtcctttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagacgactcggaccgatg

SEQ ID NO: 1922 - DNA, 203 bp, Homo sapiens
  source 1..203: mol_type = other DNA
ggcgcgccagtcctagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttcgactcggaccgatg

SEQ ID NO: 1923 - DNA, 203 bp, Homo sapiens
  source 1..203: mol_type = other DNA
ggcgcgccagtcctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaaccttttttcgactcggaccgatg

SEQ ID NO: 1924 - DNA, 203 bp, Homo sapiens
  source 1..203: mol_type = other DNA
ggcgcgccagtccttgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggcgactcggaccgatg

SEQ ID NO: 1925 - DNA, 203 bp, Homo sapiens
  source 1..203: mol_type = other DNA
ggcgcgccagtcctagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagacgactcggaccgatg

SEQ ID NO: 1926 - DNA, 203 bp, Homo sapiens
  source 1..203: mol_type = other DNA
ggcgcgccagtcctgtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtacgactcggaccgatg

SEQ ID NO: 1927 - DNA, 203 bp, Homo sapiens
  source 1..203: mol_type = other DNA
ggcgcgccagtcctggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgcgactcggaccgatg

SEQ ID NO: 1928 - DNA, 203 bp, Homo sapiens
  source 1..203: mol_type = other DNA
ggcgcgccagtcctggaaggggagagaaaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattcgactcggaccgatg

SEQ ID NO: 1929 - DNA, 203 bp, Homo sapiens
  source 1..203: mol_type = other DNA
ggcgcgccagtcctgtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttcgactcggaccgatg

SEQ ID NO: 1930 - DNA, 203 bp, Homo sapiens
  source 1..203: mol_type = other DNA
ggcgcgccagtcctataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaagcgactcggaccgatg

SEQ ID NO: 1931 - DNA, 203 bp, Homo sapiens
  source 1..203: mol_type = other DNA
ggcgcgccagtccttagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattactcgactcggaccgatg

SEQ ID NO: 1932 - DNA, 203 bp, Homo sapiens
  source 1..203: mol_type = other DNA
ggcgcgccagtcctaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacacgactcggaccgatg

SEQ ID NO: 1933 - DNA, 203 bp, Homo sapiens
  source 1..203: mol_type = other DNA
ggcgcgccagtcctataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctccgactcggaccgatg

SEQ ID NO: 1934 - DNA, 203 bp, Homo sapiens
  source 1..203: mol_type = other DNA
ggcgcgccagtcctatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggcaccatcatgactcgactcggaccgatg

SEQ ID NO: 1935 - DNA, 203 bp, Homo sapiens
  source 1..203: mol_type = other DNA
ggcgcgccagtcctccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgccgactcggaccgatg

SEQ ID NO: 1936 - DNA, 203 bp, Homo sapiens
  source 1..203: mol_type = other DNA
ggcgcgccagtccttggcaccccatcccattccagcctagttctggcctcccactttgacgggcacttggaggaggagctgactgtgtgtgtaccagcttcactgggatgtgtttccccagtcaaggaacaggggatcttcagagtcatgaatgttttcttgccagggtcagtgttcccaggaccttacgactcggaccgatg

SEQ ID NO: 1937 - DNA, 203 bp, Homo sapiens
  source 1..203: mol_type = other DNA
ggcgcgccagtcctgtgcatggtcggggcaggaactggtgcatggaggctgctgggacctggtgaacagtgtgtgatttggttgatttggttcactctgacatgatggatgctgctgatggggagtggcgagttggggcaagcgggtggggacaagcataggacttgaaggggagcaggtacacccctcgactcggaccgatg

SEQ ID NO: 1938 - DNA, 203 bp, Homo sapiens
  source 1..203: mol_type = other DNA
ggcgcgccagtcctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgcgactcggaccgatg

SEQ ID NO: 1939 - DNA, 203 bp, Homo sapiens
  source 1..203: mol_type = other DNA
ggcgcgccagtcctggcctccttttcccactgtgccagggaaggtaggtttctctggctgactgagtactgtgagtgaggcaacactgatgccagcatgggtcttacttgactggggagtaggctgagtgaggggtagggtggggtaggtggggagtagtgtggccagggaactggaatccctggtggcgactcggaccgatg

SEQ ID NO: 1940 - DNA, 203 bp, Homo sapiens
  source 1..203: mol_type = other DNA
ggcgcgccagtcctatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtatcgactcggaccgatg

SEQ ID NO: 1941 - DNA, 203 bp, Homo sapiens
  source 1..203: mol_type = other DNA
ggcgcgccagtcctcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccgactcggaccgatg

SEQ ID NO: 1942 - DNA, 203 bp, Homo sapiens
  source 1..203: mol_type = other DNA
ggcgcgccagtcctagcccagtcgccgccgcccgcccacaaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcccctcgtctcgactcggaccgatg

SEQ ID NO: 1943 - DNA, 203 bp, Homo sapiens
  source 1..203: mol_type = other DNA
ggcgcgccagtcctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgccgactcggaccgatg

SEQ ID NO: 1944 - DNA, 203 bp, Homo sapiens
  source 1..203: mol_type = other DNA
ggcgcgccagtcctagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcgactcggaccgatg

SEQ ID NO: 1945 - DNA, 203 bp, Homo sapiens
  source 1..203: mol_type = other DNA
ggcgcgccagtcctcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagacgactcggaccgatg

SEQ ID NO: 1946 - DNA, 203 bp, Homo sapiens
  source 1..203: mol_type = other DNA
ggcgcgccagtccttgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcacgactcggaccgatg

SEQ ID NO: 1947 - DNA, 203 bp, Homo sapiens
  source 1..203: mol_type = other DNA
ggcgcgccagtcctccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggacgactcggaccgatg

SEQ ID NO: 1948 - DNA, 203 bp, Homo sapiens
  source 1..203: mol_type = other DNA
ggcgcgccagtcctctgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtgcgactcggaccgatg

SEQ ID NO: 1949 - DNA, 203 bp, Homo sapiens
  source 1..203: mol_type = other DNA
ggcgcgccagtcctggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcgactcggaccgatg

SEQ ID NO: 1950 - DNA, 203 bp, Homo sapiens
  source 1..203: mol_type = other DNA
ggcgcgccagtcctccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctcgactcggaccgatg

SEQ ID NO: 1951 - DNA, 203 bp, Homo sapiens
  source 1..203: mol_type = other DNA
ggcgcgccagtcctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatcgactcggaccgatg

SEQ ID NO: 1952 - DNA, 203 bp, Homo sapiens
  source 1..203: mol_type = other DNA
ggcgcgccagtcctgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcggcgactcggaccgatg

SEQ ID NO: 1953 - DNA, 203 bp, Homo sapiens
  source 1..203: mol_type = other DNA
ggcgcgccagtcctacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtcgactcggaccgatg

SEQ ID NO: 1954 - DNA, 203 bp, Homo sapiens
  source 1..203: mol_type = other DNA
ggcgcgccagtcctaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaacgactcggaccgatg

SEQ ID NO: 1955 - DNA, 203 bp, Homo sapiens
  source 1..203: mol_type = other DNA
ggcgcgccagtcctaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtcgactcggaccgatg

SEQ ID NO: 1956 - DNA, 203 bp, Homo sapiens
  source 1..203: mol_type = other DNA
ggcgcgccagtcctctggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgactcggaccgatg

SEQ ID NO: 1957 - DNA, 203 bp, Homo sapiens
  source 1..203: mol_type = other DNA
ggcgcgccagtcctctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaacgactcggaccgatg

SEQ ID NO: 1958 - DNA, 203 bp, Homo sapiens
  source 1..203: mol_type = other DNA
ggcgcgccagtcctttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttcgactcggaccgatg

SEQ ID NO: 1959 - DNA, 203 bp, Homo sapiens
  source 1..203: mol_type = other DNA
ggcgcgccagtccttgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtcgactcggaccgatg

SEQ ID NO: 1960 - DNA, 203 bp, Homo sapiens
  source 1..203: mol_type = other DNA
ggcgcgccagtccttagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgccgactcggaccgatg

SEQ ID NO: 1961 - DNA, 203 bp, Homo sapiens
  source 1..203: mol_type = other DNA
ggcgcgccagtccttgcccacacaaaccatcagccaaggggccattgaaaaggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttcgactcggaccgatg

SEQ ID NO: 1962 - DNA, 203 bp, Homo sapiens
  source 1..203: mol_type = other DNA
ggcgcgccagtcctaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacacgactcggaccgatg

SEQ ID NO: 1963 - DNA, 203 bp, Homo sapiens
  source 1..203: mol_type = other DNA
ggcgcgccagtcctacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcgactcggaccgatg

SEQ ID NO: 1964 - DNA, 203 bp, Homo sapiens
  source 1..203: mol_type = other DNA
ggcgcgccagtcctggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttcgactcggaccgatg

SEQ ID NO: 1965 - DNA, 203 bp, Homo sapiens
  source 1..203: mol_type = other DNA
ggcgcgccagtccttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcgactcggaccgatg

SEQ ID NO: 1966 - DNA, 203 bp, Homo sapiens
  source 1..203: mol_type = other DNA
ggcgcgccagtcctgattcaagtgctggctttgcgtccgcttccccatccacttactagcgcaggagaaggctatctcggtccccagagaagcctggacccacacgcgggctagatccagagaacctgacgacccggcgacggcgacgtctcttttgactaaaagacagtgtccagtgctccagcctacgactcggaccgatg

SEQ ID NO: 1967 - DNA, 203 bp, Homo sapiens
  source 1..203: mol_type = other DNA
ggcgcgccagtcctgggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggcgactcggaccgatg

SEQ ID NO: 1968 - DNA, 203 bp, Homo sapiens
  source 1..203: mol_type = other DNA
ggcgcgccagtcctccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgactcggaccgatg

SEQ ID NO: 1969 - DNA, 203 bp, Homo sapiens
  source 1..203: mol_type = other DNA
ggcgcgccagtcctcgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcccgactcggaccgatg

SEQ ID NO: 1970 - DNA, 203 bp, Homo sapiens
  source 1..203: mol_type = other DNA
ggcgcgccagtcctggagcgggaggcggggccacttcaatcctgggcaggggcggttccgtacagggtataaaagctgtccgcgcgggagcccaggccagctttggggttgtccctggacttgtcttggttccagaacctgacgacccggcgacggcgacgtctcttttgactaaaagacagtgtccacgactcggaccgatg

SEQ ID NO: 1971 - DNA, 203 bp, Homo sapiens
  source 1..203: mol_type = other DNA
ggcgcgccagtccttgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgctcgactcggaccgatg

SEQ ID NO: 1972 - DNA, 203 bp, Homo sapiens
  source 1..203: mol_type = other DNA
ggcgcgccagtccttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggcgactcggaccgatg

SEQ ID NO: 1973 - DNA, 203 bp, Homo sapiens
  source 1..203: mol_type = other DNA
ggcgcgccagtcctcgaatctcctggggccgtccgtgccggctcgggccgtcgtggcggctcgagctcctggaacttgctcaggctccggaggtccgaggccctcgaagttatgcgtcgcctccaggcggttgcggcgggcgcgggctcctaaagggcgtcacacccggactccgccgactaggcaaccgactcggaccgatg

SEQ ID NO: 1974 - DNA, 203 bp, Homo sapiens
  source 1..203: mol_type = other DNA
ggcgcgccagtcctctccattcatctttccactgcgcctccggcgcccccgccttctccggtcccctcctcggagtcattttttcctgttccccctctgccgccctttcctcacgccccgggtgaggcaattctcttggaagcgaaggtgtcggctatgagccggagcctccttccttgaatttctcccgactcggaccgatg

SEQ ID NO: 1975 - DNA, 203 bp, Homo sapiens
  source 1..203: mol_type = other DNA
ggcgcgccagtcctctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggacgactcggaccgatg

SEQ ID NO: 1976 - DNA, 203 bp, Homo sapiens
  source 1..203: mol_type = other DNA
ggcgcgccagtcctttgatgccatcatgacacagcttcgtcaggagggttggattcatcatctagccaggcatgcagttgcttgcttcctgacacgaggggacctgtggattagttgggaagaaggaatgaaggtatttgaagaattattgcttgatgcagattggagcataaatgctggaagttggacgactcggaccgatg

SEQ ID NO: 1977 - DNA, 203 bp, Homo sapiens
  source 1..203: mol_type = other DNA
ggcgcgccagtccttgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggcgactcggaccgatg

SEQ ID NO: 1978 - DNA, 203 bp, Homo sapiens
  source 1..203: mol_type = other DNA
ggcgcgccagtccttctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaagggcgactcggaccgatg

SEQ ID NO: 1979 - DNA, 203 bp, Homo sapiens
  source 1..203: mol_type = other DNA
ggcgcgccagtccttgtatggatgatgtgtatggaggtacaaacaggtacttcaggcaagtggcatctgaatttggattaaagatttcttttgttgattgttccaaaatcaaattactagaggcagcaattacaccagaaaccaagcgccctttggctctgggagctgatatttctatgtattctgcacgactcggaccgatg

SEQ ID NO: 1980 - DNA, 203 bp, Homo sapiens
  source 1..203: mol_type = other DNA
ggcgcgccagtcctgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccggcgactcggaccgatg

SEQ ID NO: 1981 - DNA, 203 bp, Homo sapiens
  source 1..203: mol_type = other DNA
ggcgcgccagtcctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggcgactcggaccgatg

SEQ ID NO: 1982 - DNA, 203 bp, Homo sapiens
  source 1..203: mol_type = other DNA
ggcgcgccagtcctagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggaccgactcggaccgatg

SEQ ID NO: 1983 - DNA, 203 bp, Homo sapiens
  source 1..203: mol_type = other DNA
ggcgcgccagtcctagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggccgactcggaccgatg

SEQ ID NO: 1984 - DNA, 203 bp, Homo sapiens
  source 1..203: mol_type = other DNA
ggcgcgccagtcctaggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggctctgtgtgctccgggatggagcaggtgtgcgactcggaccgatg

SEQ ID NO: 1985 - DNA, 203 bp, Homo sapiens
  source 1..203: mol_type = other DNA
ggcgcgccagtcctcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccacgactcggaccgatg

SEQ ID NO: 1986 - DNA, 203 bp, Homo sapiens
  source 1..203: mol_type = other DNA
ggcgcgccagtcctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacccgactcggaccgatg

SEQ ID NO: 1987 - DNA, 203 bp, Homo sapiens
  source 1..203: mol_type = other DNA
ggcgcgccagtcctaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaaccgactcggaccgatg

SEQ ID NO: 1988 - DNA, 203 bp, Homo sapiens
  source 1..203: mol_type = other DNA
ggcgcgccagtcctccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtcgactcggaccgatg

SEQ ID NO: 1989 - DNA, 203 bp, Homo sapiens
  source 1..203: mol_type = other DNA
ggcgcgccagtcctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgccgactcggaccgatg

SEQ ID NO: 1990 - DNA, 203 bp, Homo sapiens
  source 1..203: mol_type = other DNA
ggcgcgccagtcctctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggacgactcggaccgatg

SEQ ID NO: 1991 - DNA, 203 bp, Homo sapiens
  source 1..203: mol_type = other DNA
ggcgcgccagtcctttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcaccgactcggaccgatg

SEQ ID NO: 1992 - DNA, 203 bp, Homo sapiens
  source 1..203: mol_type = other DNA
ggcgcgccagtcctgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccgactcggaccgatg

SEQ ID NO: 1993 - DNA, 203 bp, Homo sapiens
  source 1..203: mol_type = other DNA
ggcgcgccagtcctaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtgcgactcggaccgatg

SEQ ID NO: 1994 - DNA, 203 bp, Homo sapiens
  source 1..203: mol_type = other DNA
ggcgcgccagtcctgctcgcgcctcttaggcttggcggtggcggcggcggcagcttcgcgccgaatccccggggagcggcggtggcggcgtcctggggccaggaggagcgaacacctgccgcggtcctcccgccggcgctggggattctcattctgtctcccatgctggagtgcagtggcgcggtcttcgactcggaccgatg

SEQ ID NO: 1995 - DNA, 203 bp, Homo sapiens
  source 1..203: mol_type = other DNA
ggcgcgccagtcctcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtcgactcggaccgatg

SEQ ID NO: 1996 - DNA, 203 bp, Homo sapiens
  source 1..203: mol_type = other DNA
ggcgcgccagtcctgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggacgactcggaccgatg

SEQ ID NO: 1997 - DNA, 203 bp, Homo sapiens
  source 1..203: mol_type = other DNA
ggcgcgccagtcctagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattcgactcggaccgatg

SEQ ID NO: 1998 - DNA, 203 bp, Homo sapiens
  source 1..203: mol_type = other DNA
ggcgcgccagtcctaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccaccgactcggaccgatg

SEQ ID NO: 1999 - DNA, 203 bp, Homo sapiens
  source 1..203: mol_type = other DNA
ggcgcgccagtcctatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagatcgactcggaccgatg

SEQ ID NO: 2000 - DNA, 203 bp, Homo sapiens
  source 1..203: mol_type = other DNA
ggcgcgccagtccttcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtcgactcggaccgatg

SEQ ID NO: 2001 - DNA, 203 bp, Homo sapiens
  source 1..203: mol_type = other DNA
ggcgcgccagtcctgatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtacgactcggaccgatg

SEQ ID NO: 2002 - DNA, 203 bp, Homo sapiens
  source 1..203: mol_type = other DNA
ggcgcgccagtcctcttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtcgactcggaccgatg

SEQ ID NO: 2003 - DNA, 203 bp, Homo sapiens
  source 1..203: mol_type = other DNA
ggcgcgccagtcctcaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccgactcggaccgatg

SEQ ID NO: 2004 - DNA, 203 bp, Homo sapiens
  source 1..203: mol_type = other DNA
ggcgcgccagtcctcccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcgactcggaccgatg

SEQ ID NO: 2005 - DNA, 203 bp, Homo sapiens
  source 1..203: mol_type = other DNA
ggcgcgccagtcctcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtcgactcggaccgatg

SEQ ID NO: 2006 - DNA, 203 bp, Homo sapiens
  source 1..203: mol_type = other DNA
ggcgcgccagtcctgccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacgactcggaccgatg

SEQ ID NO: 2007 - DNA, 203 bp, Homo sapiens
  source 1..203: mol_type = other DNA
ggcgcgccagtcctaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcgactcggaccgatg

SEQ ID NO: 2008 - DNA, 203 bp, Homo sapiens
  source 1..203: mol_type = other DNA
ggcgcgccagtcctgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagcgactcggaccgatg

SEQ ID NO: 2009 - DNA, 203 bp, Homo sapiens
  source 1..203: mol_type = other DNA
ggcgcgccagtcctagatgggggtgccgggaggagcggatgcagctggagcggctcccttggggtgccgagtggcaggtggggggcggtgagggtccttgagggcgggccttagagtcttcagaagggcaggactctgagggctttttggagctcgctatgcttaacctggagatgattaaggccccgcgactcggaccgatg

SEQ ID NO: 2010 - DNA, 203 bp, Homo sapiens
  source 1..203: mol_type = other DNA
ggcgcgccagtcctctttttttgttcactgtgcagggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagcgactcggaccgatg

SEQ ID NO: 2011 - DNA, 203 bp, Homo sapiens
  source 1..203: mol_type = other DNA
ggcgcgccagtccttcatttagtgtttgggatacctgttaagccctttgtccagggactgtggttggatttatgaattatttggacggttgtccacttgaaagaactgacagtagcttcataacaatgttacaaatctcgttctaagattaagctgttgaacctatatttgccattagcgcttaatttcgactcggaccgatg

SEQ ID NO: 2012 - DNA, 203 bp, Homo sapiens
  source 1..203: mol_type = other DNA
ggcgcgccagtcctttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtagcttgccaacgactcggaccgatg

SEQ ID NO: 2013 - DNA, 203 bp, Homo sapiens
  source 1..203: mol_type = other DNA
ggcgcgccagtcctctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaaatgatcccttattgatgacacagtattttacgactcggaccgatg

SEQ ID NO: 2014 - DNA, 203 bp, Homo sapiens
  source 1..203: mol_type = other DNA
ggcgcgccagtccttgtctagtacacctgctccgaagtatttgaaaatattgccttctggtcttaagtataatgcaagacatccttctaccaaggtaatgaagcaaatggatataggtgtgtattttggactacctcccaaaagaaaggaagagaaattgctaggggaaagtgcattagaagggataacgactcggaccgatg

SEQ ID NO: 2015 - DNA, 203 bp, Homo sapiens
  source 1..203: mol_type = other DNA
ggcgcgccagtccttcagagcagatcccagcatggaacgttctcttcttgcggaccagaaagtccatatgctgtacttagataccacatattgtagcccagaatacacctttccatctcagcaagaggttatccggtttgccatcaacactgcctttgaggctgtaactctaaacccacatgctcttgcgactcggaccgatg

SEQ ID NO: 2016 - DNA, 203 bp, Homo sapiens
  source 1..203: mol_type = other DNA
ggcgcgccagtcctttgtctgtggcacttactctattggaaaagagaaagtcttcctagccattgctgatgttttaggttcaaaagtgggcatgtcccaggaaaaatataaaactctacagtgcctcaatataccagaaattaattcactcatcactaccgacatgtgcagttcattggttcaccttccgactcggaccgatg

SEQ ID NO: 2017 - DNA, 203 bp, Homo sapiens
  source 1..203: mol_type = other DNA
ggcgcgccagtcctcttacagtgaacacagcagctacctagaaatgaagcgctttgtccagtggctgaagccccagaaaatcatacctactgtaaatgtgggcacctggaaatctaggagcacaatggagaaatattttagagagtggaaattggaagctggatattgatgatacctccgaggattcacgactcggaccgatg

SEQ ID NO: 2018 - DNA, 203 bp, Homo sapiens
  source 1..203: mol_type = other DNA
ggcgcgccagtcctgattcgacacggcactggcagcgggaacttgttcccgccaagaccctaaagggattgttcattgctgctggaggaagatcatggactgtcgcgggaaactgaagtggttgagtatccactagtcgtggatgagggcagtgacttcgcagttttttgcgaattacacatctctttcgactcggaccgatg

SEQ ID NO: 2019 - DNA, 203 bp, Homo sapiens
  source 1..203: mol_type = other DNA
ggcgcgccagtcctaatgataaaatcattttgccatgttagaagacatttccgaagaagacatttgggaatacaaatctaaaagaaaaccaaaacgagttgatccaaataatggctctaaaaatattctaaaatctgttgaaaaagcaacagatggaaaataccagtcaaaacggagtagaaacagaacgactcggaccgatg

SEQ ID NO: 2020 - DNA, 203 bp, Homo sapiens
  source 1..203: mol_type = other DNA
ggcgcgccagtcctattacaagagatacactcacttcctgctagctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaacgactcggaccgatg

SEQ ID NO: 2021 - DNA, 203 bp, Homo sapiens
  source 1..203: mol_type = other DNA
ggcgcgccagtcctcagtttattgtagtgagataactggcaatttgttgaagaacaagcttcatgtgcaagaacaatatattcacccattgccactggacactgaatgtattgtgaatggtgtcaaagttgttttgcttgatgccaatcactgtccaggtgctgtcatgatcctcttttatcttcctacgactcggaccgatg

SEQ ID NO: 2022 - DNA, 203 bp, Homo sapiens
  source 1..203: mol_type = other DNA
ggcgcgccagtcctaatgcctctcagcatcatcaaggataactgaaactgggtctccctgggacccttaatttcttgtcccctgccctccatgggcagttatattctgcatcaagccttagaagaggaagcaaaggcagattcagggaccaaaaggattaatgataattaataaagtagtttgaagcacgactcggaccgatg

SEQ ID NO: 2023 - DNA, 203 bp, Homo sapiens
  source 1..203: mol_type = other DNA
ggcgcgccagtcctatagagcggctcccagcgttccctgcggcgtaggaggcggtccagactataaaagcggctgccggaaagcggccggcacctcattcatttctaccggtctctagtagtgcagcttcggctggtgtcatcggtgtccttcctccgctgccgcccccgcaaggcttcgccgtcatccgactcggaccgatg

SEQ ID NO: 2024 - DNA, 203 bp, Homo sapiens
  source 1..203: mol_type = other DNA
ggcgcgccagtccttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagcccgactcggaccgatg

SEQ ID NO: 2025 - DNA, 203 bp, Homo sapiens
  source 1..203: mol_type = other DNA
ggcgcgccagtccttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggcgactcggaccgatg

SEQ ID NO: 2026 - DNA, 203 bp, Homo sapiens
  source 1..203: mol_type = other DNA
ggcgcgccagtcctaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtcgactcggaccgatg

SEQ ID NO: 2027 - DNA, 203 bp, Homo sapiens
  source 1..203: mol_type = other DNA
ggcgcgccagtcctggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagacgactcggaccgatg

SEQ ID NO: 2028 - DNA, 203 bp, Homo sapiens
  source 1..203: mol_type = other DNA
ggcgcgccagtcctaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgcgactcggaccgatg

SEQ ID NO: 2029 - DNA, 203 bp, Homo sapiens
  source 1..203: mol_type = other DNA
ggcgcgccagtcctggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcaccgactcggaccgatg

SEQ ID NO: 2030 - DNA, 203 bp, Homo sapiens
  source 1..203: mol_type = other DNA
ggcgcgccagtccttttttttttgccagaagagaggtcttcaggagacttcatttaaattctgattattaaactgaggctttaattgatgttaatgccttatgtcaaatgtaaagttagaatttgctagggctgggatagggagtgatatttctaggacttagacattgaaaactaattcagcctgtacgactcggaccgatg

SEQ ID NO: 2031 - DNA, 203 bp, Homo sapiens
  source 1..203: mol_type = other DNA
ggcgcgccagtccttgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagcgactcggaccgatg

SEQ ID NO: 2032 - DNA, 203 bp, Homo sapiens
  source 1..203: mol_type = other DNA
ggcgcgccagtccttcccaaccacctttccatccccagcccctctcatccctggagcactctgccgctcaagagctggtttgttaattattgttagactttgccattgttttcttttgtacctgaagcattttgaaaataaagtttacttaagttatgcttgtttttctaaaaaaaaaaaaaaaaaaacgactcggaccgatg

SEQ ID NO: 2033 - DNA, 203 bp, Homo sapiens
  source 1..203: mol_type = other DNA
ggcgcgccagtcctgtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcatcactgccttgatcaacgtctcagcgactcggaccgatg

SEQ ID NO: 2034 - DNA, 203 bp, Homo sapiens
  source 1..203: mol_type = other DNA
ggcgcgccagtcctccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggaccgactcggaccgatg

SEQ ID NO: 2035 - DNA, 203 bp, Homo sapiens
  source 1..203: mol_type = other DNA
ggcgcgccagtccttacctggaagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttccgactcggaccgatg

SEQ ID NO: 2036 - DNA, 203 bp, Homo sapiens
  source 1..203: mol_type = other DNA
ggcgcgccagtccttgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatatcgactcggaccgatg

SEQ ID NO: 2037 - DNA, 203 bp, Homo sapiens
  source 1..203: mol_type = other DNA
ggcgcgccagtcctagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaatcgactcggaccgatg

SEQ ID NO: 2038 - DNA, 203 bp, Homo sapiens
  source 1..203: mol_type = other DNA
ggcgcgccagtcctctgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccgactcggaccgatg

SEQ ID NO: 2039 - DNA, 203 bp, Homo sapiens
  source 1..203: mol_type = other DNA
ggcgcgccagtcctcctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttcgactcggaccgatg

SEQ ID NO: 2040 - DNA, 203 bp, Homo sapiens
  source 1..203: mol_type = other DNA
ggcgcgccagtcctgagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatcgactcggaccgatg

SEQ ID NO: 2041 - DNA, 203 bp, Homo sapiens
  source 1..203: mol_type = other DNA
ggcgcgccagtccttctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctcgactcggaccgatg

SEQ ID NO: 2042 - DNA, 203 bp, Homo sapiens
  source 1..203: mol_type = other DNA
ggcgcgccagtcctcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggcgactcggaccgatg

SEQ ID NO: 2043 - DNA, 203 bp, Homo sapiens
  source 1..203: mol_type = other DNA
ggcgcgccagtcctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcattcgactcggaccgatg

SEQ ID NO: 2044 - DNA, 203 bp, Homo sapiens
  source 1..203: mol_type = other DNA
ggcgcgccagtcctgtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatcgactcggaccgatg

SEQ ID NO: 2045 - DNA, 203 bp, Homo sapiens
  source 1..203: mol_type = other DNA
ggcgcgccagtcctggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgcgactcggaccgatg

SEQ ID NO: 2046 - DNA, 203 bp, Homo sapiens
  source 1..203: mol_type = other DNA
ggcgcgccagtcctgctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgccgactcggaccgatg

SEQ ID NO: 2047 - DNA, 203 bp, Homo sapiens
  source 1..203: mol_type = other DNA
ggcgcgccagtcctgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttgcgactcggaccgatg

SEQ ID NO: 2048 - DNA, 203 bp, Homo sapiens
  source 1..203: mol_type = other DNA
ggcgcgccagtcctctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccccgactcggaccgatg

SEQ ID NO: 2049 - DNA, 203 bp, Homo sapiens
  source 1..203: mol_type = other DNA
ggcgcgccagtccttccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgactcggaccgatg

SEQ ID NO: 2050 - DNA, 203 bp, Homo sapiens
  source 1..203: mol_type = other DNA
ggcgcgccagtcctcgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgcgactcggaccgatg

SEQ ID NO: 2051 - DNA, 203 bp, Homo sapiens
  source 1..203: mol_type = other DNA
ggcgcgccagtcctcagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctgggcgactcggaccgatg

SEQ ID NO: 2052 - DNA, 203 bp, Homo sapiens
  source 1..203: mol_type = other DNA
ggcgcgccagtccttcacttgcctgaaaccggctcctcgacggccgccgcccgcctggccttttagggcctgactcccgcccttcctggcctacactcctgggcggcggcaggcctagcttctggcccagtgcgggttccccggcggcaggcgtatcctgtgtgcccctgggccaggcccgaacccggcgactcggaccgatg

SEQ ID NO: 2053 - DNA, 203 bp, Homo sapiens
  source 1..203: mol_type = other DNA
ggcgcgccagtccttctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgccgactcggaccgatg

SEQ ID NO: 2054 - DNA, 203 bp, Homo sapiens
  source 1..203: mol_type = other DNA
ggcgcgccagtcctagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctcccccgactcggaccgatg

SEQ ID NO: 2055 - DNA, 203 bp, Homo sapiens
  source 1..203: mol_type = other DNA
ggcgcgccagtcctagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccgactcggaccgatg

SEQ ID NO: 2056 - DNA, 203 bp, Homo sapiens
  source 1..203: mol_type = other DNA
ggcgcgccagtcctcatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggcgactcggaccgatg

SEQ ID NO: 2057 - DNA, 203 bp, Homo sapiens
  source 1..203: mol_type = other DNA
ggcgcgccagtcctaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccgactcggaccgatg

SEQ ID NO: 2058 - DNA, 203 bp, Homo sapiens
  source 1..203: mol_type = other DNA
ggcgcgccagtcctcagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccgactcggaccgatg

SEQ ID NO: 2059 - DNA, 203 bp, Homo sapiens
  source 1..203: mol_type = other DNA
ggcgcgccagtcctaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtcgactcggaccgatg

SEQ ID NO: 2060 - DNA, 203 bp, Homo sapiens
  source 1..203: mol_type = other DNA
ggcgcgccagtccttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttgcgactcggaccgatg

SEQ ID NO: 2061 - DNA, 203 bp, Homo sapiens
  source 1..203: mol_type = other DNA
ggcgcgccagtcctacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatcgactcggaccgatg

SEQ ID NO: 2062 - DNA, 203 bp, Homo sapiens
  source 1..203: mol_type = other DNA
ggcgcgccagtcctagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgcgactcggaccgatg

SEQ ID NO: 2063 - DNA, 203 bp, Homo sapiens
  source 1..203: mol_type = other DNA
ggcgcgccagtcctgagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatcgactcggaccgatg

SEQ ID NO: 2064 - DNA, 203 bp, Homo sapiens
  source 1..203: mol_type = other DNA
ggcgcgccagtcctctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgtcgactcggaccgatg

SEQ ID NO: 2065 - DNA, 203 bp, Homo sapiens
  source 1..203: mol_type = other DNA
ggcgcgccagtccttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctggcgactcggaccgatg

SEQ ID NO: 2066 - DNA, 203 bp, Homo sapiens
  source 1..203: mol_type = other DNA
ggcgcgccagtccttccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggcgactcggaccgatg

SEQ ID NO: 2067 - DNA, 203 bp, Homo sapiens
  source 1..203: mol_type = other DNA
ggcgcgccagtcctgcagacggcaaccgggccgctgattgggcggcgaaggagccattcggggagactctggtgggttcggctgccccaagagtgataagttcggcttcagacacgccttagcgccagcagtgagtcggagctctatggaggtggcagcgggtaccgagtggcggctgcagcagcgaccgactcggaccgatg

SEQ ID NO: 2068 - DNA, 203 bp, Homo sapiens
  source 1..203: mol_type = other DNA
ggcgcgccagtcctgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaacgactcggaccgatg

SEQ ID NO: 2069 - DNA, 203 bp, Homo sapiens
  source 1..203: mol_type = other DNA
ggcgcgccagtcctattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattcgactcggaccgatg

SEQ ID NO: 2070 - DNA, 203 bp, Homo sapiens
  source 1..203: mol_type = other DNA
ggcgcgccagtcctccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaacgactcggaccgatg

SEQ ID NO: 2071 - DNA, 203 bp, Homo sapiens
  source 1..203: mol_type = other DNA
ggcgcgccagtcctacttccctaacttgcgcctgggtgggaggaatgctccgctcttttgttcccaggaagggaaaaacggggcggaggttcctgctgccatgttgtggccctggtcttccgcctgcaagtgctagtcctgtacacccggccccctctcgcgcgtctttccacgagctctccacggggcgactcggaccgatg

SEQ ID NO: 2072 - DNA, 203 bp, Homo sapiens
  source 1..203: mol_type = other DNA
ggcgcgccagtcctaggaggcgaaagggtggacaggggaaaactgctgaagagctttcggagagacctcatctagtcgctggcctcgtcaaggcagtaaaaattcctagggcagacattttccacgtgatgttgctcgtgtctgtagttagacttttctattgatctcagtgctcagttttaaagatacgactcggaccgatg

SEQ ID NO: 2073 - DNA, 203 bp, Homo sapiens
  source 1..203: mol_type = other DNA
ggcgcgccagtcctagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaacgactcggaccgatg

SEQ ID NO: 2074 - DNA, 203 bp, Homo sapiens
  source 1..203: mol_type = other DNA
ggcgcgccagtcctttacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcgactcggaccgatg

SEQ ID NO: 2075 - DNA, 203 bp, Homo sapiens
  source 1..203: mol_type = other DNA
ggcgcgccagtccttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggcgactcggaccgatg

SEQ ID NO: 2076 - DNA, 203 bp, Homo sapiens
  source 1..203: mol_type = other DNA
ggcgcgccagtcctgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaacgactcggaccgatg

SEQ ID NO: 2077 - DNA, 203 bp, Homo sapiens
  source 1..203: mol_type = other DNA
ggcgcgccagtcctctactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttccgactcggaccgatg

SEQ ID NO: 2078 - DNA, 203 bp, Homo sapiens
  source 1..203: mol_type = other DNA
ggcgcgccagtcctccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccatcgactcggaccgatg

SEQ ID NO: 2079 - DNA, 203 bp, Homo sapiens
  source 1..203: mol_type = other DNA
ggcgcgccagtccttcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaacccgactcggaccgatg

SEQ ID NO: 2080 - DNA, 203 bp, Homo sapiens
  source 1..203: mol_type = other DNA
ggcgcgccagtcctaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgccgactcggaccgatg

SEQ ID NO: 2081 - DNA, 203 bp, Homo sapiens
  source 1..203: mol_type = other DNA
ggcgcgccagtcctatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgcgactcggaccgatg

SEQ ID NO: 2082 - DNA, 203 bp, Homo sapiens
  source 1..203: mol_type = other DNA
ggcgcgccagtcctaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaacgactcggaccgatg

SEQ ID NO: 2083 - DNA, 203 bp, Homo sapiens
  source 1..203: mol_type = other DNA
ggcgcgccagtcctggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaacgactcggaccgatg

SEQ ID NO: 2084 - DNA, 203 bp, Homo sapiens
  source 1..203: mol_type = other DNA
ggcgcgccagtcctactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaatcgactcggaccgatg

SEQ ID NO: 2085 - DNA, 203 bp, Homo sapiens
  source 1..203: mol_type = other DNA
ggcgcgccagtcctgggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcgactcggaccgatg

SEQ ID NO: 2086 - DNA, 203 bp, Homo sapiens
  source 1..203: mol_type = other DNA
ggcgcgccagtcctcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcaccgactcggaccgatg

SEQ ID NO: 2087 - DNA, 203 bp, Homo sapiens
  source 1..203: mol_type = other DNA
ggcgcgccagtcctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagacgactcggaccgatg

SEQ ID NO: 2088 - DNA, 203 bp, Homo sapiens
  source 1..203: mol_type = other DNA
ggcgcgccagtccttgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaacgactcggaccgatg

SEQ ID NO: 2089 - DNA, 203 bp, Homo sapiens
  source 1..203: mol_type = other DNA
ggcgcgccagtcctcaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcgactcggaccgatg

SEQ ID NO: 2090 - DNA, 203 bp, Homo sapiens
  source 1..203: mol_type = other DNA
ggcgcgccagtcctacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccgactcggaccgatg

SEQ ID NO: 2091 - DNA, 203 bp, Homo sapiens
  source 1..203: mol_type = other DNA
ggcgcgccagtcctgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccacgactcggaccgatg

SEQ ID NO: 2092 - DNA, 203 bp, Homo sapiens
  source 1..203: mol_type = other DNA
ggcgcgccagtcctacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaaccgactcggaccgatg

SEQ ID NO: 2093 - DNA, 203 bp, Homo sapiens
  source 1..203: mol_type = other DNA
ggcgcgccagtcctgagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccgactcggaccgatg

SEQ ID NO: 2094 - DNA, 203 bp, Homo sapiens
  source 1..203: mol_type = other DNA
ggcgcgccagtcctcatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcgactcggaccgatg

SEQ ID NO: 2095 - DNA, 203 bp, Homo sapiens
  source 1..203: mol_type = other DNA
ggcgcgccagtcctaactctggatcctcgaattttgcctcgaggaccagactttacaccagcctttgctgattttggaaggcagacacctggtggaagaggcgtacctatttgcaaagtgcagagcaggcatggattgccaattctggaacagagcaaagccccaacttgccctccactggtgatgtccgactcggaccgatg

SEQ ID NO: 2096 - DNA, 203 bp, Homo sapiens
  source 1..203: mol_type = other DNA
ggcgcgccagtcctacacccacccatgaagagcctgcctctagggttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgactcggaccgatg

SEQ ID NO: 2097 - DNA, 203 bp, Homo sapiens
  source 1..203: mol_type = other DNA
ggcgcgccagtcctgaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctcgactcggaccgatg

SEQ ID NO: 2098 - DNA, 203 bp, Homo sapiens
  source 1..203: mol_type = other DNA
ggcgcgccagtccttgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggcgactcggaccgatg

SEQ ID NO: 2099 - DNA, 203 bp, Homo sapiens
  source 1..203: mol_type = other DNA
ggcgcgccagtcctacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaacgactcggaccgatg

SEQ ID NO: 2100 - DNA, 203 bp, Homo sapiens
  source 1..203: mol_type = other DNA
ggcgcgccagtccttactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttccgactcggaccgatg

SEQ ID NO: 2101 - DNA, 203 bp, Homo sapiens
  source 1..203: mol_type = other DNA
ggcgcgccagtcctcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccccgactcggaccgatg

SEQ ID NO: 2102 - DNA, 203 bp, Homo sapiens
  source 1..203: mol_type = other DNA
ggcgcgccagtcctgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgtttcgactcggaccgatg

SEQ ID NO: 2103 - DNA, 203 bp, Homo sapiens
  source 1..203: mol_type = other DNA
ggcgcgccagtcctttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccgactcggaccgatg

SEQ ID NO: 2104 - DNA, 203 bp, Homo sapiens
  source 1..203: mol_type = other DNA
ggcgcgccagtcctagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgccgactcggaccgatg

SEQ ID NO: 2105 - DNA, 203 bp, Homo sapiens
  source 1..203: mol_type = other DNA
ggcgcgccagtccttaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcacgactcggaccgatg

SEQ ID NO: 2106 - DNA, 203 bp, Homo sapiens
  source 1..203: mol_type = other DNA
ggcgcgccagtcctgagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcgactcggaccgatg

SEQ ID NO: 2107 - DNA, 203 bp, Homo sapiens
  source 1..203: mol_type = other DNA
ggcgcgccagtcctaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatcgactcggaccgatg

SEQ ID NO: 2108 - DNA, 203 bp, Homo sapiens
  source 1..203: mol_type = other DNA
ggcgcgccagtccttctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtaccgactcggaccgatg

SEQ ID NO: 2109 - DNA, 203 bp, Homo sapiens
  source 1..203: mol_type = other DNA
ggcgcgccagtcctgagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactcgactcggaccgatg

SEQ ID NO: 2110 - DNA, 203 bp, Homo sapiens
  source 1..203: mol_type = other DNA
ggcgcgccagtcctggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggaccgactcggaccgatg

SEQ ID NO: 2111 - DNA, 203 bp, Homo sapiens
  source 1..203: mol_type = other DNA
ggcgcgccagtccttgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaacgactcggaccgatg

SEQ ID NO: 2112 - DNA, 203 bp, Homo sapiens
  source 1..203: mol_type = other DNA
ggcgcgccagtcctctatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcccgactcggaccgatg

SEQ ID NO: 2113 - DNA, 203 bp, Homo sapiens
  source 1..203: mol_type = other DNA
ggcgcgccagtccttcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtacgactcggaccgatg

SEQ ID NO: 2114 - DNA, 203 bp, Homo sapiens
  source 1..203: mol_type = other DNA
ggcgcgccagtcctcggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatcgactcggaccgatg

SEQ ID NO: 2115 - DNA, 203 bp, Homo sapiens
  source 1..203: mol_type = other DNA
ggcgcgccagtccttgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagccgactcggaccgatg

SEQ ID NO: 2116 - DNA, 203 bp, Homo sapiens
  source 1..203: mol_type = other DNA
ggcgcgccagtccttaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggcgactcggaccgatg

SEQ ID NO: 2117 - DNA, 203 bp, Homo sapiens
  source 1..203: mol_type = other DNA
ggcgcgccagtcctagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccggtctctggaacagctcatcgccgcgactcggaccgatg

SEQ ID NO: 2118 - DNA, 203 bp, Homo sapiens
  source 1..203: mol_type = other DNA
ggcgcgccagtcctcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctgctggctgcgctgcgactcggaccgatg

SEQ ID NO: 2119 - DNA, 203 bp, Homo sapiens
  source 1..203: mol_type = other DNA
ggcgcgccagtcctgtggcggccctggcatctcctcttggggcactgtctctggcatccggctttcctgactctgcttcttcctcttcttggtggatcccggagttgccctggcttcaggctgtccctcccctggcagttcaggctctagtggctgaattggctcagtcactgtgtgacctctctcttcgactcggaccgatg

SEQ ID NO: 2120 - DNA, 203 bp, Homo sapiens
  source 1..203: mol_type = other DNA
ggcgcgccagtcctctggctgttgaggcgccatggtcccccctggggactccagaggcttcatctccggctccactggctccatcgcctccgtccctggctccatcattgccatctgtcccttttcttttttcctcttcttcgtagggggcagagggatggcttcctccagtggctccaccttcacctcgactcggaccgatg

SEQ ID NO: 2121 - DNA, 203 bp, Homo sapiens
  source 1..203: mol_type = other DNA
ggcgcgccagtcctgtggctgagactcaactgtcaccccctcctctggctccatcccttccgtccccttttgcctctttctctttttggtcggggacaggactgtgtcttctagaggctcagtgttaatctgttcctgcttcactgtcttgtcttctggctcgaaggtttctttccctttgggcttctcgactcggaccgatg

SEQ ID NO: 2122 - DNA, 203 bp, Homo sapiens
  source 1..203: mol_type = other DNA
ggcgcgccagtccttcctcttcttggtggtggacgggaacagcactcccagaggctccagtgtctccactgtgggctctgtccccacaggccctgctgcctctggttctttcagctgctgattttttttcttcttcttcttccgcacatccatttctggcgaccccaaagccatgtccacctccagggcgactcggaccgatg

SEQ ID NO: 2123 - DNA, 203 bp, Homo sapiens
  source 1..203: mol_type = other DNA
ggcgcgccagtcctccccgtgcccattcactgcctcctgagtgactggggcctctgtcacctgcatctcctttttcttcttccctgaggtgagcaggttgggggccaaggctgacctaggccctgtgactggtgggttgcccccaaaggcacagaaccgaggcctcaggccaggagggatctgtggtgcgactcggaccgatg

SEQ ID NO: 2124 - DNA, 203 bp, Homo sapiens
  source 1..203: mol_type = other DNA
ggcgcgccagtcctggggacttgctgggatgggctgcagagggctccctgacagggattgctggggaccctcaaggatccttagggtgccctggggggctgaggcacaggtgagtccacctcctgcctccgttgagggggccagcagggtcgcttctccagcttggggacagctgctgaggactcgatcgactcggaccgatg

SEQ ID NO: 2125 - DNA, 203 bp, Homo sapiens
  source 1..203: mol_type = other DNA
ggcgcgccagtcctgcctaggctggagtgcagtggcatgatctcggctcactgcaatgtccacctcctgggttcaagcgattctcctgcctcagcctctcaagtagctgggattacaggcacctgccaccacgcccagccaatttttgtatttttagtagagacaatttcactatgttggccaggctgcgactcggaccgatg

SEQ ID NO: 2126 - DNA, 203 bp, Homo sapiens
  source 1..203: mol_type = other DNA
ggcgcgccagtcctgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttcccgactcggaccgatg

SEQ ID NO: 2127 - DNA, 203 bp, Homo sapiens
  source 1..203: mol_type = other DNA
ggcgcgccagtcctaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgcgactcggaccgatg

SEQ ID NO: 2128 - DNA, 203 bp, Homo sapiens
  source 1..203: mol_type = other DNA
ggcgcgccagtcctagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagtaagagctctggcgactcggaccgatg

SEQ ID NO: 2129 - DNA, 203 bp, Homo sapiens
  source 1..203: mol_type = other DNA
ggcgcgccagtcctgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaacgactcggaccgatg

SEQ ID NO: 2130 - DNA, 203 bp, Homo sapiens
  source 1..203: mol_type = other DNA
ggcgcgccagtcctaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactcgactcggaccgatg

SEQ ID NO: 2131 - DNA, 203 bp, Homo sapiens
  source 1..203: mol_type = other DNA
ggcgcgccagtcctcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtcgactcggaccgatg

SEQ ID NO: 2132 - DNA, 203 bp, Homo sapiens
  source 1..203: mol_type = other DNA
ggcgcgccagtcctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatcgactcggaccgatg

SEQ ID NO: 2133 - DNA, 203 bp, Homo sapiens
  source 1..203: mol_type = other DNA
ggcgcgccagtcctgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagcgactcggaccgatg

SEQ ID NO: 2134 - DNA, 203 bp, Homo sapiens
  source 1..203: mol_type = other DNA
ggcgcgccagtcctttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcaccgactcggaccgatg

SEQ ID NO: 2135 - DNA, 203 bp, Homo sapiens
  source 1..203: mol_type = other DNA
ggcgcgccagtcctctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaaccgactcggaccgatg

SEQ ID NO: 2136 - DNA, 203 bp, Homo sapiens
  source 1..203: mol_type = other DNA
ggcgcgccagtcctagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttacgactcggaccgatg

SEQ ID NO: 2137 - DNA, 203 bp, Homo sapiens
  source 1..203: mol_type = other DNA
ggcgcgccagtccttgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattcgactcggaccgatg

SEQ ID NO: 2138 - DNA, 203 bp, Homo sapiens
  source 1..203: mol_type = other DNA
ggcgcgccagtccttgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgcgactcggaccgatg

SEQ ID NO: 2139 - DNA, 203 bp, Homo sapiens
  source 1..203: mol_type = other DNA
ggcgcgccagtcctctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtcgactcggaccgatg

SEQ ID NO: 2140 - DNA, 203 bp, Homo sapiens
  source 1..203: mol_type = other DNA
ggcgcgccagtcctgcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagccgactcggaccgatg

SEQ ID NO: 2141 - DNA, 203 bp, Homo sapiens
  source 1..203: mol_type = other DNA
ggcgcgccagtcctggaaattatgccaccaaattcccttccttccaataattcaagggttggacctaatgccccagaagaaaaaaaacatttagatataaaggaaaacagcacccatttttctcaacctaacagtacaaaagtccagagggtgttagtggcttcatcagttgtagcaggggaatcccacgactcggaccgatg

SEQ ID NO: 2142 - DNA, 203 bp, Homo sapiens
  source 1..203: mol_type = other DNA
ggcgcgccagtcctcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagcgactcggaccgatg

SEQ ID NO: 2143 - DNA, 203 bp, Homo sapiens
  source 1..203: mol_type = other DNA
ggcgcgccagtcctaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctcgactcggaccgatg

SEQ ID NO: 2144 - DNA, 203 bp, Homo sapiens
  source 1..203: mol_type = other DNA
ggcgcgccagtcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggacgactcggaccgatg

SEQ ID NO: 2145 - DNA, 203 bp, Homo sapiens
  source 1..203: mol_type = other DNA
ggcgcgccagtccttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagcgactcggaccgatg

SEQ ID NO: 2146 - DNA, 203 bp, Homo sapiens
  source 1..203: mol_type = other DNA
ggcgcgccagtccttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacacgactcggaccgatg

SEQ ID NO: 2147 - DNA, 203 bp, Homo sapiens
  source 1..203: mol_type = other DNA
ggcgcgccagtcctagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttacgactcggaccgatg

SEQ ID NO: 2148 - DNA, 203 bp, Homo sapiens
  source 1..203: mol_type = other DNA
ggcgcgccagtcctactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagcgactcggaccgatg

SEQ ID NO: 2149 - DNA, 203 bp, Homo sapiens
  source 1..203: mol_type = other DNA
ggcgcgccagtccttggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacgactcggaccgatg

SEQ ID NO: 2150 - DNA, 203 bp, Homo sapiens
  source 1..203: mol_type = other DNA
ggcgcgccagtcctgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtccgactcggaccgatg

SEQ ID NO: 2151 - DNA, 203 bp, Homo sapiens
  source 1..203: mol_type = other DNA
ggcgcgccagtcctacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtccgactcggaccgatg

SEQ ID NO: 2152 - DNA, 203 bp, Homo sapiens
  source 1..203: mol_type = other DNA
ggcgcgccagtcctggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcgactcggaccgatg

SEQ ID NO: 2153 - DNA, 203 bp, Homo sapiens
  source 1..203: mol_type = other DNA
ggcgcgccagtcctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctcgactcggaccgatg

SEQ ID NO: 2154 - DNA, 203 bp, Homo sapiens
  source 1..203: mol_type = other DNA
ggcgcgccagtcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacgactcggaccgatg

SEQ ID NO: 2155 - DNA, 203 bp, Homo sapiens
  source 1..203: mol_type = other DNA
ggcgcgccagtcctcttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttccgactcggaccgatg

SEQ ID NO: 2156 - DNA, 203 bp, Homo sapiens
  source 1..203: mol_type = other DNA
ggcgcgccagtcctctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagcgactcggaccgatg

SEQ ID NO: 2157 - DNA, 203 bp, Homo sapiens
  source 1..203: mol_type = other DNA
ggcgcgccagtcctggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaacgactcggaccgatg

SEQ ID NO: 2158 - DNA, 203 bp, Homo sapiens
  source 1..203: mol_type = other DNA
ggcgcgccagtcctaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagcgactcggaccgatg

SEQ ID NO: 2159 - DNA, 203 bp, Homo sapiens
  source 1..203: mol_type = other DNA
ggcgcgccagtcctgtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcgactcggaccgatg

SEQ ID NO: 2160 - DNA, 203 bp, Homo sapiens
  source 1..203: mol_type = other DNA
ggcgcgccagtccttgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactgcgactcggaccgatg

SEQ ID NO: 2161 - DNA, 203 bp, Homo sapiens
  source 1..203: mol_type = other DNA
ggcgcgccagtcctgctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcgactcggaccgatg

SEQ ID NO: 2162 - DNA, 203 bp, Homo sapiens
  source 1..203: mol_type = other DNA
ggcgcgccagtcctctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcacgactcggaccgatg

SEQ ID NO: 2163 - DNA, 203 bp, Homo sapiens
  source 1..203: mol_type = other DNA
ggcgcgccagtcctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagcgactcggaccgatg

SEQ ID NO: 2164 - DNA, 203 bp, Homo sapiens
  source 1..203: mol_type = other DNA
ggcgcgccagtcctccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacccgactcggaccgatg

SEQ ID NO: 2165 - DNA, 203 bp, Homo sapiens
  source 1..203: mol_type = other DNA
ggcgcgccagtccttgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaacgactcggaccgatg

SEQ ID NO: 2166 - DNA, 203 bp, Homo sapiens
  source 1..203: mol_type = other DNA
ggcgcgccagtcctaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggcgactcggaccgatg

SEQ ID NO: 2167 - DNA, 203 bp, Homo sapiens
  source 1..203: mol_type = other DNA
ggcgcgccagtcctaaatccaaattggtcacatccccagggaagatgtagactatcacctgtacccacagggtccgggactcaatccaaatgcctctacaggacaagaagctctctctcagacaaccatctcatgggccccattccaggacacttctgagtacatcatttcatgtcatcctgttggcacgactcggaccgatg

SEQ ID NO: 2168 - DNA, 203 bp, Homo sapiens
  source 1..203: mol_type = other DNA
ggcgcgccagtcctctgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgacgactcggaccgatg

SEQ ID NO: 2169 - DNA, 203 bp, Homo sapiens
  source 1..203: mol_type = other DNA
ggcgcgccagtcctagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcacgactcggaccgatg

SEQ ID NO: 2170 - DNA, 203 bp, Homo sapiens
  source 1..203: mol_type = other DNA
ggcgcgccagtcctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccacgactcggaccgatg

SEQ ID NO: 2171 - DNA, 203 bp, Homo sapiens
  source 1..203: mol_type = other DNA
ggcgcgccagtcctataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgactcggaccgatg

SEQ ID NO: 2172 - DNA, 203 bp, Homo sapiens
  source 1..203: mol_type = other DNA
ggcgcgccagtcctcgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatcgactcggaccgatg

SEQ ID NO: 2173 - DNA, 203 bp, Homo sapiens
  source 1..203: mol_type = other DNA
ggcgcgccagtcctcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccgactcggaccgatg

SEQ ID NO: 2174 - DNA, 203 bp, Homo sapiens
  source 1..203: mol_type = other DNA
ggcgcgccagtcctcaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttacctcgactcggaccgatg

SEQ ID NO: 2175 - DNA, 203 bp, Homo sapiens
  source 1..203: mol_type = other DNA
ggcgcgccagtcctcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcatcgactcggaccgatg

SEQ ID NO: 2176 - DNA, 203 bp, Homo sapiens
  source 1..203: mol_type = other DNA
ggcgcgccagtcctggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatcgactcggaccgatg

SEQ ID NO: 2177 - DNA, 203 bp, Homo sapiens
  source 1..203: mol_type = other DNA
ggcgcgccagtcctcgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctcgactcggaccgatg

SEQ ID NO: 2178 - DNA, 203 bp, Homo sapiens
  source 1..203: mol_type = other DNA
ggcgcgccagtcctttcaagtgttccacaagtatgttctctactgaagagttgctgcatccttgaatcttgggtgatttgaggcacagaaactatgactttattttttgagatggagttttgctcttgttgcccaggctggagtgcaatggcacgtttttcggcttaccgcaactgccgcctcctgggcgactcggaccgatg

SEQ ID NO: 2179 - DNA, 203 bp, Homo sapiens
  source 1..203: mol_type = other DNA
ggcgcgccagtcctgttagccctttcagcttttttccccatcttgtgccgggccttcctgggtttcagtacttggatgtagggctgcagttatgtcagtggtgggtagattgaccaggaattaaggtctagggtccagcccatgtgagacttgactcactgatctacctttaggcatgtcttccttcccgactcggaccgatg

SEQ ID NO: 2180 - DNA, 203 bp, Homo sapiens
  source 1..203: mol_type = other DNA
ggcgcgccagtcctagtctcatcctttttaaattttttttttttttttgagacggtctcactctcacccaggctggattgcagtggtgtgatctcgaccaactgcaacctctgcctcccacccgcaagctatctgcccacctcagcctctggagtagctgggacgggactacaggcacctgccaccatcgactcggaccgatg

SEQ ID NO: 2181 - DNA, 203 bp, Homo sapiens
  source 1..203: mol_type = other DNA
ggcgcgccagtcctcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcgactcggaccgatg

SEQ ID NO: 2182 - DNA, 203 bp, Homo sapiens
  source 1..203: mol_type = other DNA
ggcgcgccagtcctgtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacccgactcggaccgatg

SEQ ID NO: 2183 - DNA, 203 bp, Homo sapiens
  source 1..203: mol_type = other DNA
ggcgcgccagtcctaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagcccgactcggaccgatg

SEQ ID NO: 2184 - DNA, 203 bp, Homo sapiens
  source 1..203: mol_type = other DNA
ggcgcgccagtcctatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggcccgactcggaccgatg

SEQ ID NO: 2185 - DNA, 203 bp, Homo sapiens
  source 1..203: mol_type = other DNA
ggcgcgccagtcctcactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagacgactcggaccgatg

SEQ ID NO: 2186 - DNA, 203 bp, Homo sapiens
  source 1..203: mol_type = other DNA
ggcgcgccagtcctggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaacgactcggaccgatg

SEQ ID NO: 2187 - DNA, 203 bp, Homo sapiens
  source 1..203: mol_type = other DNA
ggcgcgccagtcctgtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgagcgactcggaccgatg

SEQ ID NO: 2188 - DNA, 203 bp, Homo sapiens
  source 1..203: mol_type = other DNA
ggcgcgccagtcctgctagctggcccgatttctcctccgggtgatgcttttcctagattattctctgatttggtcgtattgggcgcctggtcaccagggctgcttttaactctggtaaagtggatattgttgccatcaatgaccccttcattgacctcaactacatggtttacatgttccaatatgatcgactcggaccgatg

SEQ ID NO: 2189 - DNA, 203 bp, Homo sapiens
  source 1..203: mol_type = other DNA
ggcgcgccagtccttccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctcgactcggaccgatg

SEQ ID NO: 2190 - DNA, 203 bp, Homo sapiens
  source 1..203: mol_type = other DNA
ggcgcgccagtcctaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgcgactcggaccgatg

SEQ ID NO: 2191 - DNA, 203 bp, Homo sapiens
  source 1..203: mol_type = other DNA
ggcgcgccagtcctaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtacgactcggaccgatg

SEQ ID NO: 2192 - DNA, 203 bp, Homo sapiens
  source 1..203: mol_type = other DNA
ggcgcgccagtcctgcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtcgactcggaccgatg

SEQ ID NO: 2193 - DNA, 203 bp, Homo sapiens
  source 1..203: mol_type = other DNA
ggcgcgccagtcctgacgtcagacggtttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaaccgactcggaccgatg

SEQ ID NO: 2194 - DNA, 203 bp, Homo sapiens
  source 1..203: mol_type = other DNA
ggcgcgccagtccttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgccgactcggaccgatg

SEQ ID NO: 2195 - DNA, 203 bp, Homo sapiens
  source 1..203: mol_type = other DNA
ggcgcgccagtccttgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgcgactcggaccgatg

SEQ ID NO: 2196 - DNA, 203 bp, Homo sapiens
  source 1..203: mol_type = other DNA
ggcgcgccagtcctctcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtcgactcggaccgatg

SEQ ID NO: 2197 - DNA, 203 bp, Homo sapiens
  source 1..203: mol_type = other DNA
ggcgcgccagtcctctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctcgactcggaccgatg

SEQ ID NO: 2198 - DNA, 203 bp, Homo sapiens
  source 1..203: mol_type = other DNA
ggcgcgccagtcctctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagccgactcggaccgatg

SEQ ID NO: 2199 - DNA, 203 bp, Homo sapiens
  source 1..203: mol_type = other DNA
ggcgcgccagtcctccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttacgactcggaccgatg

SEQ ID NO: 2200 - DNA, 203 bp, Homo sapiens
  source 1..203: mol_type = other DNA
ggcgcgccagtcctccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttcgactcggaccgatg

SEQ ID NO: 2201 - DNA, 203 bp, Homo sapiens
  source 1..203: mol_type = other DNA
ggcgcgccagtcctctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctcgactcggaccgatg

SEQ ID NO: 2202 - DNA, 203 bp, Homo sapiens
  source 1..203: mol_type = other DNA
ggcgcgccagtcctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgcgactcggaccgatg

SEQ ID NO: 2203 - DNA, 203 bp, Homo sapiens
  source 1..203: mol_type = other DNA
ggcgcgccagtcctattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatcgactcggaccgatg

SEQ ID NO: 2204 - DNA, 203 bp, Homo sapiens
  source 1..203: mol_type = other DNA
ggcgcgccagtcctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtcgactcggaccgatg

SEQ ID NO: 2205 - DNA, 203 bp, Homo sapiens
  source 1..203: mol_type = other DNA
ggcgcgccagtcctgaggctggggtgggaagatcacttgagcccaggaggtcgaggctgcagtgagccatgatcacatcactgcagtccagcctgggtgacagagcaagacctgtcaccctgccacccataaaaaacctcttctgtaatgccaggttcttgacaagatgtgataattccacacttacacgactcggaccgatg

SEQ ID NO: 2206 - DNA, 203 bp, Homo sapiens
  source 1..203: mol_type = other DNA
ggcgcgccagtccttcctcagatctcccatccagggcaaggacagactaaaagagcatatcttctccagaagtcctagaaacatctcatcattgactatgattgaattttatttattaatacttccctaggatatcctgtgtttgagtgtgaagttaatatcacacaaagcatgtagctaacagttgtcgactcggaccgatg

SEQ ID NO: 2207 - DNA, 203 bp, Homo sapiens
  source 1..203: mol_type = other DNA
ggcgcgccagtcctattcattccttccttctccaatagtgtttaagtacaatctttttatttgcattttattgatgattgattgtggttgaaaggagtggtgatattatttcgaggatccactgtgtaagaagactgttggcagtggaaggctcgagttgattaagtgacaaagaggtaaagcagacacgactcggaccgatg

SEQ ID NO: 2208 - DNA, 203 bp, Homo sapiens
  source 1..203: mol_type = other DNA
ggcgcgccagtcctaaaaaaaaaaaagcaaagaaactaagtctgtacagcaaaagatggaaaggaaacaagaaaattaaatgaagacaaaggttgtgattattacagtaaatgaaaataggtttttatctttaaaatgtagactcaaactgcaaagctaatgatatgctatctgcaaaatattcctatcgactcggaccgatg

SEQ ID NO: 2209 - DNA, 203 bp, Homo sapiens
  source 1..203: mol_type = other DNA
ggcgcgccagtcctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtcgactcggaccgatg

SEQ ID NO: 2210 - DNA, 203 bp, Homo sapiens
  source 1..203: mol_type = other DNA
ggcgcgccagtcctggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgactcggaccgatg

SEQ ID NO: 2211 - DNA, 203 bp, Homo sapiens
  source 1..203: mol_type = other DNA
ggcgcgccagtcctccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgcgactcggaccgatg

SEQ ID NO: 2212 - DNA, 203 bp, Homo sapiens
  source 1..203: mol_type = other DNA
ggcgcgccagtcctcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccatcgactcggaccgatg

SEQ ID NO: 2213 - DNA, 203 bp, Homo sapiens
  source 1..203: mol_type = other DNA
ggcgcgccagtcctgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaatacgactcggaccgatg

SEQ ID NO: 2214 - DNA, 203 bp, Homo sapiens
  source 1..203: mol_type = other DNA
ggcgcgccagtccttgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcgactcggaccgatg

SEQ ID NO: 2215 - DNA, 203 bp, Homo sapiens
  source 1..203: mol_type = other DNA
ggcgcgccagtccttcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctactcgactcggaccgatg

SEQ ID NO: 2216 - DNA, 203 bp, Homo sapiens
  source 1..203: mol_type = other DNA
ggcgcgccagtcctcttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgcgactcggaccgatg

SEQ ID NO: 2217 - DNA, 203 bp, Homo sapiens
  source 1..203: mol_type = other DNA
ggcgcgccagtcctgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgcgactcggaccgatg

SEQ ID NO: 2218 - DNA, 203 bp, Homo sapiens
  source 1..203: mol_type = other DNA
ggcgcgccagtccttcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgacgactcggaccgatg

SEQ ID NO: 2219 - DNA, 203 bp, Homo sapiens
  source 1..203: mol_type = other DNA
ggcgcgccagtcctaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccaggcgactcggaccgatg

SEQ ID NO: 2220 - DNA, 203 bp, Homo sapiens
  source 1..203: mol_type = other DNA
ggcgcgccagtcctgatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacgactcggaccgatg

SEQ ID NO: 2221 - DNA, 203 bp, Homo sapiens
  source 1..203: mol_type = other DNA
ggcgcgccagtcctcaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcgactcggaccgatg

SEQ ID NO: 2222 - DNA, 203 bp, Homo sapiens
  source 1..203: mol_type = other DNA
ggcgcgccagtcctcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgcgactcggaccgatg

SEQ ID NO: 2223 - DNA, 203 bp, Homo sapiens
  source 1..203: mol_type = other DNA
ggcgcgccagtcctagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctaccccttcgactcggaccgatg

SEQ ID NO: 2224 - DNA, 203 bp, Homo sapiens
  source 1..203: mol_type = other DNA
ggcgcgccagtcctccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcgactcggaccgatg

SEQ ID NO: 2225 - DNA, 203 bp, Homo sapiens
  source 1..203: mol_type = other DNA
ggcgcgccagtcctgaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagcgactcggaccgatg

SEQ ID NO: 2226 - DNA, 203 bp, Homo sapiens
  source 1..203: mol_type = other DNA
ggcgcgccagtcctggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgcgactcggaccgatg

SEQ ID NO: 2227 - DNA, 203 bp, Homo sapiens
  source 1..203: mol_type = other DNA
ggcgcgccagtcctctttggttttacaaagtagcttgtattttcagtattttctacataatatggtaaaatgtagagcaattgcaatgcatcaataaaatgggtaaattttctgacttatgtggctgtttttgacttctgttataggatataaaggggatcaataaatgacatctttgaaagtgaaaacgactcggaccgatg

SEQ ID NO: 2228 - DNA, 203 bp, Homo sapiens
  source 1..203: mol_type = other DNA
ggcgcgccagtcctcgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccagcgactcggaccgatg

SEQ ID NO: 2229 - DNA, 203 bp, Homo sapiens
  source 1..203: mol_type = other DNA
ggcgcgccagtcctgtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaaccgactcggaccgatg

SEQ ID NO: 2230 - DNA, 203 bp, Homo sapiens
  source 1..203: mol_type = other DNA
ggcgcgccagtcctgtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaaccgactcggaccgatg

SEQ ID NO: 2231 - DNA, 203 bp, Homo sapiens
  source 1..203: mol_type = other DNA
ggcgcgccagtcctggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcgactcggaccgatg

SEQ ID NO: 2232 - DNA, 203 bp, Homo sapiens
  source 1..203: mol_type = other DNA
ggcgcgccagtcctcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaacgactcggaccgatg

SEQ ID NO: 2233 - DNA, 203 bp, Homo sapiens
  source 1..203: mol_type = other DNA
ggcgcgccagtcctaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaaaaaaaaaaacgactcggaccgatg

SEQ ID NO: 2234 - DNA, 203 bp, Homo sapiens
  source 1..203: mol_type = other DNA
ggcgcgccagtcctctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacgcgactcggaccgatg

SEQ ID NO: 2235 - DNA, 203 bp, Homo sapiens
  source 1..203: mol_type = other DNA
ggcgcgccagtcctgtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaacgactcggaccgatg

SEQ ID NO: 2236 - DNA, 203 bp, Homo sapiens
  source 1..203: mol_type = other DNA
ggcgcgccagtcctgacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaacgactcggaccgatg

SEQ ID NO: 2237 - DNA, 203 bp, Homo sapiens
  source 1..203: mol_type = other DNA
ggcgcgccagtcctgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttccgactcggaccgatg

SEQ ID NO: 2238 - DNA, 203 bp, Homo sapiens
  source 1..203: mol_type = other DNA
ggcgcgccagtccttggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccccgactcggaccgatg

SEQ ID NO: 2239 - DNA, 203 bp, Homo sapiens
  source 1..203: mol_type = other DNA
ggcgcgccagtccttgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaatcgactcggaccgatg

SEQ ID NO: 2240 - DNA, 203 bp, Homo sapiens
  source 1..203: mol_type = other DNA
ggcgcgccagtcctttaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaactatgaaacgactcggaccgatg

SEQ ID NO: 2241 - DNA, 203 bp, Homo sapiens
  source 1..203: mol_type = other DNA
ggcgcgccagtcctattatccagatattttgggtgggccgcaaaggcgagctacttagacgcaccccggtgagctcggccatgcagacaccaatgggaatcccaatggggaagtcgatgctggtgcttctcaccttcttggccttcgcctcgtgctgcattgctgcttaccgccccagtgagaccctgcgactcggaccgatg

SEQ ID NO: 2242 - DNA, 203 bp, Homo sapiens
  source 1..203: mol_type = other DNA
ggcgcgccagtccttgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtcccgactcggaccgatg

SEQ ID NO: 2243 - DNA, 203 bp, Homo sapiens
  source 1..203: mol_type = other DNA
ggcgcgccagtcctttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggcgactcggaccgatg

SEQ ID NO: 2244 - DNA, 203 bp, Homo sapiens
  source 1..203: mol_type = other DNA
ggcgcgccagtcctttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacacgactcggaccgatg

SEQ ID NO: 2245 - DNA, 203 bp, Homo sapiens
  source 1..203: mol_type = other DNA
ggcgcgccagtcctggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgcgactcggaccgatg

SEQ ID NO: 2246 - DNA, 203 bp, Homo sapiens
  source 1..203: mol_type = other DNA
ggcgcgccagtcctacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacgactcggaccgatg

SEQ ID NO: 2247 - DNA, 203 bp, Homo sapiens
  source 1..203: mol_type = other DNA
ggcgcgccagtcctctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacacgactcggaccgatg

SEQ ID NO: 2248 - DNA, 203 bp, Homo sapiens
  source 1..203: mol_type = other DNA
ggcgcgccagtcctttggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatcgactcggaccgatg

SEQ ID NO: 2249 - DNA, 203 bp, Homo sapiens
  source 1..203: mol_type = other DNA
ggcgcgccagtcctgggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagacgactcggaccgatg

SEQ ID NO: 2250 - DNA, 203 bp, Homo sapiens
  source 1..203: mol_type = other DNA
ggcgcgccagtcctggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcccgactcggaccgatg

SEQ ID NO: 2251 - DNA, 203 bp, Homo sapiens
  source 1..203: mol_type = other DNA
ggcgcgccagtcctccgctaatgtaccatgccctggtgctggaaagtgcctgagccagctgccccagcggcctcagcactaccaagttggcacaaagctccccaaattcggaggggctcagggaaacgagtggaggggatgaggaggtgaggggtaaacccatcatttcagttggcatttgagcaggtcgactcggaccgatg

SEQ ID NO: 2252 - DNA, 203 bp, Homo sapiens
  source 1..203: mol_type = other DNA
ggcgcgccagtcctccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcgactcggaccgatg

SEQ ID NO: 2253 - DNA, 203 bp, Homo sapiens
  source 1..203: mol_type = other DNA
ggcgcgccagtcctcagccccaactgcgaggcagagagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgccgactcggaccgatg

SEQ ID NO: 2254 - DNA, 203 bp, Homo sapiens
  source 1..203: mol_type = other DNA
ggcgcgccagtcctggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttcccccgactcggaccgatg

SEQ ID NO: 2255 - DNA, 203 bp, Homo sapiens
  source 1..203: mol_type = other DNA
ggcgcgccagtcctagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaacgactcggaccgatg

SEQ ID NO: 2256 - DNA, 203 bp, Homo sapiens
  source 1..203: mol_type = other DNA
ggcgcgccagtcctgaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctcgactcggaccgatg

SEQ ID NO: 2257 - DNA, 203 bp, Homo sapiens
  source 1..203: mol_type = other DNA
ggcgcgccagtcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcacgactcggaccgatg

SEQ ID NO: 2258 - DNA, 203 bp, Homo sapiens
  source 1..203: mol_type = other DNA
ggcgcgccagtcctagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcaccccgactcggaccgatg

SEQ ID NO: 2259 - DNA, 203 bp, Homo sapiens
  source 1..203: mol_type = other DNA
ggcgcgccagtcctacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacaccgactcggaccgatg

SEQ ID NO: 2260 - DNA, 203 bp, Homo sapiens
  source 1..203: mol_type = other DNA
ggcgcgccagtccttccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgaccgactcggaccgatg

SEQ ID NO: 2261 - DNA, 203 bp, Homo sapiens
  source 1..203: mol_type = other DNA
ggcgcgccagtcctagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtcgactcggaccgatg

SEQ ID NO: 2262 - DNA, 203 bp, Homo sapiens
  source 1..203: mol_type = other DNA
ggcgcgccagtcctgagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggcgactcggaccgatg

SEQ ID NO: 2263 - DNA, 203 bp, Homo sapiens
  source 1..203: mol_type = other DNA
ggcgcgccagtcctggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcacccccgactcggaccgatg

SEQ ID NO: 2264 - DNA, 203 bp, Homo sapiens
  source 1..203: mol_type = other DNA
ggcgcgccagtcctaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctacgactcggaccgatg

SEQ ID NO: 2265 - DNA, 203 bp, Homo sapiens
  source 1..203: mol_type = other DNA
ggcgcgccagtcctgtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcccgactcggaccgatg

SEQ ID NO: 2266 - DNA, 203 bp, Homo sapiens
  source 1..203: mol_type = other DNA
ggcgcgccagtcctccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacgactcggaccgatg

SEQ ID NO: 2267 - DNA, 203 bp, Homo sapiens
  source 1..203: mol_type = other DNA
ggcgcgccagtcctagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaacgactcggaccgatg

SEQ ID NO: 2268 - DNA, 203 bp, Homo sapiens
  source 1..203: mol_type = other DNA
ggcgcgccagtcctgcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccacgactcggaccgatg

SEQ ID NO: 2269 - DNA, 203 bp, Homo sapiens
  source 1..203: mol_type = other DNA
ggcgcgccagtcctcctctgcggtgccaccgacgggaagaagcgctatgacctgtccgcgctggtccgccatgcagaaccagagcagaattgggaagctgtggatggcagtcagacggaaacagagaagaagcattttttcattaatatttgtcacagagtgctgcaggaaggcaaggcacgagggtgcgactcggaccgatg

SEQ ID NO: 2270 - DNA, 203 bp, Homo sapiens
  source 1..203: mol_type = other DNA
ggcgcgccagtcctccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggacgactcggaccgatg

SEQ ID NO: 2271 - DNA, 203 bp, Homo sapiens
  source 1..203: mol_type = other DNA
ggcgcgccagtcctgctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcgactcggaccgatg

SEQ ID NO: 2272 - DNA, 203 bp, Homo sapiens
  source 1..203: mol_type = other DNA
ggcgcgccagtcctcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacaccgactcggaccgatg

SEQ ID NO: 2273 - DNA, 203 bp, Homo sapiens
  source 1..203: mol_type = other DNA
ggcgcgccagtcctctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcgactcggaccgatg

SEQ ID NO: 2274 - DNA, 203 bp, Homo sapiens
  source 1..203: mol_type = other DNA
ggcgcgccagtcctcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgcgactcggaccgatg

SEQ ID NO: 2275 - DNA, 203 bp, Homo sapiens
  source 1..203: mol_type = other DNA
ggcgcgccagtcctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggacgactcggaccgatg

SEQ ID NO: 2276 - DNA, 203 bp, Homo sapiens
  source 1..203: mol_type = other DNA
ggcgcgccagtcctgcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacgactcggaccgatg

SEQ ID NO: 2277 - DNA, 203 bp, Homo sapiens
  source 1..203: mol_type = other DNA
ggcgcgccagtcctcttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccacgactcggaccgatg

SEQ ID NO: 2278 - DNA, 203 bp, Homo sapiens
  source 1..203: mol_type = other DNA
ggcgcgccagtcctggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcgactcggaccgatg

SEQ ID NO: 2279 - DNA, 203 bp, Homo sapiens
  source 1..203: mol_type = other DNA
ggcgcgccagtcctcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagaccgactcggaccgatg

SEQ ID NO: 2280 - DNA, 203 bp, Homo sapiens
  source 1..203: mol_type = other DNA
ggcgcgccagtcctagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatccgactcggaccgatg

SEQ ID NO: 2281 - DNA, 203 bp, Homo sapiens
  source 1..203: mol_type = other DNA
ggcgcgccagtcctctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggccgactcggaccgatg

SEQ ID NO: 2282 - DNA, 203 bp, Homo sapiens
  source 1..203: mol_type = other DNA
ggcgcgccagtcctaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttatttcgactcggaccgatg

SEQ ID NO: 2283 - DNA, 203 bp, Homo sapiens
  source 1..203: mol_type = other DNA
ggcgcgccagtccttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccgactcggaccgatg

SEQ ID NO: 2284 - DNA, 203 bp, Homo sapiens
  source 1..203: mol_type = other DNA
ggcgcgccagtcctcaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctccgactcggaccgatg

SEQ ID NO: 2285 - DNA, 203 bp, Homo sapiens
  source 1..203: mol_type = other DNA
ggcgcgccagtcctttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaacgactcggaccgatg

SEQ ID NO: 2286 - DNA, 203 bp, Homo sapiens
  source 1..203: mol_type = other DNA
ggcgcgccagtcctgaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggacgactcggaccgatg

SEQ ID NO: 2287 - DNA, 203 bp, Homo sapiens
  source 1..203: mol_type = other DNA
ggcgcgccagtcctgcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgactcggaccgatg

SEQ ID NO: 2288 - DNA, 203 bp, Homo sapiens
  source 1..203: mol_type = other DNA
ggcgcgccagtccttataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcactcgactcggaccgatg

SEQ ID NO: 2289 - DNA, 203 bp, Homo sapiens
  source 1..203: mol_type = other DNA
ggcgcgccagtccttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacgactcggaccgatg

SEQ ID NO: 2290 - DNA, 203 bp, Homo sapiens
  source 1..203: mol_type = other DNA
ggcgcgccagtcctgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaattattaaaacgactcggaccgatg

SEQ ID NO: 2291 - DNA, 203 bp, Homo sapiens
  source 1..203: mol_type = other DNA
ggcgcgccagtcctcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtcgactcggaccgatg

SEQ ID NO: 2292 - DNA, 203 bp, Homo sapiens
  source 1..203: mol_type = other DNA
ggcgcgccagtcctctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaagcgactcggaccgatg

SEQ ID NO: 2293 - DNA, 203 bp, Homo sapiens
  source 1..203: mol_type = other DNA
ggcgcgccagtcctgtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatcgactcggaccgatg

SEQ ID NO: 2294 - DNA, 203 bp, Homo sapiens
  source 1..203: mol_type = other DNA
ggcgcgccagtcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctcccgactcggaccgatg

SEQ ID NO: 2295 - DNA, 203 bp, Homo sapiens
  source 1..203: mol_type = other DNA
ggcgcgccagtcctcctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgcgactcggaccgatg

SEQ ID NO: 2296 - DNA, 203 bp, Homo sapiens
  source 1..203: mol_type = other DNA
ggcgcgccagtcctgccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactgcgactcggaccgatg

SEQ ID NO: 2297 - DNA, 203 bp, Homo sapiens
  source 1..203: mol_type = other DNA
ggcgcgccagtcctgagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatcgactcggaccgatg

SEQ ID NO: 2298 - DNA, 203 bp, Homo sapiens
  source 1..203: mol_type = other DNA
ggcgcgccagtcctgatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgcgactcggaccgatg

SEQ ID NO: 2299 - DNA, 203 bp, Homo sapiens
  source 1..203: mol_type = other DNA
ggcgcgccagtcctactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctcgactcggaccgatg

SEQ ID NO: 2300 - DNA, 203 bp, Homo sapiens
  source 1..203: mol_type = other DNA
ggcgcgccagtcctacaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgacacgactcggaccgatg

SEQ ID NO: 2301 - DNA, 203 bp, Homo sapiens
  source 1..203: mol_type = other DNA
ggcgcgccagtcctctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtcgactcggaccgatg

SEQ ID NO: 2302 - DNA, 203 bp, Homo sapiens
  source 1..203: mol_type = other DNA
ggcgcgccagtcctgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggcgactcggaccgatg

SEQ ID NO: 2303 - DNA, 203 bp, Homo sapiens
  source 1..203: mol_type = other DNA
ggcgcgccagtccttggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacgactcggaccgatg

SEQ ID NO: 2304 - DNA, 203 bp, Homo sapiens
  source 1..203: mol_type = other DNA
ggcgcgccagtcctcagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccacgactcggaccgatg

SEQ ID NO: 2305 - DNA, 203 bp, Homo sapiens
  source 1..203: mol_type = other DNA
ggcgcgccagtcctcctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccccgactcggaccgatg

SEQ ID NO: 2306 - DNA, 203 bp, Homo sapiens
  source 1..203: mol_type = other DNA
ggcgcgccagtcctaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagcgactcggaccgatg

SEQ ID NO: 2307 - DNA, 203 bp, Homo sapiens
  source 1..203: mol_type = other DNA
ggcgcgccagtcctctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgactcggaccgatg

SEQ ID NO: 2308 - DNA, 203 bp, Homo sapiens
  source 1..203: mol_type = other DNA
ggcgcgccagtcctcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttacgactcggaccgatg

SEQ ID NO: 2309 - DNA, 203 bp, Homo sapiens
  source 1..203: mol_type = other DNA
ggcgcgccagtcctctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcgactcggaccgatg

SEQ ID NO: 2310 - DNA, 203 bp, Homo sapiens
  source 1..203: mol_type = other DNA
ggcgcgccagtcctgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacacgactcggaccgatg

SEQ ID NO: 2311 - DNA, 203 bp, Homo sapiens
  source 1..203: mol_type = other DNA
ggcgcgccagtcctggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagccgactcggaccgatg

SEQ ID NO: 2312 - DNA, 203 bp, Homo sapiens
  source 1..203: mol_type = other DNA
ggcgcgccagtccttgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttcccgactcggaccgatg

SEQ ID NO: 2313 - DNA, 203 bp, Homo sapiens
  source 1..203: mol_type = other DNA
ggcgcgccagtcctctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaacgactcggaccgatg

SEQ ID NO: 2314 - DNA, 203 bp, Homo sapiens
  source 1..203: mol_type = other DNA
ggcgcgccagtcctcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatcgactcggaccgatg

SEQ ID NO: 2315 - DNA, 203 bp, Homo sapiens
  source 1..203: mol_type = other DNA
ggcgcgccagtcctttttatttggggtttgggaccggatcaggccttaaatctacgcagaagaaaggcggagaagcagcggaagccgggcactagtcctgcagggtggaaggcgctttatcgggtcttctggcccgctgcgggcgatagagctggtaacctgagtagagtaaatagagacacgtgggtcgactcggaccgatg

SEQ ID NO: 2316 - DNA, 203 bp, Homo sapiens
  source 1..203: mol_type = other DNA
ggcgcgccagtccttggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagcgactcggaccgatg

SEQ ID NO: 2317 - DNA, 203 bp, Homo sapiens
  source 1..203: mol_type = other DNA
ggcgcgccagtcctacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacacgactcggaccgatg

SEQ ID NO: 2318 - DNA, 203 bp, Homo sapiens
  source 1..203: mol_type = other DNA
ggcgcgccagtcctaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacgactcggaccgatg

SEQ ID NO: 2319 - DNA, 203 bp, Homo sapiens
  source 1..203: mol_type = other DNA
ggcgcgccagtcctccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccacgactcggaccgatg

SEQ ID NO: 2320 - DNA, 203 bp, Homo sapiens
  source 1..203: mol_type = other DNA
ggcgcgccagtcctgctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgtcgactcggaccgatg

SEQ ID NO: 2321 - DNA, 203 bp, Homo sapiens
  source 1..203: mol_type = other DNA
ggcgcgccagtccttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcgactcggaccgatg

SEQ ID NO: 2322 - DNA, 203 bp, Homo sapiens
  source 1..203: mol_type = other DNA
ggcgcgccagtcctcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcagcgactcggaccgatg

SEQ ID NO: 2323 - DNA, 203 bp, Homo sapiens
  source 1..203: mol_type = other DNA
ggcgcgccagtcctgcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcacgactcggaccgatg

SEQ ID NO: 2324 - DNA, 203 bp, Homo sapiens
  source 1..203: mol_type = other DNA
ggcgcgccagtcctttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgccgactcggaccgatg

SEQ ID NO: 2325 - DNA, 203 bp, Homo sapiens
  source 1..203: mol_type = other DNA
ggcgcgccagtccttagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaacccgactcggaccgatg

SEQ ID NO: 2326 - DNA, 203 bp, Homo sapiens
  source 1..203: mol_type = other DNA
ggcgcgccagtccttgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcacgactcggaccgatg

SEQ ID NO: 2327 - DNA, 203 bp, Homo sapiens
  source 1..203: mol_type = other DNA
ggcgcgccagtccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcccgactcggaccgatg

SEQ ID NO: 2328 - DNA, 203 bp, Homo sapiens
  source 1..203: mol_type = other DNA
ggcgcgccagtcctcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacccgactcggaccgatg

SEQ ID NO: 2329 - DNA, 203 bp, Homo sapiens
  source 1..203: mol_type = other DNA
ggcgcgccagtccttcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatccgactcggaccgatg

SEQ ID NO: 2330 - DNA, 203 bp, Homo sapiens
  source 1..203: mol_type = other DNA
ggcgcgccagtcctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtcgactcggaccgatg

SEQ ID NO: 2331 - DNA, 203 bp, Homo sapiens
  source 1..203: mol_type = other DNA
ggcgcgccagtcctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctcgactcggaccgatg

SEQ ID NO: 2332 - DNA, 203 bp, Homo sapiens
  source 1..203: mol_type = other DNA
ggcgcgccagtcctggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccacccgactcggaccgatg

SEQ ID NO: 2333 - DNA, 203 bp, Homo sapiens
  source 1..203: mol_type = other DNA
ggcgcgccagtcctctttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacgactcggaccgatg

SEQ ID NO: 2334 - DNA, 203 bp, Homo sapiens
  source 1..203: mol_type = other DNA
ggcgcgccagtccttatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacgactcggaccgatg

SEQ ID NO: 2335 - DNA, 203 bp, Homo sapiens
  source 1..203: mol_type = other DNA
ggcgcgccagtcctcatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccacgactcggaccgatg

SEQ ID NO: 2336 - DNA, 203 bp, Homo sapiens
  source 1..203: mol_type = other DNA
ggcgcgccagtcctgctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagacgactcggaccgatg

SEQ ID NO: 2337 - DNA, 203 bp, Homo sapiens
  source 1..203: mol_type = other DNA
ggcgcgccagtcctctcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgcgactcggaccgatg

SEQ ID NO: 2338 - DNA, 203 bp, Homo sapiens
  source 1..203: mol_type = other DNA
ggcgcgccagtcctccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggacgactcggaccgatg

SEQ ID NO: 2339 - DNA, 203 bp, Homo sapiens
  source 1..203: mol_type = other DNA
ggcgcgccagtcctagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttcgactcggaccgatg

SEQ ID NO: 2340 - DNA, 203 bp, Homo sapiens
  source 1..203: mol_type = other DNA
ggcgcgccagtcctttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggccgactcggaccgatg

SEQ ID NO: 2341 - DNA, 203 bp, Homo sapiens
  source 1..203: mol_type = other DNA
ggcgcgccagtcctttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttcgactcggaccgatg

SEQ ID NO: 2342 - DNA, 203 bp, Homo sapiens
  source 1..203: mol_type = other DNA
ggcgcgccagtcctagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcacgactcggaccgatg

SEQ ID NO: 2343 - DNA, 203 bp, Homo sapiens
  source 1..203: mol_type = other DNA
ggcgcgccagtcctgaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagcgactcggaccgatg

SEQ ID NO: 2344 - DNA, 203 bp, Homo sapiens
  source 1..203: mol_type = other DNA
ggcgcgccagtccttggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacgactcggaccgatg

SEQ ID NO: 2345 - DNA, 203 bp, Homo sapiens
  source 1..203: mol_type = other DNA
ggcgcgccagtcctcagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtcgactcggaccgatg

SEQ ID NO: 2346 - DNA, 203 bp, Homo sapiens
  source 1..203: mol_type = other DNA
ggcgcgccagtcctgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacaccccgactcggaccgatg

SEQ ID NO: 2347 - DNA, 203 bp, Homo sapiens
  source 1..203: mol_type = other DNA
ggcgcgccagtcctggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatccgactcggaccgatg

SEQ ID NO: 2348 - DNA, 203 bp, Homo sapiens
  source 1..203: mol_type = other DNA
ggcgcgccagtccttccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagcgactcggaccgatg

SEQ ID NO: 2349 - DNA, 203 bp, Homo sapiens
  source 1..203: mol_type = other DNA
ggcgcgccagtccttaaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcccgactcggaccgatg

SEQ ID NO: 2350 - DNA, 203 bp, Homo sapiens
  source 1..203: mol_type = other DNA
ggcgcgccagtccttcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggccgactcggaccgatg

SEQ ID NO: 2351 - DNA, 203 bp, Homo sapiens
  source 1..203: mol_type = other DNA
ggcgcgccagtcctctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaacgactcggaccgatg

SEQ ID NO: 2352 - DNA, 203 bp, Homo sapiens
  source 1..203: mol_type = other DNA
ggcgcgccagtcctctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgcgactcggaccgatg

SEQ ID NO: 2353 - DNA, 203 bp, Homo sapiens
  source 1..203: mol_type = other DNA
ggcgcgccagtcctctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgaccgactcggaccgatg

SEQ ID NO: 2354 - DNA, 203 bp, Homo sapiens
  source 1..203: mol_type = other DNA
ggcgcgccagtccttacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccacgactcggaccgatg

SEQ ID NO: 2355 - DNA, 203 bp, Homo sapiens
  source 1..203: mol_type = other DNA
ggcgcgccagtcctgagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagaccccgactcggaccgatg

SEQ ID NO: 2356 - DNA, 203 bp, Homo sapiens
  source 1..203: mol_type = other DNA
ggcgcgccagtccttttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggcgactcggaccgatg

SEQ ID NO: 2357 - DNA, 203 bp, Homo sapiens
  source 1..203: mol_type = other DNA
ggcgcgccagtcctggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctccgactcggaccgatg

SEQ ID NO: 2358 - DNA, 203 bp, Homo sapiens
  source 1..203: mol_type = other DNA
ggcgcgccagtcctctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtcgactcggaccgatg

SEQ ID NO: 2359 - DNA, 203 bp, Homo sapiens
  source 1..203: mol_type = other DNA
ggcgcgccagtcctcctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccgactcggaccgatg

SEQ ID NO: 2360 - DNA, 203 bp, Homo sapiens
  source 1..203: mol_type = other DNA
ggcgcgccagtcctagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagctcgactcggaccgatg

SEQ ID NO: 2361 - DNA, 203 bp, Homo sapiens
  source 1..203: mol_type = other DNA
ggcgcgccagtccttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcacgactcggaccgatg

SEQ ID NO: 2362 - DNA, 203 bp, Homo sapiens
  source 1..203: mol_type = other DNA
ggcgcgccagtcctcgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacgactcggaccgatg

SEQ ID NO: 2363 - DNA, 203 bp, Homo sapiens
  source 1..203: mol_type = other DNA
ggcgcgccagtcctcatgatgtcacacctggtgaagatccctggcatcatcatcgcggcctctggggtccgtgccaaggccacccgcatctctatccagtgccgcagctgccgcaacaccctcaccaacattgccatgcgccctggcctcgagggctatgccctgcccaggaagtgcaacacagatcacgactcggaccgatg

SEQ ID NO: 2364 - DNA, 203 bp, Homo sapiens
  source 1..203: mol_type = other DNA
ggcgcgccagtcctggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccccgactcggaccgatg

SEQ ID NO: 2365 - DNA, 203 bp, Homo sapiens
  source 1..203: mol_type = other DNA
ggcgcgccagtcctggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcgactcggaccgatg

SEQ ID NO: 2366 - DNA, 203 bp, Homo sapiens
  source 1..203: mol_type = other DNA
ggcgcgccagtcctcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccgactcggaccgatg

SEQ ID NO: 2367 - DNA, 203 bp, Homo sapiens
  source 1..203: mol_type = other DNA
ggcgcgccagtcctgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggccgactcggaccgatg

SEQ ID NO: 2368 - DNA, 203 bp, Homo sapiens
  source 1..203: mol_type = other DNA
ggcgcgccagtcctcatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagcgactcggaccgatg

SEQ ID NO: 2369 - DNA, 203 bp, Homo sapiens
  source 1..203: mol_type = other DNA
ggcgcgccagtcctccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcacgactcggaccgatg

SEQ ID NO: 2370 - DNA, 203 bp, Homo sapiens
  source 1..203: mol_type = other DNA
ggcgcgccagtcctgagcaggagcgagagcaggaacagaagaaggccaatagcctggccaggctggcacatacccttcctgtggaggaaccccgcatggaggcgccacccctgcctctgtctccaccggctcccccgccggcacccccaccaccacttgccacccctgccccactgactgtcatccctcgactcggaccgatg

SEQ ID NO: 2371 - DNA, 203 bp, Homo sapiens
  source 1..203: mol_type = other DNA
ggcgcgccagtcctatccctgtggtgaccaactcccctcagcctctacccccacccccacccttgcccgcggcagcccagcctctgcccctggcgcctcgtcagccggccctggttggcgcccccggactcagcattaaggagcctgcccccctgcccagcaggccgcaggtgcccacccctgctccccgactcggaccgatg

SEQ ID NO: 2372 - DNA, 203 bp, Homo sapiens
  source 1..203: mol_type = other DNA
ggcgcgccagtcctctactgccggactcgaaggccaccattccacccaatggcagccccaagcctttgcagcccctccccacgcctgtcctgaccatagcgccacaccctggagtccagcctcagctggccccccagcagccgcccccacccacgctggggaccctgaagttggcaccagctgaagaacgactcggaccgatg

SEQ ID NO: 2373 - DNA, 203 bp, Homo sapiens
  source 1..203: mol_type = other DNA
ggcgcgccagtcctgaggatgaccaggcctccacctccaccgcctctgagggtgaggacaacatagacgaggatatggaggaggaccgggcgggcctgggcccacctaagctgagccatcgtccccagccggagctgctgaagtccaccctgccaccccccagcaccacccctgcgcctctgcctccacgactcggaccgatg

SEQ ID NO: 2374 - DNA, 203 bp, Homo sapiens
  source 1..203: mol_type = other DNA
ggcgcgccagtcctcacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctcccgactcggaccgatg

SEQ ID NO: 2375 - DNA, 203 bp, Homo sapiens
  source 1..203: mol_type = other DNA
ggcgcgccagtcctacggtcatcgcccacacagccaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgcccgactcggaccgatg

SEQ ID NO: 2376 - DNA, 203 bp, Homo sapiens
  source 1..203: mol_type = other DNA
ggcgcgccagtcctccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccgactcggaccgatg

SEQ ID NO: 2377 - DNA, 203 bp, Homo sapiens
  source 1..203: mol_type = other DNA
ggcgcgccagtcctcagtgccgctcctgcttcccctccctaccctcggaaatcagtgcgatgtggacgtcacgctccctgacttctcccccgccctgccccgccttcgtgtgctgctgctgctattgctgtctggtgaggtggcccaggcccccggctttcctccggagcctcatgttctcttcccagcgactcggaccgatg

SEQ ID NO: 2378 - DNA, 203 bp, Homo sapiens
  source 1..203: mol_type = other DNA
ggcgcgccagtcctttccccgtcccctgcagcctgggtctggatgggaggagagccactgggcccctgtccccagtccccagtccccagccctgggcttggctcttggcttccagaaggcagcaaagaggggcgctgtcctgcgttcagcccctgatctctgacctctgctgagtgctgggcactgctcgactcggaccgatg

SEQ ID NO: 2379 - DNA, 203 bp, Homo sapiens
  source 1..203: mol_type = other DNA
ggcgcgccagtcctccaagggacaggtgggcctggcggcctgtgggtttgggtgcctcctgcagtttgggagacatggaccagcatctggtcttgtttccaggagcatagaagccacatcgttgagacatcaggaaggtaaaaacccagcggcttagccaagccctaagcctgtccccagaccaaccccgactcggaccgatg

SEQ ID NO: 2380 - DNA, 203 bp, Homo sapiens
  source 1..203: mol_type = other DNA
ggcgcgccagtccttgggacctatacagaacagagggccagagctagggctgctgcttctgctccagcccctttgcctctgtcctcccatcccctcaacaccctgcttctcccggggacgcttttgagtgggccctgcccggggagctgcagagcagcagcacctttctctgagaagaggtccttggtcgactcggaccgatg

SEQ ID NO: 2381 - DNA, 203 bp, Homo sapiens
  source 1..203: mol_type = other DNA
ggcgcgccagtccttctctggaaataaagaatccttagatgcctaaaaattcccttcctgttccctcctggtcctggacacctcccaggggactgttccttatttctctctcctggtgtgggtaaagggacagttacaaaccaggtcaccatcctcagaggctgagccctgtacccaccccagcacagcgactcggaccgatg

SEQ ID NO: 2382 - DNA, 203 bp, Homo sapiens
  source 1..203: mol_type = other DNA
ggcgcgccagtcctccacctccgccagaccccgtggctctgggagagccagctttgctattcccattgtgacagcgatggcaggcctgacccacggggcagttagagcagcctcgtggagctcgcccctcccctcagcctgcccacctctccctgcatcctgaggccagtggcccccgggcctgcacacgactcggaccgatg

SEQ ID NO: 2383 - DNA, 203 bp, Homo sapiens
  source 1..203: mol_type = other DNA
ggcgcgccagtcctgatacctcatcatccacccgctgcccctccccgtccctgtcccccagcatcgggggcctgcaaatctagtgccgaatgactatgtccagattggtgacgatgggtgttgctgtttttcttgtcgtttgtgaacgctgtgatgctgtgtgcccaagtgggcagtcaccacccagccgactcggaccgatg

SEQ ID NO: 2384 - DNA, 203 bp, Homo sapiens
  source 1..203: mol_type = other DNA
ggcgcgccagtccttcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagcgactcggaccgatg

SEQ ID NO: 2385 - DNA, 203 bp, Homo sapiens
  source 1..203: mol_type = other DNA
ggcgcgccagtcctaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgacgactcggaccgatg

SEQ ID NO: 2386 - DNA, 203 bp, Homo sapiens
  source 1..203: mol_type = other DNA
ggcgcgccagtcctgtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgactcggaccgatg

SEQ ID NO: 2387 - DNA, 203 bp, Homo sapiens
  source 1..203: mol_type = other DNA
ggcgcgccagtcctcgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtcgactcggaccgatg

SEQ ID NO: 2388 - DNA, 203 bp, Homo sapiens
  source 1..203: mol_type = other DNA
ggcgcgccagtcctgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcgactcggaccgatg

SEQ ID NO: 2389 - DNA, 203 bp, Homo sapiens
  source 1..203: mol_type = other DNA
ggcgcgccagtcctctctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagcgactcggaccgatg

SEQ ID NO: 2390 - DNA, 203 bp, Homo sapiens
  source 1..203: mol_type = other DNA
ggcgcgccagtccttgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatcgactcggaccgatg

SEQ ID NO: 2391 - DNA, 203 bp, Homo sapiens
  source 1..203: mol_type = other DNA
ggcgcgccagtccttaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccaggggtccgcaacccttgcccgactcggaccgatg

SEQ ID NO: 2392 - DNA, 203 bp, Homo sapiens
  source 1..203: mol_type = other DNA
ggcgcgccagtcctgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagcgactcggaccgatg

SEQ ID NO: 2393 - DNA, 203 bp, Homo sapiens
  source 1..203: mol_type = other DNA
ggcgcgccagtcctatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagaccgactcggaccgatg

SEQ ID NO: 2394 - DNA, 203 bp, Homo sapiens
  source 1..203: mol_type = other DNA
ggcgcgccagtcctagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttccgactcggaccgatg

SEQ ID NO: 2395 - DNA, 203 bp, Homo sapiens
  source 1..203: mol_type = other DNA
ggcgcgccagtccttctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggccgactcggaccgatg

SEQ ID NO: 2396 - DNA, 203 bp, Homo sapiens
  source 1..203: mol_type = other DNA
ggcgcgccagtcctaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtccgactcggaccgatg

SEQ ID NO: 2397 - DNA, 203 bp, Homo sapiens
  source 1..203: mol_type = other DNA
ggcgcgccagtcctctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccgactcggaccgatg

SEQ ID NO: 2398 - DNA, 203 bp, Homo sapiens
  source 1..203: mol_type = other DNA
ggcgcgccagtcctacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaaaaaaaaaaaaaaacgactcggaccgatg

SEQ ID NO: 2399 - DNA, 203 bp, Homo sapiens
  source 1..203: mol_type = other DNA
ggcgcgccagtccttgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcacgactcggaccgatg

SEQ ID NO: 2400 - DNA, 203 bp, Homo sapiens
  source 1..203: mol_type = other DNA
ggcgcgccagtcctagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagcgactcggaccgatg

SEQ ID NO: 2401 - DNA, 203 bp, Homo sapiens
  source 1..203: mol_type = other DNA
ggcgcgccagtcctttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcaccgactcggaccgatg

SEQ ID NO: 2402 - DNA, 203 bp, Homo sapiens
  source 1..203: mol_type = other DNA
ggcgcgccagtccttttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggcgactcggaccgatg

SEQ ID NO: 2403 - DNA, 203 bp, Homo sapiens
  source 1..203: mol_type = other DNA
ggcgcgccagtcctgctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctcgactcggaccgatg

SEQ ID NO: 2404 - DNA, 203 bp, Homo sapiens
  source 1..203: mol_type = other DNA
ggcgcgccagtcctgtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataattcgactcggaccgatg

SEQ ID NO: 2405 - DNA, 203 bp, Homo sapiens
  source 1..203: mol_type = other DNA
ggcgcgccagtcctactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatatcgactcggaccgatg

SEQ ID NO: 2406 - DNA, 203 bp, Homo sapiens
  source 1..203: mol_type = other DNA
ggcgcgccagtcctggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggacccgactcggaccgatg

SEQ ID NO: 2407 - DNA, 203 bp, Homo sapiens
  source 1..203: mol_type = other DNA
ggcgcgccagtcctatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatcgactcggaccgatg

SEQ ID NO: 2408 - DNA, 203 bp, Homo sapiens
  source 1..203: mol_type = other DNA
ggcgcgccagtccttggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatgcgactcggaccgatg

SEQ ID NO: 2409 - DNA, 203 bp, Homo sapiens
  source 1..203: mol_type = other DNA
ggcgcgccagtcctactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgagcgactcggaccgatg

SEQ ID NO: 2410 - DNA, 203 bp, Homo sapiens
  source 1..203: mol_type = other DNA
ggcgcgccagtcctggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacgtaaacttaaaaaaaacgactcggaccgatg

SEQ ID NO: 2411 - DNA, 203 bp, Homo sapiens
  source 1..203: mol_type = other DNA
ggcgcgccagtcctgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttcgactcggaccgatg

SEQ ID NO: 2412 - DNA, 203 bp, Homo sapiens
  source 1..203: mol_type = other DNA
ggcgcgccagtcctgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcgactcggaccgatg

SEQ ID NO: 2413 - DNA, 203 bp, Homo sapiens
  source 1..203: mol_type = other DNA
ggcgcgccagtcctgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattacgactcggaccgatg

SEQ ID NO: 2414 - DNA, 203 bp, Homo sapiens
  source 1..203: mol_type = other DNA
ggcgcgccagtcctgtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgcgactcggaccgatg

SEQ ID NO: 2415 - DNA, 203 bp, Homo sapiens
  source 1..203: mol_type = other DNA
ggcgcgccagtccttggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggcgactcggaccgatg

SEQ ID NO: 2416 - DNA, 203 bp, Homo sapiens
  source 1..203: mol_type = other DNA
ggcgcgccagtcctggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactatcgactcggaccgatg

SEQ ID NO: 2417 - DNA, 203 bp, Homo sapiens
  source 1..203: mol_type = other DNA
ggcgcgccagtcctaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggcgactcggaccgatg

SEQ ID NO: 2418 - DNA, 203 bp, Homo sapiens
  source 1..203: mol_type = other DNA
ggcgcgccagtccttcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctcgactcggaccgatg

SEQ ID NO: 2419 - DNA, 203 bp, Homo sapiens
  source 1..203: mol_type = other DNA
ggcgcgccagtcctggggccatggccagtacagagtcctccctgttgagatccctaggcctcagcccaggtcctggcagcagtgaggtggagctggactgttggtttgatgaggatttcaagttcatcctgctgcctgtgagctatgcagttgtctttgtgctgggcttgggccttaacgccccaacccgactcggaccgatg

SEQ ID NO: 2420 - DNA, 203 bp, Homo sapiens
  source 1..203: mol_type = other DNA
ggcgcgccagtcctctatggctcttcatcttccgcctccgaccctgggatgcaacggccacctacatgttccacctggcattgtcagacaccttgtatgtgctgtcgctgcccaccctcatctactattatgcagcccacaaccactggccctttggcactgagatctgcaagttcgtccgctttcttcgactcggaccgatg

SEQ ID NO: 2421 - DNA, 203 bp, Homo sapiens
  source 1..203: mol_type = other DNA
ggcgcgccagtcctttctattggaacctctactgcagtgtccttttcctcacctgcatcagcgtgcaccgctacctgggcatctgccacccacttcgggcactacgctggggccgccctcgcctcgcaggccttctctgcctggcagtttggttggtcgtagccggctgcctcgtgcccaacctgttccgactcggaccgatg

SEQ ID NO: 2422 - DNA, 203 bp, Homo sapiens
  source 1..203: mol_type = other DNA
ggcgcgccagtccttttgtcacaaccagcaacaaagggaccaccgtcctgtgccatgacaccactcggcctgaagagtttgaccactatgtgcacttcagctcggcggtcatggggctgctctttggcgtgccctgcctggtcactcttgtttgctatggactcatggctcgtcgcctgtatcagccccgactcggaccgatg

SEQ ID NO: 2423 - DNA, 203 bp, Homo sapiens
  source 1..203: mol_type = other DNA
ggcgcgccagtcctttgccaggctctgcacagtcgtcttctcgcctccgctctctccgcaccatagctgtggtgctgactgtctttgctgtctgcttcgtgcctttccacatcacccgcaccatttactacctggccaggctgttggaagctgactgccgagtactgaacattgtcaacgtggtctatcgactcggaccgatg

SEQ ID NO: 2424 - DNA, 203 bp, Homo sapiens
  source 1..203: mol_type = other DNA
ggcgcgccagtcctaaagtgactcggcccctggccagtgccaacagctgcctggatcctgtgctctacttgctcactggggacaaatatcgacgtcagctccgtcagctctgtggtggtggcaagccccagccccgcacggctgcctcttccctggcactagtgtccctgcctgaggatagcagctgccgactcggaccgatg

SEQ ID NO: 2425 - DNA, 203 bp, Homo sapiens
  source 1..203: mol_type = other DNA
ggcgcgccagtcctccctcaccctgagggttgcagggaggcagggatatcatgggtgacctcatctctcataaccccttcagttgccgactctttttagccaatgccaatcttctactcctttctcgttgtttctgttccttcctggggccattggtcctacaatcttcctgaaaatcttccccagtccgactcggaccgatg

SEQ ID NO: 2426 - DNA, 203 bp, Homo sapiens
  source 1..203: mol_type = other DNA
ggcgcgccagtcctgactctttttagccaatgccaatcttctactcctttctcgttgtttctgttccttcctggggccattggtcctacaatcttcctgaaaatcttccccagtcctctttccctgtcccatttcccccacagcctcctatagcatgtgtttctctacccagaccagagcattcagctcgactcggaccgatg

SEQ ID NO: 2427 - DNA, 203 bp, Homo sapiens
  source 1..203: mol_type = other DNA
ggcgcgccagtcctcctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctcgactcggaccgatg

SEQ ID NO: 2428 - DNA, 203 bp, Homo sapiens
  source 1..203: mol_type = other DNA
ggcgcgccagtcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggccgactcggaccgatg

SEQ ID NO: 2429 - DNA, 203 bp, Homo sapiens
  source 1..203: mol_type = other DNA
ggcgcgccagtcctcgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagcgactcggaccgatg

SEQ ID NO: 2430 - DNA, 203 bp, Homo sapiens
  source 1..203: mol_type = other DNA
ggcgcgccagtcctacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttacgactcggaccgatg

SEQ ID NO: 2431 - DNA, 203 bp, Homo sapiens
  source 1..203: mol_type = other DNA
ggcgcgccagtcctcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtgcgactcggaccgatg

SEQ ID NO: 2432 - DNA, 203 bp, Homo sapiens
  source 1..203: mol_type = other DNA
ggcgcgccagtcctttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagttcgactcggaccgatg

SEQ ID NO: 2433 - DNA, 203 bp, Homo sapiens
  source 1..203: mol_type = other DNA
ggcgcgccagtcctcgtgcccgccgcccgggccccgcgccagggcgcacacgctcccgcccccctacccggcccgggcgggagtttgcacctctccctgcccgggtgctcgagctgccgttgcaaagccaactttggaaaaagttttttgggggagacttgggccttgaggtgcccagctccgcgcttcgactcggaccgatg

SEQ ID NO: 2434 - DNA, 203 bp, Homo sapiens
  source 1..203: mol_type = other DNA
ggcgcgccagtcctctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcacgactcggaccgatg

SEQ ID NO: 2435 - DNA, 203 bp, Homo sapiens
  source 1..203: mol_type = other DNA
ggcgcgccagtcctacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccgactcggaccgatg

SEQ ID NO: 2436 - DNA, 203 bp, Homo sapiens
  source 1..203: mol_type = other DNA
ggcgcgccagtcctcggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcgactcggaccgatg

SEQ ID NO: 2437 - DNA, 203 bp, Homo sapiens
  source 1..203: mol_type = other DNA
ggcgcgccagtcctcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccgactcggaccgatg

SEQ ID NO: 2438 - DNA, 203 bp, Homo sapiens
  source 1..203: mol_type = other DNA
ggcgcgccagtcctcggcgtcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtgcgactcggaccgatg

SEQ ID NO: 2439 - DNA, 203 bp, Homo sapiens
  source 1..203: mol_type = other DNA
ggcgcgccagtcctgactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacacccgactcggaccgatg

SEQ ID NO: 2440 - DNA, 203 bp, Homo sapiens
  source 1..203: mol_type = other DNA
ggcgcgccagtcctcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcgactcggaccgatg

SEQ ID NO: 2441 - DNA, 203 bp, Homo sapiens
  source 1..203: mol_type = other DNA
ggcgcgccagtcctaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtggcgactcggaccgatg

SEQ ID NO: 2442 - DNA, 203 bp, Homo sapiens
  source 1..203: mol_type = other DNA
ggcgcgccagtcctgctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttacgactcggaccgatg

SEQ ID NO: 2443 - DNA, 203 bp, Homo sapiens
  source 1..203: mol_type = other DNA
ggcgcgccagtcctggaggtaagaactaagacgttcttaaaccctactacgtgctggaatcctgaagtgcctgccatcattcaaacttaagcactaactctctagagagacactgccattcataccacagaacgagaaggcagtggcgatcctcaacggctacatgtcactgcctgccacttccggctcgactcggaccgatg

SEQ ID NO: 2444 - DNA, 203 bp, Homo sapiens
  source 1..203: mol_type = other DNA
ggcgcgccagtcctacgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcgactcggaccgatg

SEQ ID NO: 2445 - DNA, 203 bp, Homo sapiens
  source 1..203: mol_type = other DNA
ggcgcgccagtcctcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatcgactcggaccgatg

SEQ ID NO: 2446 - DNA, 203 bp, Homo sapiens
  source 1..203: mol_type = other DNA
ggcgcgccagtccttttggagactctgggatgagtgtgcatttattttcagagttgacataatatgataatgtgacaattatgagactgttttaaaccttaagacctgatgcctcagttgtaacttttttttttttttctgagacggtgtcctgctctgtcacccaggctggagtgcagtggcgcgatcgactcggaccgatg

SEQ ID NO: 2447 - DNA, 203 bp, Homo sapiens
  source 1..203: mol_type = other DNA
ggcgcgccagtccttaattctgtatccttcactctttttctctgcctttttttacttaaaagtaaattcagactcttaaaatggtatagaattattagcttgaacattgaattatctcgtcttaactagaatgttttttaaaaaacagtttttaaatgtttttaaataaacatcttgctagtatgatgcgactcggaccgatg

SEQ ID NO: 2448 - DNA, 203 bp, Homo sapiens
  source 1..203: mol_type = other DNA
ggcgcgccagtcctcatctgagcctcccaagttgctgggaccacaggcccataccaccatgcctggctaatttttgtagagatgaggtctcactttgttgcccaggctggtcttgaacttctgggctcaagcagtcctcctaccctggcctcccaaagttgtgggattacaggcatgagccactgcaccgactcggaccgatg

SEQ ID NO: 2449 - DNA, 203 bp, Homo sapiens
  source 1..203: mol_type = other DNA
ggcgcgccagtcctcctaaaggagtcctggaggaggccgttcaccacaggaaactgaggtgttcttagaagggtggatgctggcagatctctactagttagagtctacatttgccttactcatttcaaaagtccacattgcagtctcattttaccagtgatctagcttgataaggacattcataagtacgactcggaccgatg

SEQ ID NO: 2450 - DNA, 203 bp, Homo sapiens
  source 1..203: mol_type = other DNA
ggcgcgccagtccttcgctccggaagcctgcgagttccggaagccttggtaatccagattcggctaggaaaagacaagctttccagagaatgtttcagagaaagttacgtggagcgtgggcgtttcgcagactcctaagtggtctggaacctaacctgcagtgtctctgagcttctggcaagtatgagcgactcggaccgatg

SEQ ID NO: 2451 - DNA, 203 bp, Homo sapiens
  source 1..203: mol_type = other DNA
ggcgcgccagtcctgtgtgaattttgtgattggacttttgaaattaggtgggctgattaattttttgattttccttcagaggggaaagtttgcaactttgacagaacgtctcctaggtattcattctgtattttgcaagcctcaaaacatacgtgaagttggctttgaatacatgaatagggaacttccgactcggaccgatg

SEQ ID NO: 2452 - DNA, 203 bp, Homo sapiens
  source 1..203: mol_type = other DNA
ggcgcgccagtcctctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttacgactcggaccgatg

SEQ ID NO: 2453 - DNA, 203 bp, Homo sapiens
  source 1..203: mol_type = other DNA
ggcgcgccagtcctgtatgaacagcactatttacaggtctctttctcttgcctttgattcagagctgtcattctcagtaaatattgatagttttattgaaacaaaaggggtctttagcatgggaatagtaacagcagtgcataatcaagataattctgtatccttcactctttttctctgccttttttcgactcggaccgatg

SEQ ID NO: 2454 - DNA, 203 bp, Homo sapiens
  source 1..203: mol_type = other DNA
ggcgcgccagtccttaagagtattttacatcttaagaatttgccttcttttgccttctgtaattttaaaacattattgtagaaaacaccaacaattcaggaaaaaatataaaatcaactttcccacaattttttgagagagatcatcactatattttactatatttgtagatttgttgcacgtacattcgactcggaccgatg

SEQ ID NO: 2455 - DNA, 203 bp, Homo sapiens
  source 1..203: mol_type = other DNA
ggcgcgccagtcctatacaaacgtctttgttttttgtttgtttgtttgtttttggtgagaaagggcctcacccagtcacccaggttggagtgcagtggtgtgatcatggctaaccgcagcctttccctcccagggctcaagcgatcctcccatctgagcctcccaagttgctgggaccacaggcccatcgactcggaccgatg

SEQ ID NO: 2456 - DNA, 203 bp, Homo sapiens
  source 1..203: mol_type = other DNA
ggcgcgccagtccttgacacatagtaaatagaatataatagtagtgctttcctttgctgttgtcagtattactctgagtcggtttcattctcacacagaatgatggccgctagaagctcaaggcttataatctgctagctttctgatcccactggcatgagatactcttgcctaatagttacagctaacgactcggaccgatg

SEQ ID NO: 2457 - DNA, 203 bp, Homo sapiens
  source 1..203: mol_type = other DNA
ggcgcgccagtcctagtccaggagctcactgttactggtctgccttggattatgtgcacattcctgaaccagccactatagctaggggatggaaaatactgttcctggttacttaaatgtaggtgatgctcctcccatataccacatgaacctaaaggagtcctggaggaggccgttcaccacaggaacgactcggaccgatg

SEQ ID NO: 2458 - DNA, 203 bp, Homo sapiens
  source 1..203: mol_type = other DNA
ggcgcgccagtcctactgaggtgttcttagaagggtggatgctggcagatctctactagttagagtctacatttgccttactcatttcaaaagtccacattgcagtctcattttaccagtgatctagcttgataaggacattcataagtaactggatgattctttaacattgcagatttgaaaggattcgactcggaccgatg

SEQ ID NO: 2459 - DNA, 203 bp, Homo sapiens
  source 1..203: mol_type = other DNA
ggcgcgccagtcctcgagccgctcaccccgccgttctcagcgctgcccgaccccgctcgcgcgccctcccgccgccagtcccggcagcgccctcagttgtcctccgactcgccctcggccttccgcgccagccgcagccacagccgcaacgccacccgcagccacagccacagccacagccccaggcacgactcggaccgatg

SEQ ID NO: 2460 - DNA, 203 bp, Homo sapiens
  source 1..203: mol_type = other DNA
ggcgcgccagtccttagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaacgactcggaccgatg

SEQ ID NO: 2461 - DNA, 203 bp, Homo sapiens
  source 1..203: mol_type = other DNA
ggcgcgccagtcctggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggacgactcggaccgatg

SEQ ID NO: 2462 - DNA, 203 bp, Homo sapiens
  source 1..203: mol_type = other DNA
ggcgcgccagtcctagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcgactcggaccgatg

SEQ ID NO: 2463 - DNA, 203 bp, Homo sapiens
  source 1..203: mol_type = other DNA
ggcgcgccagtccttcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcgactcggaccgatg

SEQ ID NO: 2464 - DNA, 203 bp, Homo sapiens
  source 1..203: mol_type = other DNA
ggcgcgccagtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccgactcggaccgatg

SEQ ID NO: 2465 - DNA, 203 bp, Homo sapiens
  source 1..203: mol_type = other DNA
ggcgcgccagtcctcaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggcgactcggaccgatg

SEQ ID NO: 2466 - DNA, 203 bp, Homo sapiens
  source 1..203: mol_type = other DNA
ggcgcgccagtcctcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcccgactcggaccgatg

SEQ ID NO: 2467 - DNA, 203 bp, Homo sapiens
  source 1..203: mol_type = other DNA
ggcgcgccagtccttgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgcgactcggaccgatg

SEQ ID NO: 2468 - DNA, 203 bp, Homo sapiens
  source 1..203: mol_type = other DNA
ggcgcgccagtcctcacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagacgactcggaccgatg

SEQ ID NO: 2469 - DNA, 203 bp, Homo sapiens
  source 1..203: mol_type = other DNA
ggcgcgccagtcctgaggctgaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccacgactcggaccgatg

SEQ ID NO: 2470 - DNA, 203 bp, Homo sapiens
  source 1..203: mol_type = other DNA
ggcgcgccagtcctctcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagcgactcggaccgatg

SEQ ID NO: 2471 - DNA, 203 bp, Homo sapiens
  source 1..203: mol_type = other DNA
ggcgcgccagtcctaccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggctcgactcggaccgatg

SEQ ID NO: 2472 - DNA, 203 bp, Homo sapiens
  source 1..203: mol_type = other DNA
ggcgcgccagtcctcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggccgactcggaccgatg

SEQ ID NO: 2473 - DNA, 203 bp, Homo sapiens
  source 1..203: mol_type = other DNA
ggcgcgccagtcctccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactcgactcggaccgatg

SEQ ID NO: 2474 - DNA, 203 bp, Homo sapiens
  source 1..203: mol_type = other DNA
ggcgcgccagtccttctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcaccaaaaaaaaaaaaaaacgactcggaccgatg

SEQ ID NO: 2475 - DNA, 203 bp, Homo sapiens
  source 1..203: mol_type = other DNA
ggcgcgccagtcctggccggccccgggcacgcaggcagggcggcgcaggatccagggcgtctgggatgcagtggagctcagagagaggagaacggctcctcacgcctggggcctgctcttcagaagtccccagcgccgttccttccagatcaggacctcagcagccatgtcgaagccccatagtgaagcgactcggaccgatg

SEQ ID NO: 2476 - DNA, 203 bp, Homo sapiens
  source 1..203: mol_type = other DNA
ggcgcgccagtcctccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattacgactcggaccgatg

SEQ ID NO: 2477 - DNA, 203 bp, Homo sapiens
  source 1..203: mol_type = other DNA
ggcgcgccagtcctagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcacgactcggaccgatg

SEQ ID NO: 2478 - DNA, 203 bp, Homo sapiens
  source 1..203: mol_type = other DNA
ggcgcgccagtccttgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgcgactcggaccgatg

SEQ ID NO: 2479 - DNA, 203 bp, Homo sapiens
  source 1..203: mol_type = other DNA
ggcgcgccagtcctaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgccgactcggaccgatg

SEQ ID NO: 2480 - DNA, 203 bp, Homo sapiens
  source 1..203: mol_type = other DNA
ggcgcgccagtccttccgcccccttcccgcctccccgtatataagacttcgccgagcgctctcactcgcacaagtggaccggggtgttgggtgctagtcggcaccagaggcaagggtgcgaggaccacggccggctcggacgtgtgaccgcgcctagggggtggcagcgggcagtgcggggcggcaagcgactcggaccgatg

SEQ ID NO: 2481 - DNA, 203 bp, Homo sapiens
  source 1..203: mol_type = other DNA
ggcgcgccagtcctgcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctacgactcggaccgatg

SEQ ID NO: 2482 - DNA, 203 bp, Homo sapiens
  source 1..203: mol_type = other DNA
ggcgcgccagtcctcttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctccgactcggaccgatg

SEQ ID NO: 2483 - DNA, 203 bp, Homo sapiens
  source 1..203: mol_type = other DNA
ggcgcgccagtccttcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattaccgactcggaccgatg

SEQ ID NO: 2484 - DNA, 203 bp, Homo sapiens
  source 1..203: mol_type = other DNA
ggcgcgccagtcctcaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgcgactcggaccgatg

SEQ ID NO: 2485 - DNA, 203 bp, Homo sapiens
  source 1..203: mol_type = other DNA
ggcgcgccagtcctggactcctcttttccactgtgagatctacagggaagccaaaagaatgatctagagtatgttgaagaagatggacatgtggtggtacgaaaacaattcccctgtggcctgctggactggttggaaccagaacaggctaaggcatacagttcttgactttggacaatccaagagtgcgactcggaccgatg

SEQ ID NO: 2486 - DNA, 203 bp, Homo sapiens
  source 1..203: mol_type = other DNA
ggcgcgccagtcctgcgccgcctccttcggcgttcgccccagggaccggcaggcgggggaccgcggcccaggctgaagctcagggccctgtctgctctgtggactcaacagtttgtggcaagacaagctcagaactgagaagctgtcaccacagtagcttggagctcggcggcacaaccagcaccatccgactcggaccgatg

SEQ ID NO: 2487 - DNA, 203 bp, Homo sapiens
  source 1..203: mol_type = other DNA
ggcgcgccagtccttggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtcgactcggaccgatg

SEQ ID NO: 2488 - DNA, 203 bp, Homo sapiens
  source 1..203: mol_type = other DNA
ggcgcgccagtcctatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattcgactcggaccgatg

SEQ ID NO: 2489 - DNA, 203 bp, Homo sapiens
  source 1..203: mol_type = other DNA
ggcgcgccagtcctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacgactcggaccgatg

SEQ ID NO: 2490 - DNA, 203 bp, Homo sapiens
  source 1..203: mol_type = other DNA
ggcgcgccagtcctgcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtacgactcggaccgatg

SEQ ID NO: 2491 - DNA, 203 bp, Homo sapiens
  source 1..203: mol_type = other DNA
ggcgcgccagtcctaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatccgactcggaccgatg

SEQ ID NO: 2492 - DNA, 203 bp, Homo sapiens
  source 1..203: mol_type = other DNA
ggcgcgccagtcctctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgaccgactcggaccgatg

SEQ ID NO: 2493 - DNA, 203 bp, Homo sapiens
  source 1..203: mol_type = other DNA
ggcgcgccagtcctgtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgacgactcggaccgatg

SEQ ID NO: 2494 - DNA, 203 bp, Homo sapiens
  source 1..203: mol_type = other DNA
ggcgcgccagtcctaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaacgactcggaccgatg

SEQ ID NO: 2495 - DNA, 203 bp, Homo sapiens
  source 1..203: mol_type = other DNA
ggcgcgccagtcctatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagcgactcggaccgatg

SEQ ID NO: 2496 - DNA, 203 bp, Homo sapiens
  source 1..203: mol_type = other DNA
ggcgcgccagtccttctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcacgactcggaccgatg

SEQ ID NO: 2497 - DNA, 203 bp, Homo sapiens
  source 1..203: mol_type = other DNA
ggcgcgccagtcctcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaaccgactcggaccgatg

SEQ ID NO: 2498 - DNA, 203 bp, Homo sapiens
  source 1..203: mol_type = other DNA
ggcgcgccagtcctgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaacgactcggaccgatg

SEQ ID NO: 2499 - DNA, 203 bp, Homo sapiens
  source 1..203: mol_type = other DNA
ggcgcgccagtccttggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggcgactcggaccgatg

SEQ ID NO: 2500 - DNA, 203 bp, Homo sapiens
  source 1..203: mol_type = other DNA
ggcgcgccagtcctaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttcgactcggaccgatg

SEQ ID NO: 2501 - DNA, 203 bp, Homo sapiens
  source 1..203: mol_type = other DNA
ggcgcgccagtcctccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcaccgactcggaccgatg

SEQ ID NO: 2502 - DNA, 203 bp, Homo sapiens
  source 1..203: mol_type = other DNA
ggcgcgccagtcctagcagattcagtgtcatgtgaggacgtgcttcctgcttcatagataagagtagcttggagctcggcggcacaaccagcaccatctggtcgcgatggtggacacggaaagcccactctgccccctctccccactcgaggccggcgatctagagagcccgttatctgaagagttcccgactcggaccgatg

SEQ ID NO: 2503 - DNA, 203 bp, Homo sapiens
  source 1..203: mol_type = other DNA
ggcgcgccagtcctagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagcgactcggaccgatg

SEQ ID NO: 2504 - DNA, 203 bp, Homo sapiens
  source 1..203: mol_type = other DNA
ggcgcgccagtcctccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatatcgactcggaccgatg

SEQ ID NO: 2505 - DNA, 203 bp, Homo sapiens
  source 1..203: mol_type = other DNA
ggcgcgccagtcctggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacggggcgactcggaccgatg

SEQ ID NO: 2506 - DNA, 203 bp, Homo sapiens
  source 1..203: mol_type = other DNA
ggcgcgccagtcctgagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgcgactcggaccgatg

SEQ ID NO: 2507 - DNA, 203 bp, Homo sapiens
  source 1..203: mol_type = other DNA
ggcgcgccagtcctcgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacgactcggaccgatg

SEQ ID NO: 2508 - DNA, 203 bp, Homo sapiens
  source 1..203: mol_type = other DNA
ggcgcgccagtcctcagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgcgactcggaccgatg

SEQ ID NO: 2509 - DNA, 203 bp, Homo sapiens
  source 1..203: mol_type = other DNA
ggcgcgccagtcctttgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccgactcggaccgatg

SEQ ID NO: 2510 - DNA, 203 bp, Homo sapiens
  source 1..203: mol_type = other DNA
ggcgcgccagtccttgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaacgactcggaccgatg

SEQ ID NO: 2511 - DNA, 203 bp, Homo sapiens
  source 1..203: mol_type = other DNA
ggcgcgccagtcctgacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaacgactcggaccgatg

SEQ ID NO: 2512 - DNA, 203 bp, Homo sapiens
  source 1..203: mol_type = other DNA
ggcgcgccagtcctttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagcgactcggaccgatg

SEQ ID NO: 2513 - DNA, 203 bp, Homo sapiens
  source 1..203: mol_type = other DNA
ggcgcgccagtcctactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcgactcggaccgatg

SEQ ID NO: 2514 - DNA, 203 bp, Homo sapiens
  source 1..203: mol_type = other DNA
ggcgcgccagtcctcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttcgactcggaccgatg

SEQ ID NO: 2515 - DNA, 203 bp, Homo sapiens
  source 1..203: mol_type = other DNA
ggcgcgccagtcctaaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttcccgactcggaccgatg

SEQ ID NO: 2516 - DNA, 203 bp, Homo sapiens
  source 1..203: mol_type = other DNA
ggcgcgccagtcctgctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcgactcggaccgatg

SEQ ID NO: 2517 - DNA, 203 bp, Homo sapiens
  source 1..203: mol_type = other DNA
ggcgcgccagtcctcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgcgactcggaccgatg

SEQ ID NO: 2518 - DNA, 203 bp, Homo sapiens
  source 1..203: mol_type = other DNA
ggcgcgccagtccttaaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagcgactcggaccgatg

SEQ ID NO: 2519 - DNA, 203 bp, Homo sapiens
  source 1..203: mol_type = other DNA
ggcgcgccagtccttggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacgactcggaccgatg

SEQ ID NO: 2520 - DNA, 203 bp, Homo sapiens
  source 1..203: mol_type = other DNA
ggcgcgccagtcctcccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgccgactcggaccgatg

SEQ ID NO: 2521 - DNA, 203 bp, Homo sapiens
  source 1..203: mol_type = other DNA
ggcgcgccagtcctagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcgactcggaccgatg

SEQ ID NO: 2522 - DNA, 203 bp, Homo sapiens
  source 1..203: mol_type = other DNA
ggcgcgccagtcctcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacaccgactcggaccgatg

SEQ ID NO: 2523 - DNA, 203 bp, Homo sapiens
  source 1..203: mol_type = other DNA
ggcgcgccagtcctcaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccgactcggaccgatg

SEQ ID NO: 2524 - DNA, 203 bp, Homo sapiens
  source 1..203: mol_type = other DNA
ggcgcgccagtcctcagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgactcggaccgatg

SEQ ID NO: 2525 - DNA, 203 bp, Homo sapiens
  source 1..203: mol_type = other DNA
ggcgcgccagtcctgaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaaaaaaaaaaaaaaacgactcggaccgatg

SEQ ID NO: 2526 - DNA, 203 bp, Homo sapiens
  source 1..203: mol_type = other DNA
ggcgcgccagtcctggacagtgcgcatctccctggtcaccaaggaccctcctcaccggcctcacccccacgagcttgtaggaaaggactgccgggatggcttctatgaggctgagctctgccgggaccgctgcatccacagtttccagaacctgggaatccagtgtgtgaagaagcgggacctggagccgactcggaccgatg

SEQ ID NO: 2527 - DNA, 203 bp, Homo sapiens
  source 1..203: mol_type = other DNA
ggcgcgccagtcctaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacacgactcggaccgatg

SEQ ID NO: 2528 - DNA, 203 bp, Homo sapiens
  source 1..203: mol_type = other DNA
ggcgcgccagtcctatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgcgactcggaccgatg

SEQ ID NO: 2529 - DNA, 203 bp, Homo sapiens
  source 1..203: mol_type = other DNA
ggcgcgccagtcctctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagccgactcggaccgatg

SEQ ID NO: 2530 - DNA, 203 bp, Homo sapiens
  source 1..203: mol_type = other DNA
ggcgcgccagtcctagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagactcgactcggaccgatg

SEQ ID NO: 2531 - DNA, 203 bp, Homo sapiens
  source 1..203: mol_type = other DNA
ggcgcgccagtcctccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcgactcggaccgatg

SEQ ID NO: 2532 - DNA, 203 bp, Homo sapiens
  source 1..203: mol_type = other DNA
ggcgcgccagtcctaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctcgactcggaccgatg

SEQ ID NO: 2533 - DNA, 203 bp, Homo sapiens
  source 1..203: mol_type = other DNA
ggcgcgccagtcctcaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggcgactcggaccgatg

SEQ ID NO: 2534 - DNA, 203 bp, Homo sapiens
  source 1..203: mol_type = other DNA
ggcgcgccagtcctactgcggccgtgtctgtggcagctggagacagagctgagggagcaagaggtgtcggaggtctcatctttgaactactgccggagcttctgccagaccttattgcaatatgcaagcaacaagaatgcatcagaacatattgtgtatcttctggaggtatatcgacttgccatccacgactcggaccgatg

SEQ ID NO: 2535 - DNA, 203 bp, Homo sapiens
  source 1..203: mol_type = other DNA
ggcgcgccagtcctaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattcgactcggaccgatg

SEQ ID NO: 2536 - DNA, 203 bp, Homo sapiens
  source 1..203: mol_type = other DNA
ggcgcgccagtcctgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactcgactcggaccgatg

SEQ ID NO: 2537 - DNA, 203 bp, Homo sapiens
  source 1..203: mol_type = other DNA
ggcgcgccagtccttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatcgactcggaccgatg

SEQ ID NO: 2538 - DNA, 203 bp, Homo sapiens
  source 1..203: mol_type = other DNA
ggcgcgccagtcctctctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacgcgactcggaccgatg

SEQ ID NO: 2539 - DNA, 203 bp, Homo sapiens
  source 1..203: mol_type = other DNA
ggcgcgccagtccttgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagccgactcggaccgatg

SEQ ID NO: 2540 - DNA, 203 bp, Homo sapiens
  source 1..203: mol_type = other DNA
ggcgcgccagtccttctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggacgactcggaccgatg

SEQ ID NO: 2541 - DNA, 203 bp, Homo sapiens
  source 1..203: mol_type = other DNA
ggcgcgccagtcctctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgctcgactcggaccgatg

SEQ ID NO: 2542 - DNA, 203 bp, Homo sapiens
  source 1..203: mol_type = other DNA
ggcgcgccagtccttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggcgactcggaccgatg

SEQ ID NO: 2543 - DNA, 203 bp, Homo sapiens
  source 1..203: mol_type = other DNA
ggcgcgccagtccttccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctccgactcggaccgatg

SEQ ID NO: 2544 - DNA, 203 bp, Homo sapiens
  source 1..203: mol_type = other DNA
ggcgcgccagtccttctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgcgactcggaccgatg

SEQ ID NO: 2545 - DNA, 203 bp, Homo sapiens
  source 1..203: mol_type = other DNA
ggcgcgccagtcctggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgcgactcggaccgatg

SEQ ID NO: 2546 - DNA, 203 bp, Homo sapiens
  source 1..203: mol_type = other DNA
ggcgcgccagtcctccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccgcgactcggaccgatg

SEQ ID NO: 2547 - DNA, 203 bp, Homo sapiens
  source 1..203: mol_type = other DNA
ggcgcgccagtcctgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtcgactcggaccgatg

SEQ ID NO: 2548 - DNA, 203 bp, Homo sapiens
  source 1..203: mol_type = other DNA
ggcgcgccagtcctatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagcgactcggaccgatg

SEQ ID NO: 2549 - DNA, 203 bp, Homo sapiens
  source 1..203: mol_type = other DNA
ggcgcgccagtccttggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatcccgactcggaccgatg

SEQ ID NO: 2550 - DNA, 203 bp, Homo sapiens
  source 1..203: mol_type = other DNA
ggcgcgccagtcctaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagccttcgactcggaccgatg

SEQ ID NO: 2551 - DNA, 203 bp, Homo sapiens
  source 1..203: mol_type = other DNA
ggcgcgccagtccttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaacgactcggaccgatg

SEQ ID NO: 2552 - DNA, 203 bp, Homo sapiens
  source 1..203: mol_type = other DNA
ggcgcgccagtccttctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagcgactcggaccgatg

SEQ ID NO: 2553 - DNA, 203 bp, Homo sapiens
  source 1..203: mol_type = other DNA
ggcgcgccagtcctttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaacgactcggaccgatg

SEQ ID NO: 2554 - DNA, 203 bp, Homo sapiens
  source 1..203: mol_type = other DNA
ggcgcgccagtcctaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccacgactcggaccgatg

SEQ ID NO: 2555 - DNA, 203 bp, Homo sapiens
  source 1..203: mol_type = other DNA
ggcgcgccagtcctcctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagcgactcggaccgatg

SEQ ID NO: 2556 - DNA, 203 bp, Homo sapiens
  source 1..203: mol_type = other DNA
ggcgcgccagtccttgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcgactcggaccgatg

SEQ ID NO: 2557 - DNA, 203 bp, Homo sapiens
  source 1..203: mol_type = other DNA
ggcgcgccagtccttatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatcgactcggaccgatg

SEQ ID NO: 2558 - DNA, 203 bp, Homo sapiens
  source 1..203: mol_type = other DNA
ggcgcgccagtcctttttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcagcgactcggaccgatg

SEQ ID NO: 2559 - DNA, 203 bp, Homo sapiens
  source 1..203: mol_type = other DNA
ggcgcgccagtcctttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtcgactcggaccgatg

SEQ ID NO: 2560 - DNA, 203 bp, Homo sapiens
  source 1..203: mol_type = other DNA
ggcgcgccagtcctgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctcgactcggaccgatg

SEQ ID NO: 2561 - DNA, 203 bp, Homo sapiens
  source 1..203: mol_type = other DNA
ggcgcgccagtcctatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctggcgactcggaccgatg

SEQ ID NO: 2562 - DNA, 203 bp, Homo sapiens
  source 1..203: mol_type = other DNA
ggcgcgccagtcctgagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgtcgactcggaccgatg

SEQ ID NO: 2563 - DNA, 203 bp, Homo sapiens
  source 1..203: mol_type = other DNA
ggcgcgccagtcctagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgccgactcggaccgatg

SEQ ID NO: 2564 - DNA, 203 bp, Homo sapiens
  source 1..203: mol_type = other DNA
ggcgcgccagtcctaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcgactcggaccgatg

SEQ ID NO: 2565 - DNA, 203 bp, Homo sapiens
  source 1..203: mol_type = other DNA
ggcgcgccagtcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagcgactcggaccgatg

SEQ ID NO: 2566 - DNA, 203 bp, Homo sapiens
  source 1..203: mol_type = other DNA
ggcgcgccagtcctaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccacgactcggaccgatg

SEQ ID NO: 2567 - DNA, 203 bp, Homo sapiens
  source 1..203: mol_type = other DNA
ggcgcgccagtcctacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagcgactcggaccgatg

SEQ ID NO: 2568 - DNA, 203 bp, Homo sapiens
  source 1..203: mol_type = other DNA
ggcgcgccagtcctaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtcgactcggaccgatg

SEQ ID NO: 2569 - DNA, 203 bp, Homo sapiens
  source 1..203: mol_type = other DNA
ggcgcgccagtcctacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcacgactcggaccgatg

SEQ ID NO: 2570 - DNA, 203 bp, Homo sapiens
  source 1..203: mol_type = other DNA
ggcgcgccagtccttgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgacgactcggaccgatg

SEQ ID NO: 2571 - DNA, 203 bp, Homo sapiens
  source 1..203: mol_type = other DNA
ggcgcgccagtcctaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaaccgactcggaccgatg

SEQ ID NO: 2572 - DNA, 203 bp, Homo sapiens
  source 1..203: mol_type = other DNA
ggcgcgccagtcctaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactcgactcggaccgatg

SEQ ID NO: 2573 - DNA, 203 bp, Homo sapiens
  source 1..203: mol_type = other DNA
ggcgcgccagtccttacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctaccgactcggaccgatg

SEQ ID NO: 2574 - DNA, 203 bp, Homo sapiens
  source 1..203: mol_type = other DNA
ggcgcgccagtccttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctccgactcggaccgatg

SEQ ID NO: 2575 - DNA, 203 bp, Homo sapiens
  source 1..203: mol_type = other DNA
ggcgcgccagtcctgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggcgactcggaccgatg

SEQ ID NO: 2576 - DNA, 203 bp, Homo sapiens
  source 1..203: mol_type = other DNA
ggcgcgccagtcctaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgccgactcggaccgatg

SEQ ID NO: 2577 - DNA, 203 bp, Homo sapiens
  source 1..203: mol_type = other DNA
ggcgcgccagtcctgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggccgactcggaccgatg

SEQ ID NO: 2578 - DNA, 203 bp, Homo sapiens
  source 1..203: mol_type = other DNA
ggcgcgccagtcctaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagattttcgactcggaccgatg

SEQ ID NO: 2579 - DNA, 203 bp, Homo sapiens
  source 1..203: mol_type = other DNA
ggcgcgccagtcctccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacaccgactcggaccgatg

SEQ ID NO: 2580 - DNA, 203 bp, Homo sapiens
  source 1..203: mol_type = other DNA
ggcgcgccagtcctactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagacctttcgactcggaccgatg

SEQ ID NO: 2581 - DNA, 203 bp, Homo sapiens
  source 1..203: mol_type = other DNA
ggcgcgccagtccttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgacgactcggaccgatg

SEQ ID NO: 2582 - DNA, 203 bp, Homo sapiens
  source 1..203: mol_type = other DNA
ggcgcgccagtcctaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctcccgactcggaccgatg

SEQ ID NO: 2583 - DNA, 203 bp, Homo sapiens
  source 1..203: mol_type = other DNA
ggcgcgccagtcctggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggcgactcggaccgatg

SEQ ID NO: 2584 - DNA, 203 bp, Homo sapiens
  source 1..203: mol_type = other DNA
ggcgcgccagtcctctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccgactcggaccgatg

SEQ ID NO: 2585 - DNA, 203 bp, Homo sapiens
  source 1..203: mol_type = other DNA
ggcgcgccagtcctggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagcgactcggaccgatg

SEQ ID NO: 2586 - DNA, 203 bp, Homo sapiens
  source 1..203: mol_type = other DNA
ggcgcgccagtcctttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggcgactcggaccgatg

SEQ ID NO: 2587 - DNA, 203 bp, Homo sapiens
  source 1..203: mol_type = other DNA
ggcgcgccagtcctctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacacgactcggaccgatg

SEQ ID NO: 2588 - DNA, 203 bp, Homo sapiens
  source 1..203: mol_type = other DNA
ggcgcgccagtcctaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcgactcggaccgatg

SEQ ID NO: 2589 - DNA, 203 bp, Homo sapiens
  source 1..203: mol_type = other DNA
ggcgcgccagtcctataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtctttttttcgactcggaccgatg

SEQ ID NO: 2590 - DNA, 203 bp, Homo sapiens
  source 1..203: mol_type = other DNA
ggcgcgccagtccttgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattccgactcggaccgatg

SEQ ID NO: 2591 - DNA, 203 bp, Homo sapiens
  source 1..203: mol_type = other DNA
ggcgcgccagtcctataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgccgactcggaccgatg

SEQ ID NO: 2592 - DNA, 203 bp, Homo sapiens
  source 1..203: mol_type = other DNA
ggcgcgccagtccttcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaacgactcggaccgatg

SEQ ID NO: 2593 - DNA, 203 bp, Homo sapiens
  source 1..203: mol_type = other DNA
ggcgcgccagtccttatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatacgactcggaccgatg

SEQ ID NO: 2594 - DNA, 203 bp, Homo sapiens
  source 1..203: mol_type = other DNA
ggcgcgccagtcctttatgattttcattctgttcagcggctatactcagactttactctaaaagtcaaatcttctgacattctttgaagtgaagcattctatgaatgtgagctgaagaaatgaatgaaatgaaataatgcagcatctagtgctttttgcatggcccaaaggggctctgtgctgctccacgactcggaccgatg

SEQ ID NO: 2595 - DNA, 203 bp, Homo sapiens
  source 1..203: mol_type = other DNA
ggcgcgccagtcctacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaacgactcggaccgatg

SEQ ID NO: 2596 - DNA, 203 bp, Homo sapiens
  source 1..203: mol_type = other DNA
ggcgcgccagtcctaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgtcgactcggaccgatg

SEQ ID NO: 2597 - DNA, 203 bp, Homo sapiens
  source 1..203: mol_type = other DNA
ggcgcgccagtccttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggcgactcggaccgatg

SEQ ID NO: 2598 - DNA, 203 bp, Homo sapiens
  source 1..203: mol_type = other DNA
ggcgcgccagtcctgcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgactcggaccgatg

SEQ ID NO: 2599 - DNA, 203 bp, Homo sapiens
  source 1..203: mol_type = other DNA
ggcgcgccagtcctcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcgcgactcggaccgatg

SEQ ID NO: 2600 - DNA, 203 bp, Homo sapiens
  source 1..203: mol_type = other DNA
ggcgcgccagtcctatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttcgactcggaccgatg

SEQ ID NO: 2601 - DNA, 203 bp, Homo sapiens
  source 1..203: mol_type = other DNA
ggcgcgccagtccttttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtcgactcggaccgatg

SEQ ID NO: 2602 - DNA, 203 bp, Homo sapiens
  source 1..203: mol_type = other DNA
ggcgcgccagtcctgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgcgactcggaccgatg

SEQ ID NO: 2603 - DNA, 203 bp, Homo sapiens
  source 1..203: mol_type = other DNA
ggcgcgccagtcctagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggcgactcggaccgatg

SEQ ID NO: 2604 - DNA, 203 bp, Homo sapiens
  source 1..203: mol_type = other DNA
ggcgcgccagtcctaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcatcgactcggaccgatg

SEQ ID NO: 2605 - DNA, 203 bp, Homo sapiens
  source 1..203: mol_type = other DNA
ggcgcgccagtcctaccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaacgactcggaccgatg

SEQ ID NO: 2606 - DNA, 203 bp, Homo sapiens
  source 1..203: mol_type = other DNA
ggcgcgccagtcctacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggcgactcggaccgatg

SEQ ID NO: 2607 - DNA, 203 bp, Homo sapiens
  source 1..203: mol_type = other DNA
ggcgcgccagtcctccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagccgactcggaccgatg

SEQ ID NO: 2608 - DNA, 203 bp, Homo sapiens
  source 1..203: mol_type = other DNA
ggcgcgccagtccttccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggaccgactcggaccgatg

SEQ ID NO: 2609 - DNA, 203 bp, Homo sapiens
  source 1..203: mol_type = other DNA
ggcgcgccagtccttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaacgactcggaccgatg

SEQ ID NO: 2610 - DNA, 203 bp, Homo sapiens
  source 1..203: mol_type = other DNA
ggcgcgccagtccttttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaacgactcggaccgatg

SEQ ID NO: 2611 - DNA, 203 bp, Homo sapiens
  source 1..203: mol_type = other DNA
ggcgcgccagtcctgtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattccgactcggaccgatg

SEQ ID NO: 2612 - DNA, 203 bp, Homo sapiens
  source 1..203: mol_type = other DNA
ggcgcgccagtcctacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaacgactcggaccgatg

SEQ ID NO: 2613 - DNA, 203 bp, Homo sapiens
  source 1..203: mol_type = other DNA
ggcgcgccagtccttgaggcatgagtaggggctgtatttgcgtgcaggcgggcccccaaagcttccactcgctgccttaaaacgccaacccagcctctcagacaatgctgccctcccactatgtactctaccacctatgaagagaggaatatcaccggaaccagggtgaaggtgcccgtggggcaggacgactcggaccgatg

SEQ ID NO: 2614 - DNA, 203 bp, Homo sapiens
  source 1..203: mol_type = other DNA
ggcgcgccagtcctggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcgactcggaccgatg

SEQ ID NO: 2615 - DNA, 203 bp, Homo sapiens
  source 1..203: mol_type = other DNA
ggcgcgccagtcctcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtcgactcggaccgatg

SEQ ID NO: 2616 - DNA, 203 bp, Homo sapiens
  source 1..203: mol_type = other DNA
ggcgcgccagtcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgacgactcggaccgatg

SEQ ID NO: 2617 - DNA, 203 bp, Homo sapiens
  source 1..203: mol_type = other DNA
ggcgcgccagtcctgtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttccgactcggaccgatg

SEQ ID NO: 2618 - DNA, 203 bp, Homo sapiens
  source 1..203: mol_type = other DNA
ggcgcgccagtccttgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtcgactcggaccgatg

SEQ ID NO: 2619 - DNA, 203 bp, Homo sapiens
  source 1..203: mol_type = other DNA
ggcgcgccagtcctcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccgactcggaccgatg

SEQ ID NO: 2620 - DNA, 203 bp, Homo sapiens
  source 1..203: mol_type = other DNA
ggcgcgccagtcctcaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggcgactcggaccgatg

SEQ ID NO: 2621 - DNA, 203 bp, Homo sapiens
  source 1..203: mol_type = other DNA
ggcgcgccagtcctcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggcgactcggaccgatg

SEQ ID NO: 2622 - DNA, 203 bp, Homo sapiens
  source 1..203: mol_type = other DNA
ggcgcgccagtcctagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgactcggaccgatg

SEQ ID NO: 2623 - DNA, 203 bp, Homo sapiens
  source 1..203: mol_type = other DNA
ggcgcgccagtccttcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatcccgactcggaccgatg

SEQ ID NO: 2624 - DNA, 203 bp, Homo sapiens
  source 1..203: mol_type = other DNA
ggcgcgccagtcctctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggcgactcggaccgatg

SEQ ID NO: 2625 - DNA, 203 bp, Homo sapiens
  source 1..203: mol_type = other DNA
ggcgcgccagtccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttcgactcggaccgatg

SEQ ID NO: 2626 - DNA, 203 bp, Homo sapiens
  source 1..203: mol_type = other DNA
ggcgcgccagtcctaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccacgactcggaccgatg

SEQ ID NO: 2627 - DNA, 203 bp, Homo sapiens
  source 1..203: mol_type = other DNA
ggcgcgccagtcctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccacgactcggaccgatg

SEQ ID NO: 2628 - DNA, 203 bp, Homo sapiens
  source 1..203: mol_type = other DNA
ggcgcgccagtcctattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctgcgactcggaccgatg

SEQ ID NO: 2629 - DNA, 203 bp, Homo sapiens
  source 1..203: mol_type = other DNA
ggcgcgccagtccttcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagcgactcggaccgatg

SEQ ID NO: 2630 - DNA, 203 bp, Homo sapiens
  source 1..203: mol_type = other DNA
ggcgcgccagtcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttcgactcggaccgatg

SEQ ID NO: 2631 - DNA, 203 bp, Homo sapiens
  source 1..203: mol_type = other DNA
ggcgcgccagtcctagttccagggaaggagggcgtagacaaagcgccacctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgcgactcggaccgatg

SEQ ID NO: 2632 - DNA, 203 bp, Homo sapiens
  source 1..203: mol_type = other DNA
ggcgcgccagtcctacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtcgactcggaccgatg

SEQ ID NO: 2633 - DNA, 203 bp, Homo sapiens
  source 1..203: mol_type = other DNA
ggcgcgccagtcctctcagcgcgggggacgactcagagacggggtctgactgtgttacccaggctggtcttcaactcttggcctcaagtgatcctcctgccttagcttccaagaatgctgaggttacagtagaaacggggtttcaccatgttagccaggctgatattgaattcctgacctcaattgatcgactcggaccgatg

SEQ ID NO: 2634 - DNA, 203 bp, Homo sapiens
  source 1..203: mol_type = other DNA
ggcgcgccagtcctatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcatacgactcggaccgatg

SEQ ID NO: 2635 - DNA, 203 bp, Homo sapiens
  source 1..203: mol_type = other DNA
ggcgcgccagtcctatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgcgactcggaccgatg

SEQ ID NO: 2636 - DNA, 203 bp, Homo sapiens
  source 1..203: mol_type = other DNA
ggcgcgccagtcctaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcgactcggaccgatg

SEQ ID NO: 2637 - DNA, 203 bp, Homo sapiens
  source 1..203: mol_type = other DNA
ggcgcgccagtcctcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggcccgactcggaccgatg

SEQ ID NO: 2638 - DNA, 203 bp, Homo sapiens
  source 1..203: mol_type = other DNA
ggcgcgccagtcctgagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatccgactcggaccgatg

SEQ ID NO: 2639 - DNA, 203 bp, Homo sapiens
  source 1..203: mol_type = other DNA
ggcgcgccagtcctgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaacgactcggaccgatg

SEQ ID NO: 2640 - DNA, 203 bp, Homo sapiens
  source 1..203: mol_type = other DNA
ggcgcgccagtcctaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctccgactcggaccgatg

SEQ ID NO: 2641 - DNA, 203 bp, Homo sapiens
  source 1..203: mol_type = other DNA
ggcgcgccagtcctatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgactcggaccgatg

SEQ ID NO: 2642 - DNA, 203 bp, Homo sapiens
  source 1..203: mol_type = other DNA
ggcgcgccagtcctgcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattcgactcggaccgatg

SEQ ID NO: 2643 - DNA, 203 bp, Homo sapiens
  source 1..203: mol_type = other DNA
ggcgcgccagtcctcgagacgcccattctgcccccggccccgcgcggaggggcgggggaggcgccgggaagtcgacggcgccggcggctcctgcgtctcgcccttttgcccaggctagagtgcagtggtgcggtcatggttcactgcagcctcaacctcctggactcagcaggaggccactgtctgcacgactcggaccgatg

SEQ ID NO: 2644 - DNA, 203 bp, Homo sapiens
  source 1..203: mol_type = other DNA
ggcgcgccagtcctggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccacgactcggaccgatg

SEQ ID NO: 2645 - DNA, 203 bp, Homo sapiens
  source 1..203: mol_type = other DNA
ggcgcgccagtcctaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatccgactcggaccgatg

SEQ ID NO: 2646 - DNA, 203 bp, Homo sapiens
  source 1..203: mol_type = other DNA
ggcgcgccagtcctatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagaccgactcggaccgatg

SEQ ID NO: 2647 - DNA, 203 bp, Homo sapiens
  source 1..203: mol_type = other DNA
ggcgcgccagtcctcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaacgactcggaccgatg

SEQ ID NO: 2648 - DNA, 203 bp, Homo sapiens
  source 1..203: mol_type = other DNA
ggcgcgccagtcctcacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccgactcggaccgatg

SEQ ID NO: 2649 - DNA, 203 bp, Homo sapiens
  source 1..203: mol_type = other DNA
ggcgcgccagtcctcgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtcgactcggaccgatg

SEQ ID NO: 2650 - DNA, 203 bp, Homo sapiens
  source 1..203: mol_type = other DNA
ggcgcgccagtccttttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaatacgactcggaccgatg

SEQ ID NO: 2651 - DNA, 203 bp, Homo sapiens
  source 1..203: mol_type = other DNA
ggcgcgccagtcctcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccacgactcggaccgatg

SEQ ID NO: 2652 - DNA, 203 bp, Homo sapiens
  source 1..203: mol_type = other DNA
ggcgcgccagtcctgaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaacgactcggaccgatg

SEQ ID NO: 2653 - DNA, 203 bp, Homo sapiens
  source 1..203: mol_type = other DNA
ggcgcgccagtcctaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccacgactcggaccgatg

SEQ ID NO: 2654 - DNA, 203 bp, Homo sapiens
  source 1..203: mol_type = other DNA
ggcgcgccagtcctctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatcgactcggaccgatg

SEQ ID NO: 2655 - DNA, 203 bp, Homo sapiens
  source 1..203: mol_type = other DNA
ggcgcgccagtcctgcaaagtcactgtcttcaaatctggatacacactttcccctctgtagattcaaaaggtgcttccttcccggctgtctccagcttccttactctcttttctgggatttctttttctcttctttctgctcttcctccactgctgaactggtccctaactgaaacagcccctgacttcgactcggaccgatg

SEQ ID NO: 2656 - DNA, 203 bp, Homo sapiens
  source 1..203: mol_type = other DNA
ggcgcgccagtcctatcccaagcatgcttcctttagctgctgtgagaatttgtcttcctcaccagccaggtcctcaggcaaagtcctcagccagtgctttagagcaacttcccgcaaatcagaaactcactgtgattccaaaaatgtttctgagccctggacccctgcccccaaaatattttcatcttcgactcggaccgatg

SEQ ID NO: 2657 - DNA, 203 bp, Homo sapiens
  source 1..203: mol_type = other DNA
ggcgcgccagtcctaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgcgactcggaccgatg

SEQ ID NO: 2658 - DNA, 203 bp, Homo sapiens
  source 1..203: mol_type = other DNA
ggcgcgccagtcctttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtcccgactcggaccgatg

SEQ ID NO: 2659 - DNA, 203 bp, Homo sapiens
  source 1..203: mol_type = other DNA
ggcgcgccagtcctatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagccgactcggaccgatg

SEQ ID NO: 2660 - DNA, 203 bp, Homo sapiens
  source 1..203: mol_type = other DNA
ggcgcgccagtcctgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgactcggaccgatg

SEQ ID NO: 2661 - DNA, 203 bp, Homo sapiens
  source 1..203: mol_type = other DNA
ggcgcgccagtcctcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagaccgactcggaccgatg

SEQ ID NO: 2662 - DNA, 203 bp, Homo sapiens
  source 1..203: mol_type = other DNA
ggcgcgccagtcctgcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgacccgactcggaccgatg

SEQ ID NO: 2663 - DNA, 203 bp, Homo sapiens
  source 1..203: mol_type = other DNA
ggcgcgccagtcctagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctacgactcggaccgatg

SEQ ID NO: 2664 - DNA, 203 bp, Homo sapiens
  source 1..203: mol_type = other DNA
ggcgcgccagtcctgagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaagcgactcggaccgatg

SEQ ID NO: 2665 - DNA, 203 bp, Homo sapiens
  source 1..203: mol_type = other DNA
ggcgcgccagtcctgacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccgactcggaccgatg

SEQ ID NO: 2666 - DNA, 203 bp, Homo sapiens
  source 1..203: mol_type = other DNA
ggcgcgccagtcctcaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgactcggaccgatg

SEQ ID NO: 2667 - DNA, 203 bp, Homo sapiens
  source 1..203: mol_type = other DNA
ggcgcgccagtcctcgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccaccgactcggaccgatg

SEQ ID NO: 2668 - DNA, 203 bp, Homo sapiens
  source 1..203: mol_type = other DNA
ggcgcgccagtcctctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcgcgactcggaccgatg

SEQ ID NO: 2669 - DNA, 203 bp, Homo sapiens
  source 1..203: mol_type = other DNA
ggcgcgccagtcctgagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggcgactcggaccgatg

SEQ ID NO: 2670 - DNA, 203 bp, Homo sapiens
  source 1..203: mol_type = other DNA
ggcgcgccagtcctctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccgactcggaccgatg

SEQ ID NO: 2671 - DNA, 203 bp, Homo sapiens
  source 1..203: mol_type = other DNA
ggcgcgccagtcctcagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcgactcggaccgatg

SEQ ID NO: 2672 - DNA, 203 bp, Homo sapiens
  source 1..203: mol_type = other DNA
ggcgcgccagtcctgagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcccgactcggaccgatg

SEQ ID NO: 2673 - DNA, 203 bp, Homo sapiens
  source 1..203: mol_type = other DNA
ggcgcgccagtcctgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttcgactcggaccgatg

SEQ ID NO: 2674 - DNA, 203 bp, Homo sapiens
  source 1..203: mol_type = other DNA
ggcgcgccagtcctctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctcgactcggaccgatg

SEQ ID NO: 2675 - DNA, 203 bp, Homo sapiens
  source 1..203: mol_type = other DNA
ggcgcgccagtcctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgcccgactcggaccgatg

SEQ ID NO: 2676 - DNA, 203 bp, Homo sapiens
  source 1..203: mol_type = other DNA
ggcgcgccagtcctcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtccgactcggaccgatg

SEQ ID NO: 2677 - DNA, 203 bp, Homo sapiens
  source 1..203: mol_type = other DNA
ggcgcgccagtccttgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaacgactcggaccgatg

SEQ ID NO: 2678 - DNA, 203 bp, Homo sapiens
  source 1..203: mol_type = other DNA
ggcgcgccagtccttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgcccgactcggaccgatg

SEQ ID NO: 2679 - DNA, 203 bp, Homo sapiens
  source 1..203: mol_type = other DNA
ggcgcgccagtccttatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatccgactcggaccgatg

SEQ ID NO: 2680 - DNA, 203 bp, Homo sapiens
  source 1..203: mol_type = other DNA
ggcgcgccagtcctatcaaagctttctcttaactctcttacctctaggcaaactgagacctcaccatcctctcccctgcttcccacgacagtcctttgcccttgccatgctcagggttggaatcaagttgttctattctcaacagaccaaaatgtttagttaaggcaaagtatcttggaaacaattgtcgactcggaccgatg

SEQ ID NO: 2681 - DNA, 203 bp, Homo sapiens
  source 1..203: mol_type = other DNA
ggcgcgccagtcctgattaattacagtcttgtactcttgacaaagctgtgcagatggcaataagttcataccagcaatcctggagtcccataataaatacgtacatgtggaacatcgtgcacataatttcaacagttcgcagatctgtagttatgaagccagggtttggtggtatttgctctctcttgcgactcggaccgatg

SEQ ID NO: 2682 - DNA, 203 bp, Homo sapiens
  source 1..203: mol_type = other DNA
ggcgcgccagtcctttcttccactatcatgttttttgaggattttgcatatttcttgttgccataatgctgtgctattttaccctgattttcagtgatacaatatgggtgacaatactggcccctccataaatctgaagagtaagaagtagtgaaaataaggcttaggatatgaaatggcgttgtcaccgactcggaccgatg

SEQ ID NO: 2683 - DNA, 203 bp, Homo sapiens
  source 1..203: mol_type = other DNA
ggcgcgccagtcctttgaatcaaggccactttttgtcctacttgagcatctcaagttgggatgcatcttctgatggcacttccggaactggctgtggtttttttgggtgtaccgagagtgccagtgactgtgcttcttacaattcctggcatcttgagtaggtgaaacactgtatcagactgggtgatcgactcggaccgatg

SEQ ID NO: 2684 - DNA, 203 bp, Homo sapiens
  source 1..203: mol_type = other DNA
ggcgcgccagtcctggtgtgcgcgctgcgcccgcgagctcccgggctcggcaaccgtggcatgcttaggattggccatatttaaaagttctgaagtagaacctgcgcctcctctctgcttctccctcctcctcagtaatttatttcgagcttccaggcaagggccacggaagaagggaaagcaagaaacgactcggaccgatg

SEQ ID NO: 2685 - DNA, 203 bp, Homo sapiens
  source 1..203: mol_type = other DNA
ggcgcgccagtcctttagatgcctgtgtggtaactcctcgcggagctaaggtggactctcttgcagccaacttcccatcagatcaccctgctggacttgcagaccggaatggggctcgcctaaggagccgagcgctgcggaggctgctgcgtgttggatgggagtgggagggggctggagcgagatttcgactcggaccgatg

SEQ ID NO: 2686 - DNA, 203 bp, Homo sapiens
  source 1..203: mol_type = other DNA
ggcgcgccagtcctccagggcgcagtcctccggggcgttacgccgggcataatggaattgcagaggacgtctagtatctccgggccgctgtcgccggcgtacacggggcaggtgccttacaactacaaccagctggaaggcagattcaagcagctgcaagatgagcgtgaagccgtgcagaagaagaccgactcggaccgatg

SEQ ID NO: 2687 - DNA, 203 bp, Homo sapiens
  source 1..203: mol_type = other DNA
ggcgcgccagtcctcttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacgactcggaccgatg

SEQ ID NO: 2688 - DNA, 203 bp, Homo sapiens
  source 1..203: mol_type = other DNA
ggcgcgccagtccttgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagacgactcggaccgatg

SEQ ID NO: 2689 - DNA, 203 bp, Homo sapiens
  source 1..203: mol_type = other DNA
ggcgcgccagtcctactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgacgactcggaccgatg

SEQ ID NO: 2690 - DNA, 203 bp, Homo sapiens
  source 1..203: mol_type = other DNA
ggcgcgccagtcctggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcgcgactcggaccgatg

SEQ ID NO: 2691 - DNA, 203 bp, Homo sapiens
  source 1..203: mol_type = other DNA
ggcgcgccagtcctagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcgactcggaccgatg

SEQ ID NO: 2692 - DNA, 203 bp, Homo sapiens
  source 1..203: mol_type = other DNA
ggcgcgccagtcctcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccgactcggaccgatg

SEQ ID NO: 2693 - DNA, 203 bp, Homo sapiens
  source 1..203: mol_type = other DNA
ggcgcgccagtcctgcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtgcgactcggaccgatg

SEQ ID NO: 2694 - DNA, 203 bp, Homo sapiens
  source 1..203: mol_type = other DNA
ggcgcgccagtcctgcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacgactcggaccgatg

SEQ ID NO: 2695 - DNA, 203 bp, Homo sapiens
  source 1..203: mol_type = other DNA
ggcgcgccagtcctcgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctcgactcggaccgatg

SEQ ID NO: 2696 - DNA, 203 bp, Homo sapiens
  source 1..203: mol_type = other DNA
ggcgcgccagtcctggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacgactcggaccgatg

SEQ ID NO: 2697 - DNA, 203 bp, Homo sapiens
  source 1..203: mol_type = other DNA
ggcgcgccagtcctttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggctcgactcggaccgatg

SEQ ID NO: 2698 - DNA, 203 bp, Homo sapiens
  source 1..203: mol_type = other DNA
ggcgcgccagtcctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgcgactcggaccgatg

SEQ ID NO: 2699 - DNA, 203 bp, Homo sapiens
  source 1..203: mol_type = other DNA
ggcgcgccagtcctctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagcgactcggaccgatg

SEQ ID NO: 2700 - DNA, 203 bp, Homo sapiens
  source 1..203: mol_type = other DNA
ggcgcgccagtcctacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacgggttagttaccgctctcaaaccgactcggaccgatg

SEQ ID NO: 2701 - DNA, 203 bp, Homo sapiens
  source 1..203: mol_type = other DNA
ggcgcgccagtccttttttttctgccaagtcctgaattgaaaactgtaggcttccttgcacagatgttgcagccagcctcaggagtaaagtgcccgctgactgctgccgccacctctgtctcgctccctgtcagtgctgctggcacgtgggacgcggcaggtgacagccgttctcagcatgttttagacgactcggaccgatg

SEQ ID NO: 2702 - DNA, 203 bp, Homo sapiens
  source 1..203: mol_type = other DNA
ggcgcgccagtcctgtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttcccgactcggaccgatg

SEQ ID NO: 2703 - DNA, 203 bp, Homo sapiens
  source 1..203: mol_type = other DNA
ggcgcgccagtcctgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgctgtctgttggcatgcttaaagcacatgtcgactcggaccgatg

SEQ ID NO: 2704 - DNA, 203 bp, Homo sapiens
  source 1..203: mol_type = other DNA
ggcgcgccagtcctagagctccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaacgactcggaccgatg

SEQ ID NO: 2705 - DNA, 203 bp, Homo sapiens
  source 1..203: mol_type = other DNA
ggcgcgccagtcctggggggaggtgctagcagggccagccttgaactcgctggacagagctacagacctatggggcctggaagtgcccgctgagaaagggagaagacagcagaggggttgccgaggtgaggggttgcctccgaggcaacctccaagtcccagatcatgtctctgtggggtctggtctccgactcggaccgatg

SEQ ID NO: 2706 - DNA, 203 bp, Homo sapiens
  source 1..203: mol_type = other DNA
ggcgcgccagtcctcaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggccgactcggaccgatg

SEQ ID NO: 2707 - DNA, 203 bp, Homo sapiens
  source 1..203: mol_type = other DNA
ggcgcgccagtcctctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaacgactcggaccgatg

SEQ ID NO: 2708 - DNA, 203 bp, Homo sapiens
  source 1..203: mol_type = other DNA
ggcgcgccagtcctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcacgactcggaccgatg

SEQ ID NO: 2709 - DNA, 203 bp, Homo sapiens
  source 1..203: mol_type = other DNA
ggcgcgccagtcctggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcgactcggaccgatg

SEQ ID NO: 2710 - DNA, 203 bp, Homo sapiens
  source 1..203: mol_type = other DNA
ggcgcgccagtcctctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtcgactcggaccgatg

SEQ ID NO: 2711 - DNA, 203 bp, Homo sapiens
  source 1..203: mol_type = other DNA
ggcgcgccagtcctgagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacgactcggaccgatg

SEQ ID NO: 2712 - DNA, 203 bp, Homo sapiens
  source 1..203: mol_type = other DNA
ggcgcgccagtcctcatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcgactcggaccgatg

SEQ ID NO: 2713 - DNA, 203 bp, Homo sapiens
  source 1..203: mol_type = other DNA
ggcgcgccagtcctaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgcgactcggaccgatg

SEQ ID NO: 2714 - DNA, 203 bp, Homo sapiens
  source 1..203: mol_type = other DNA
ggcgcgccagtcctctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggccgactcggaccgatg

SEQ ID NO: 2715 - DNA, 203 bp, Homo sapiens
  source 1..203: mol_type = other DNA
ggcgcgccagtcctacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagccgactcggaccgatg

SEQ ID NO: 2716 - DNA, 203 bp, Homo sapiens
  source 1..203: mol_type = other DNA
ggcgcgccagtcctagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacaccccaacacgactcggaccgatg

SEQ ID NO: 2717 - DNA, 203 bp, Homo sapiens
  source 1..203: mol_type = other DNA
ggcgcgccagtccttgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttcgactcggaccgatg

SEQ ID NO: 2718 - DNA, 203 bp, Homo sapiens
  source 1..203: mol_type = other DNA
ggcgcgccagtccttgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaacgactcggaccgatg

SEQ ID NO: 2719 - DNA, 203 bp, Homo sapiens
  source 1..203: mol_type = other DNA
ggcgcgccagtcctttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggcgactcggaccgatg

SEQ ID NO: 2720 - DNA, 203 bp, Homo sapiens
  source 1..203: mol_type = other DNA
ggcgcgccagtcctagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcgactcggaccgatg

SEQ ID NO: 2721 - DNA, 203 bp, Homo sapiens
  source 1..203: mol_type = other DNA
ggcgcgccagtcctccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcgactcggaccgatg

SEQ ID NO: 2722 - DNA, 203 bp, Homo sapiens
  source 1..203: mol_type = other DNA
ggcgcgccagtcctttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcacgactcggaccgatg

SEQ ID NO: 2723 - DNA, 203 bp, Homo sapiens
  source 1..203: mol_type = other DNA
ggcgcgccagtcctctccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagcgactcggaccgatg

SEQ ID NO: 2724 - DNA, 203 bp, Homo sapiens
  source 1..203: mol_type = other DNA
ggcgcgccagtcctctgagacacaccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcagcgactcggaccgatg

SEQ ID NO: 2725 - DNA, 203 bp, Homo sapiens
  source 1..203: mol_type = other DNA
ggcgcgccagtcctctgttagccaggtggaggcttctgatacgtgtatgagactatgcaaaagtacaagggctgagattcttcgtgtatagctgtgtgaacgtgtatgtacctaggatatgttaaatgtatagctggcaccttagttgcatgaccacatagaacatgtgtctatctgcttttgcctaccgactcggaccgatg

SEQ ID NO: 2726 - DNA, 203 bp, Homo sapiens
  source 1..203: mol_type = other DNA
ggcgcgccagtccttttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtacgactcggaccgatg

SEQ ID NO: 2727 - DNA, 203 bp, Homo sapiens
  source 1..203: mol_type = other DNA
ggcgcgccagtccttggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccacgactcggaccgatg

SEQ ID NO: 2728 - DNA, 203 bp, Homo sapiens
  source 1..203: mol_type = other DNA
ggcgcgccagtcctgtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccatcgactcggaccgatg

SEQ ID NO: 2729 - DNA, 203 bp, Homo sapiens
  source 1..203: mol_type = other DNA
ggcgcgccagtccttttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttaccgactcggaccgatg

SEQ ID NO: 2730 - DNA, 203 bp, Homo sapiens
  source 1..203: mol_type = other DNA
ggcgcgccagtccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttcgactcggaccgatg

SEQ ID NO: 2731 - DNA, 203 bp, Homo sapiens
  source 1..203: mol_type = other DNA
ggcgcgccagtcctagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatcgactcggaccgatg

SEQ ID NO: 2732 - DNA, 203 bp, Homo sapiens
  source 1..203: mol_type = other DNA
ggcgcgccagtcctggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccgactcggaccgatg

SEQ ID NO: 2733 - DNA, 203 bp, Homo sapiens
  source 1..203: mol_type = other DNA
ggcgcgccagtcctcccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagcccgactcggaccgatg

SEQ ID NO: 2734 - DNA, 203 bp, Homo sapiens
  source 1..203: mol_type = other DNA
ggcgcgccagtcctaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgcgactcggaccgatg

SEQ ID NO: 2735 - DNA, 203 bp, Homo sapiens
  source 1..203: mol_type = other DNA
ggcgcgccagtcctaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgcgactcggaccgatg

SEQ ID NO: 2736 - DNA, 203 bp, Homo sapiens
  source 1..203: mol_type = other DNA
ggcgcgccagtcctaacctggtggagctggccctggctaccaacatccccaaaggctgtgctgagacagctgtcagagttcatgtctcctacctggatggcaaagggaacctggcacctcaaggatcggtgcccagtgctgtgtcttcactgacagatgaccttctcaagtactatcaccaggtgactcgactcggaccgatg

SEQ ID NO: 2737 - DNA, 203 bp, Homo sapiens
  source 1..203: mol_type = other DNA
ggcgcgccagtcctcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctacgactcggaccgatg

SEQ ID NO: 2738 - DNA, 203 bp, Homo sapiens
  source 1..203: mol_type = other DNA
ggcgcgccagtccttttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttcgactcggaccgatg

SEQ ID NO: 2739 - DNA, 203 bp, Homo sapiens
  source 1..203: mol_type = other DNA
ggcgcgccagtccttttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcccgactcggaccgatg

SEQ ID NO: 2740 - DNA, 203 bp, Homo sapiens
  source 1..203: mol_type = other DNA
ggcgcgccagtcctcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttcgactcggaccgatg

SEQ ID NO: 2741 - DNA, 203 bp, Homo sapiens
  source 1..203: mol_type = other DNA
ggcgcgccagtcctgcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaagcgactcggaccgatg

SEQ ID NO: 2742 - DNA, 203 bp, Homo sapiens
  source 1..203: mol_type = other DNA
ggcgcgccagtcctaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgcgactcggaccgatg

SEQ ID NO: 2743 - DNA, 203 bp, Homo sapiens
  source 1..203: mol_type = other DNA
ggcgcgccagtcctgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaagtcgactcggaccgatg

SEQ ID NO: 2744 - DNA, 203 bp, Homo sapiens
  source 1..203: mol_type = other DNA
ggcgcgccagtcctgacagaagcaatggccgaggcagaagacaagccgaggtgctggtgaccctgggcgtctgagtggatgattggggctgctgcgctcagaggcctgcctccctgccttccaatgcatataaccccacaccccagccaatgaagacgagaggcagcgtgaacaaagtcatttagaaacgactcggaccgatg

SEQ ID NO: 2745 - DNA, 203 bp, Homo sapiens
  source 1..203: mol_type = other DNA
ggcgcgccagtcctgcccccgaggaagtgtaaacaaaagagaaagcatgaatggagtgcctgagagacaagtgtgtcctgtactgcccccacctttagctgggccagcaactgcccggccctgcttctccccacctactcactggtgatctttttttttttacttttttttcccttttcttttccattcgactcggaccgatg

SEQ ID NO: 2746 - DNA, 203 bp, Homo sapiens
  source 1..203: mol_type = other DNA
ggcgcgccagtcctccactcccagctgccttgccacccctcccagccctctgcttgccctccacctggcctgctgggagtcagagcccagcaaaacctgtttagacacatggacaagaatcccagcgctacaaggcacacagtccgcttcttcgtcctcagggttgccagcgcttcctggaagtcctgcgactcggaccgatg

SEQ ID NO: 2747 - DNA, 203 bp, Homo sapiens
  source 1..203: mol_type = other DNA
ggcgcgccagtcctccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggccgactcggaccgatg

SEQ ID NO: 2748 - DNA, 203 bp, Homo sapiens
  source 1..203: mol_type = other DNA
ggcgcgccagtcctcattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagacgactcggaccgatg

SEQ ID NO: 2749 - DNA, 203 bp, Homo sapiens
  source 1..203: mol_type = other DNA
ggcgcgccagtccttgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgcgactcggaccgatg

SEQ ID NO: 2750 - DNA, 203 bp, Homo sapiens
  source 1..203: mol_type = other DNA
ggcgcgccagtccttagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttcgactcggaccgatg

SEQ ID NO: 2751 - DNA, 203 bp, Homo sapiens
  source 1..203: mol_type = other DNA
ggcgcgccagtcctaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattcgactcggaccgatg

SEQ ID NO: 2752 - DNA, 203 bp, Homo sapiens
  source 1..203: mol_type = other DNA
ggcgcgccagtccttctttaagatttgtagctactaagaaagaaaggagctttttttccttgggccttcaaactgaaagaaccgcatgagcctgaagctgcgcatggtcttaacatcaggctgtgcaggaagaagctatctgcagatggatgccagcacacacaaggaagcagagctctggcaacattcgactcggaccgatg

SEQ ID NO: 2753 - DNA, 203 bp, Homo sapiens
  source 1..203: mol_type = other DNA
ggcgcgccagtcctactgggctgccacaggaggtgcatgtcctgaatctccgcactgcaggccaggggcctggccagctacagagagaggtcacacttcacctgaatcccatctcctcagtccacatccaccacaagtctgttgtgttcctgctcaactccccacaccccctggtgtggcatctgaagcgactcggaccgatg

SEQ ID NO: 2754 - DNA, 203 bp, Homo sapiens
  source 1..203: mol_type = other DNA
ggcgcgccagtcctgtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagcgactcggaccgatg

SEQ ID NO: 2755 - DNA, 203 bp, Homo sapiens
  source 1..203: mol_type = other DNA
ggcgcgccagtcctgatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctcgactcggaccgatg

SEQ ID NO: 2756 - DNA, 203 bp, Homo sapiens
  source 1..203: mol_type = other DNA
ggcgcgccagtccttgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttccgactcggaccgatg

SEQ ID NO: 2757 - DNA, 203 bp, Homo sapiens
  source 1..203: mol_type = other DNA
ggcgcgccagtcctaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgcgactcggaccgatg

SEQ ID NO: 2758 - DNA, 203 bp, Homo sapiens
  source 1..203: mol_type = other DNA
ggcgcgccagtcctatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacacgactcggaccgatg

SEQ ID NO: 2759 - DNA, 203 bp, Homo sapiens
  source 1..203: mol_type = other DNA
ggcgcgccagtcctgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatacgactcggaccgatg

SEQ ID NO: 2760 - DNA, 203 bp, Homo sapiens
  source 1..203: mol_type = other DNA
ggcgcgccagtcctgtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatggcgactcggaccgatg

SEQ ID NO: 2761 - DNA, 203 bp, Homo sapiens
  source 1..203: mol_type = other DNA
ggcgcgccagtcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgcgactcggaccgatg

SEQ ID NO: 2762 - DNA, 203 bp, Homo sapiens
  source 1..203: mol_type = other DNA
ggcgcgccagtcctccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagcgactcggaccgatg

SEQ ID NO: 2763 - DNA, 203 bp, Homo sapiens
  source 1..203: mol_type = other DNA
ggcgcgccagtcctaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttcgactcggaccgatg

SEQ ID NO: 2764 - DNA, 203 bp, Homo sapiens
  source 1..203: mol_type = other DNA
ggcgcgccagtcctggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctcgactcggaccgatg

SEQ ID NO: 2765 - DNA, 203 bp, Homo sapiens
  source 1..203: mol_type = other DNA
ggcgcgccagtcctatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatcgactcggaccgatg

SEQ ID NO: 2766 - DNA, 203 bp, Homo sapiens
  source 1..203: mol_type = other DNA
ggcgcgccagtcctgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttacgactcggaccgatg

SEQ ID NO: 2767 - DNA, 203 bp, Homo sapiens
  source 1..203: mol_type = other DNA
ggcgcgccagtcctgagagcccccggtggggccggcggaggagcgcccttccccccgcgcgctgattgctgtggcgtcctgcccgtccccgcccgcgtgtgtgcgagggagggcgagtgcgccgggtcggcctgatgggggtaatcgagggtttcggggacgccgagcggcactttcctcttcccagccgactcggaccgatg

SEQ ID NO: 2768 - DNA, 203 bp, Homo sapiens
  source 1..203: mol_type = other DNA
ggcgcgccagtcctcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccgactcggaccgatg

SEQ ID NO: 2769 - DNA, 203 bp, Homo sapiens
  source 1..203: mol_type = other DNA
ggcgcgccagtcctttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaaccgactcggaccgatg

SEQ ID NO: 2770 - DNA, 203 bp, Homo sapiens
  source 1..203: mol_type = other DNA
ggcgcgccagtcctaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcgactcggaccgatg

SEQ ID NO: 2771 - DNA, 203 bp, Homo sapiens
  source 1..203: mol_type = other DNA
ggcgcgccagtcctcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggccgactcggaccgatg

SEQ ID NO: 2772 - DNA, 203 bp, Homo sapiens
  source 1..203: mol_type = other DNA
ggcgcgccagtcctttttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacaccccgactcggaccgatg

SEQ ID NO: 2773 - DNA, 203 bp, Homo sapiens
  source 1..203: mol_type = other DNA
ggcgcgccagtccttttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtccgactcggaccgatg

SEQ ID NO: 2774 - DNA, 203 bp, Homo sapiens
  source 1..203: mol_type = other DNA
ggcgcgccagtcctacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgacgactcggaccgatg

SEQ ID NO: 2775 - DNA, 203 bp, Homo sapiens
  source 1..203: mol_type = other DNA
ggcgcgccagtcctggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccgcgactcggaccgatg

SEQ ID NO: 2776 - DNA, 203 bp, Homo sapiens
  source 1..203: mol_type = other DNA
ggcgcgccagtcctaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggcgactcggaccgatg

SEQ ID NO: 2777 - DNA, 203 bp, Homo sapiens
  source 1..203: mol_type = other DNA
ggcgcgccagtccttggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagccgactcggaccgatg

SEQ ID NO: 2778 - DNA, 203 bp, Homo sapiens
  source 1..203: mol_type = other DNA
ggcgcgccagtcctctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtcgactcggaccgatg

SEQ ID NO: 2779 - DNA, 203 bp, Homo sapiens
  source 1..203: mol_type = other DNA
ggcgcgccagtcctctcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagacgactcggaccgatg

SEQ ID NO: 2780 - DNA, 203 bp, Homo sapiens
  source 1..203: mol_type = other DNA
ggcgcgccagtcctgccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttcgactcggaccgatg

SEQ ID NO: 2781 - DNA, 203 bp, Homo sapiens
  source 1..203: mol_type = other DNA
ggcgcgccagtcctgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtcgactcggaccgatg

SEQ ID NO: 2782 - DNA, 203 bp, Homo sapiens
  source 1..203: mol_type = other DNA
ggcgcgccagtcctcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttctttttttcgactcggaccgatg

SEQ ID NO: 2783 - DNA, 203 bp, Homo sapiens
  source 1..203: mol_type = other DNA
ggcgcgccagtccttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgccgactcggaccgatg

SEQ ID NO: 2784 - DNA, 203 bp, Homo sapiens
  source 1..203: mol_type = other DNA
ggcgcgccagtcctatctccgtccctcagccgctcacagcctcctcccagcgcccatcgccttgagctgcccactacctctagactgccctcccgggctggcgtcccacggagtctcagccgcgcaccccttcctcgcgttaccctccttccggacagcaccccctcccttctccggtagctcctacccgactcggaccgatg

SEQ ID NO: 2785 - DNA, 203 bp, Homo sapiens
  source 1..203: mol_type = other DNA
ggcgcgccagtcctcctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggcgactcggaccgatg

SEQ ID NO: 2786 - DNA, 203 bp, Homo sapiens
  source 1..203: mol_type = other DNA
ggcgcgccagtcctacccggtgagcctgggctgcgagcattacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctcctcgactcggaccgatg

SEQ ID NO: 2787 - DNA, 203 bp, Homo sapiens
  source 1..203: mol_type = other DNA
ggcgcgccagtccttcccgctggacgccatcctcaacgcgcgccgcgccgcgcgaccctgccaggcgcacgacaaggtcaagctcttctgcctcagggaccgcgcgcttctctgcttcttctgcgacgagcctgcactgcacgagcagcatcaggtcaccggcatcgacgacgccttcgacgagctgccgactcggaccgatg

SEQ ID NO: 2788 - DNA, 203 bp, Homo sapiens
  source 1..203: mol_type = other DNA
ggcgcgccagtcctagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagacgactcggaccgatg

SEQ ID NO: 2789 - DNA, 203 bp, Homo sapiens
  source 1..203: mol_type = other DNA
ggcgcgccagtcctaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtcgactcggaccgatg

SEQ ID NO: 2790 - DNA, 203 bp, Homo sapiens
  source 1..203: mol_type = other DNA
ggcgcgccagtcctccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcccgactcggaccgatg

SEQ ID NO: 2791 - DNA, 203 bp, Homo sapiens
  source 1..203: mol_type = other DNA
ggcgcgccagtcctcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggctcgactcggaccgatg

SEQ ID NO: 2792 - DNA, 203 bp, Homo sapiens
  source 1..203: mol_type = other DNA
ggcgcgccagtcctcctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctcgactcggaccgatg

SEQ ID NO: 2793 - DNA, 203 bp, Homo sapiens
  source 1..203: mol_type = other DNA
ggcgcgccagtcctaaaagcaactgcaggacaagcctccctggatgatcgaggtccccagtagctctgaacaagagtccagccaaccctcttcagccaggcctctgtgacctgctagggtgcaggaggcttccagaagcagttgttgtaattaggacccaagcactgggaggggctgttggctggacccgactcggaccgatg

SEQ ID NO: 2794 - DNA, 203 bp, Homo sapiens
  source 1..203: mol_type = other DNA
ggcgcgccagtcctttcatcatgtctgttgtgaccaggaaagctgcccccatctgcaggaagccactatgccagaaagctgctgactgcagaactaggctccctctgccagggtccgtgccagccaatagatgtcctgaggcctgcccctctcccacttcactcagttcccaaatctaaatttttacacgactcggaccgatg

SEQ ID NO: 2795 - DNA, 203 bp, Homo sapiens
  source 1..203: mol_type = other DNA
ggcgcgccagtcctattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaaccgactcggaccgatg

SEQ ID NO: 2796 - DNA, 203 bp, Homo sapiens
  source 1..203: mol_type = other DNA
ggcgcgccagtcctcggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgcgactcggaccgatg

SEQ ID NO: 2797 - DNA, 203 bp, Homo sapiens
  source 1..203: mol_type = other DNA
ggcgcgccagtccttacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagcgactcggaccgatg

SEQ ID NO: 2798 - DNA, 203 bp, Homo sapiens
  source 1..203: mol_type = other DNA
ggcgcgccagtcctctcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatacgactcggaccgatg

SEQ ID NO: 2799 - DNA, 203 bp, Homo sapiens
  source 1..203: mol_type = other DNA
ggcgcgccagtccttagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggcgactcggaccgatg

SEQ ID NO: 2800 - DNA, 203 bp, Homo sapiens
  source 1..203: mol_type = other DNA
ggcgcgccagtcctcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacaatgcaccagccgcctgagtccaccgccgcggcgactcggaccgatg

SEQ ID NO: 2801 - DNA, 203 bp, Homo sapiens
  source 1..203: mol_type = other DNA
ggcgcgccagtcctccgccgccgctgcagacattagcgctaggaagatggcgcacccggcaatgttccctcgaaggggcagcggtagtggcagcgcctctgctctcaatgcagcaggtaccggcgtcggtagtaatgccacatcttccgaggattttccgcctccgtcgctgcttcagccgccgcccccgactcggaccgatg

SEQ ID NO: 2802 - DNA, 203 bp, Homo sapiens
  source 1..203: mol_type = other DNA
ggcgcgccagtcctctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagctcgactcggaccgatg

SEQ ID NO: 2803 - DNA, 203 bp, Homo sapiens
  source 1..203: mol_type = other DNA
ggcgcgccagtcctctgtggccagtgcatccattactggtgggccaccctcaagcccagtatctagaaaactctctacaactggaagctctgacagtatcacaccagttgcaccaacttctgctgtatcatccagtggttcacctgcatctgtaatgactaatatgcgtgctccaagtactacaggtgcgactcggaccgatg

SEQ ID NO: 2804 - DNA, 203 bp, Homo sapiens
  source 1..203: mol_type = other DNA
ggcgcgccagtccttaggtcagcagccttccatttccagtttggctcaaccccagctaccatattctcaggcggctcctccagtgcaaactccccttccaggggcaccaccaccccaacagttacagtatggacaacagcaaccaatggtttctacacagatggccccaggccatgtcaaatcagtgacgactcggaccgatg

SEQ ID NO: 2805 - DNA, 203 bp, Homo sapiens
  source 1..203: mol_type = other DNA
ggcgcgccagtcctctcaaaatcctgcttcagagtatgtacaacagcagccaattcttcaaacagcaatgtcctccggacagcccagttctgcaggagtaggagcaggaacaacagtgattcctgtggctcagccacagggtatccagctgccagtgcagcccacagcagtcccagcacaacctgcagcgactcggaccgatg

SEQ ID NO: 2806 - DNA, 203 bp, Homo sapiens
  source 1..203: mol_type = other DNA
ggcgcgccagtcctcagatgggagtagcagcagcctagcagcctctgcttctcttttcccgttgaaggtgctaccgctgacgacacccctggtggatggcgaggatgagagctcctctggtgcaagtgtggtagctattgacaacaaaatcgagcaagctatggatctagtgaaaagccatttgatgtcgactcggaccgatg

SEQ ID NO: 2807 - DNA, 203 bp, Homo sapiens
  source 1..203: mol_type = other DNA
ggcgcgccagtcctatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccaccgactcggaccgatg

SEQ ID NO: 2808 - DNA, 203 bp, Homo sapiens
  source 1..203: mol_type = other DNA
ggcgcgccagtcctagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagaccgactcggaccgatg

SEQ ID NO: 2809 - DNA, 203 bp, Homo sapiens
  source 1..203: mol_type = other DNA
ggcgcgccagtccttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgaccgactcggaccgatg

SEQ ID NO: 2810 - DNA, 203 bp, Homo sapiens
  source 1..203: mol_type = other DNA
ggcgcgccagtcctttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcacgactcggaccgatg

SEQ ID NO: 2811 - DNA, 203 bp, Homo sapiens
  source 1..203: mol_type = other DNA
ggcgcgccagtcctagtggccccctgcccagtaggaattggaccaatcccaagttctaaggcttgtcttaagtccttgcagaacaaggacaaactttctgaatcattcatttctctcatctagagctggtgggagattgagaggtgaatgggacatccaagatccctaaaaagaattgttcgatagcgcgactcggaccgatg

SEQ ID NO: 2812 - DNA, 203 bp, Homo sapiens
  source 1..203: mol_type = other DNA
ggcgcgccagtccttgcatgtgttataaagtggtgacacgggcatcctgttgaaatgatggatggctcactgccataggctgatagcagttgtcataaagatattttgggggaatttgaaaaggacgtaaagaaaaatctttcatattggcttgttggttatataacttcaaatttaataaaggaatacgactcggaccgatg

SEQ ID NO: 2813 - DNA, 203 bp, Homo sapiens
  source 1..203: mol_type = other DNA
ggcgcgccagtcctgccactgcagactccagagccctgcttcaggcctatatagatggtcactctgtggtcatcttcagtaggtccacatgcacacgctgtactgaggtaaagaagttatttaaatctctgtgtgttccttattttgtgcttgaacttgatcaaacagaggacggtcgggccctggaacgactcggaccgatg

SEQ ID NO: 2814 - DNA, 203 bp, Homo sapiens
  source 1..203: mol_type = other DNA
ggcgcgccagtcctagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtagggcgactcggaccgatg

SEQ ID NO: 2815 - DNA, 203 bp, Homo sapiens
  source 1..203: mol_type = other DNA
ggcgcgccagtcctgtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagcgactcggaccgatg

SEQ ID NO: 2816 - DNA, 203 bp, Homo sapiens
  source 1..203: mol_type = other DNA
ggcgcgccagtcctgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacacgactcggaccgatg

SEQ ID NO: 2817 - DNA, 203 bp, Homo sapiens
  source 1..203: mol_type = other DNA
ggcgcgccagtcctacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtcgactcggaccgatg

SEQ ID NO: 2818 - DNA, 203 bp, Homo sapiens
  source 1..203: mol_type = other DNA
ggcgcgccagtcctgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagcccgactcggaccgatg

SEQ ID NO: 2819 - DNA, 203 bp, Homo sapiens
  source 1..203: mol_type = other DNA
ggcgcgccagtcctaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatccgactcggaccgatg

SEQ ID NO: 2820 - DNA, 203 bp, Homo sapiens
  source 1..203: mol_type = other DNA
ggcgcgccagtcctcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttcgactcggaccgatg

SEQ ID NO: 2821 - DNA, 203 bp, Homo sapiens
  source 1..203: mol_type = other DNA
ggcgcgccagtccttcacccaattaggagctctcagcttacgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttctcgactcggaccgatg

SEQ ID NO: 2822 - DNA, 203 bp, Homo sapiens
  source 1..203: mol_type = other DNA
ggcgcgccagtccttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccacgactcggaccgatg

SEQ ID NO: 2823 - DNA, 203 bp, Homo sapiens
  source 1..203: mol_type = other DNA
ggcgcgccagtcctcgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccgactcggaccgatg

SEQ ID NO: 2824 - DNA, 203 bp, Homo sapiens
  source 1..203: mol_type = other DNA
ggcgcgccagtcctagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagacgactcggaccgatg

SEQ ID NO: 2825 - DNA, 203 bp, Homo sapiens
  source 1..203: mol_type = other DNA
ggcgcgccagtcctagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatcgactcggaccgatg

SEQ ID NO: 2826 - DNA, 203 bp, Homo sapiens
  source 1..203: mol_type = other DNA
ggcgcgccagtcctgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactcgactcggaccgatg

SEQ ID NO: 2827 - DNA, 203 bp, Homo sapiens
  source 1..203: mol_type = other DNA
ggcgcgccagtcctgccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgttcgactcggaccgatg

SEQ ID NO: 2828 - DNA, 203 bp, Homo sapiens
  source 1..203: mol_type = other DNA
ggcgcgccagtccttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatcgactcggaccgatg

SEQ ID NO: 2829 - DNA, 203 bp, Homo sapiens
  source 1..203: mol_type = other DNA
ggcgcgccagtcctttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtacgactcggaccgatg

SEQ ID NO: 2830 - DNA, 203 bp, Homo sapiens
  source 1..203: mol_type = other DNA
ggcgcgccagtcctttccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttacgactcggaccgatg

SEQ ID NO: 2831 - DNA, 203 bp, Homo sapiens
  source 1..203: mol_type = other DNA
ggcgcgccagtcctaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagcgactcggaccgatg

SEQ ID NO: 2832 - DNA, 203 bp, Homo sapiens
  source 1..203: mol_type = other DNA
ggcgcgccagtccttaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggcgactcggaccgatg

SEQ ID NO: 2833 - DNA, 203 bp, Homo sapiens
  source 1..203: mol_type = other DNA
ggcgcgccagtcctccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacccgactcggaccgatg

SEQ ID NO: 2834 - DNA, 203 bp, Homo sapiens
  source 1..203: mol_type = other DNA
ggcgcgccagtcctggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcgactcggaccgatg

SEQ ID NO: 2835 - DNA, 203 bp, Homo sapiens
  source 1..203: mol_type = other DNA
ggcgcgccagtcctaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggcgactcggaccgatg

SEQ ID NO: 2836 - DNA, 203 bp, Homo sapiens
  source 1..203: mol_type = other DNA
ggcgcgccagtcctctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagacgactcggaccgatg

SEQ ID NO: 2837 - DNA, 203 bp, Homo sapiens
  source 1..203: mol_type = other DNA
ggcgcgccagtcctagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcgactcggaccgatg

SEQ ID NO: 2838 - DNA, 203 bp, Homo sapiens
  source 1..203: mol_type = other DNA
ggcgcgccagtccttgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaacgactcggaccgatg

SEQ ID NO: 2839 - DNA, 203 bp, Homo sapiens
  source 1..203: mol_type = other DNA
ggcgcgccagtccttttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgcgactcggaccgatg

SEQ ID NO: 2840 - DNA, 203 bp, Homo sapiens
  source 1..203: mol_type = other DNA
ggcgcgccagtccttttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgtcgactcggaccgatg

SEQ ID NO: 2841 - DNA, 203 bp, Homo sapiens
  source 1..203: mol_type = other DNA
ggcgcgccagtcctgggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaagcgactcggaccgatg

SEQ ID NO: 2842 - DNA, 203 bp, Homo sapiens
  source 1..203: mol_type = other DNA
ggcgcgccagtcctaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggcgactcggaccgatg

SEQ ID NO: 2843 - DNA, 203 bp, Homo sapiens
  source 1..203: mol_type = other DNA
ggcgcgccagtcctcaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttacgactcggaccgatg

SEQ ID NO: 2844 - DNA, 203 bp, Homo sapiens
  source 1..203: mol_type = other DNA
ggcgcgccagtcctcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccgactcggaccgatg

SEQ ID NO: 2845 - DNA, 203 bp, Homo sapiens
  source 1..203: mol_type = other DNA
ggcgcgccagtcctcccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctccgactcggaccgatg

SEQ ID NO: 2846 - DNA, 203 bp, Homo sapiens
  source 1..203: mol_type = other DNA
ggcgcgccagtcctcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggcgactcggaccgatg

SEQ ID NO: 2847 - DNA, 203 bp, Homo sapiens
  source 1..203: mol_type = other DNA
ggcgcgccagtcctggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctacgactcggaccgatg

SEQ ID NO: 2848 - DNA, 203 bp, Homo sapiens
  source 1..203: mol_type = other DNA
ggcgcgccagtcctcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtcgactcggaccgatg

SEQ ID NO: 2849 - DNA, 203 bp, Homo sapiens
  source 1..203: mol_type = other DNA
ggcgcgccagtcctgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtccgactcggaccgatg

SEQ ID NO: 2850 - DNA, 203 bp, Homo sapiens
  source 1..203: mol_type = other DNA
ggcgcgccagtcctgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatcgactcggaccgatg

SEQ ID NO: 2851 - DNA, 203 bp, Homo sapiens
  source 1..203: mol_type = other DNA
ggcgcgccagtcctacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacatcgactcggaccgatg

SEQ ID NO: 2852 - DNA, 203 bp, Homo sapiens
  source 1..203: mol_type = other DNA
ggcgcgccagtcctcatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagtcgactcggaccgatg

SEQ ID NO: 2853 - DNA, 203 bp, Homo sapiens
  source 1..203: mol_type = other DNA
ggcgcgccagtcctataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttcgactcggaccgatg

SEQ ID NO: 2854 - DNA, 203 bp, Homo sapiens
  source 1..203: mol_type = other DNA
ggcgcgccagtccttttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttcgactcggaccgatg

SEQ ID NO: 2855 - DNA, 203 bp, Homo sapiens
  source 1..203: mol_type = other DNA
ggcgcgccagtcctgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaacgactcggaccgatg

SEQ ID NO: 2856 - DNA, 203 bp, Homo sapiens
  source 1..203: mol_type = other DNA
ggcgcgccagtccttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacgactcggaccgatg

SEQ ID NO: 2857 - DNA, 203 bp, Homo sapiens
  source 1..203: mol_type = other DNA
ggcgcgccagtcctaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactcgactcggaccgatg

SEQ ID NO: 2858 - DNA, 203 bp, Homo sapiens
  source 1..203: mol_type = other DNA
ggcgcgccagtcctagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcacgactcggaccgatg

SEQ ID NO: 2859 - DNA, 203 bp, Homo sapiens
  source 1..203: mol_type = other DNA
ggcgcgccagtcctataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagccgactcggaccgatg

SEQ ID NO: 2860 - DNA, 203 bp, Homo sapiens
  source 1..203: mol_type = other DNA
ggcgcgccagtccttaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatcgactcggaccgatg

SEQ ID NO: 2861 - DNA, 203 bp, Homo sapiens
  source 1..203: mol_type = other DNA
ggcgcgccagtccttatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattacgactcggaccgatg

SEQ ID NO: 2862 - DNA, 203 bp, Homo sapiens
  source 1..203: mol_type = other DNA
ggcgcgccagtcctgctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgcgactcggaccgatg

SEQ ID NO: 2863 - DNA, 203 bp, Homo sapiens
  source 1..203: mol_type = other DNA
ggcgcgccagtcctgtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgacgactcggaccgatg

SEQ ID NO: 2864 - DNA, 203 bp, Homo sapiens
  source 1..203: mol_type = other DNA
ggcgcgccagtccttgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtcctcgactcggaccgatg

SEQ ID NO: 2865 - DNA, 203 bp, Homo sapiens
  source 1..203: mol_type = other DNA
ggcgcgccagtcctctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatcgactcggaccgatg

SEQ ID NO: 2866 - DNA, 203 bp, Homo sapiens
  source 1..203: mol_type = other DNA
ggcgcgccagtcctcttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgcgactcggaccgatg

SEQ ID NO: 2867 - DNA, 203 bp, Homo sapiens
  source 1..203: mol_type = other DNA
ggcgcgccagtccttagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaacgactcggaccgatg

SEQ ID NO: 2868 - DNA, 203 bp, Homo sapiens
  source 1..203: mol_type = other DNA
ggcgcgccagtccttcatttaagaatgatcagcaatacgtttagaacatatgaactgaatgaaatggacattttttcttaatttatgtataaatccatatgattatacataaagttctgatgcattaataaaagcagccaaatagggccaaagagaaaaataacaggactctgtactggacctaacttcgactcggaccgatg

SEQ ID NO: 2869 - DNA, 203 bp, Homo sapiens
  source 1..203: mol_type = other DNA
ggcgcgccagtccttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggaccgactcggaccgatg

SEQ ID NO: 2870 - DNA, 203 bp, Homo sapiens
  source 1..203: mol_type = other DNA
ggcgcgccagtccttattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaacgactcggaccgatg

SEQ ID NO: 2871 - DNA, 203 bp, Homo sapiens
  source 1..203: mol_type = other DNA
ggcgcgccagtcctttgcagtgagctgagattgcaccactacactccagcctggatgacagagtgagacttcatctcaaaaaaaaaaaaaaacaaaaaaaaacaacccggtagcattgtcccttccccactgacaaacttatcaaatccagaagctttagagtttcgtctctaattatttttctcctgcgactcggaccgatg

SEQ ID NO: 2872 - DNA, 203 bp, Homo sapiens
  source 1..203: mol_type = other DNA
ggcgcgccagtcctaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggcgactcggaccgatg

SEQ ID NO: 2873 - DNA, 203 bp, Homo sapiens
  source 1..203: mol_type = other DNA
ggcgcgccagtcctcccagaattactgtgcgtacaactttatttttcagagttttcattggaatggtaagagttttatgaaagacagttttaaaacttattctgagttaaatattaatactttaaaaaattattgtactagacttattgcagccttttgaaagtagcagagtttcatcataccacatacgactcggaccgatg

SEQ ID NO: 2874 - DNA, 203 bp, Homo sapiens
  source 1..203: mol_type = other DNA
ggcgcgccagtcctggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccgactcggaccgatg

SEQ ID NO: 2875 - DNA, 203 bp, Homo sapiens
  source 1..203: mol_type = other DNA
ggcgcgccagtcctgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccacgactcggaccgatg

SEQ ID NO: 2876 - DNA, 203 bp, Homo sapiens
  source 1..203: mol_type = other DNA
ggcgcgccagtcctttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgcgactcggaccgatg

SEQ ID NO: 2877 - DNA, 203 bp, Homo sapiens
  source 1..203: mol_type = other DNA
ggcgcgccagtcctaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctcgactcggaccgatg

SEQ ID NO: 2878 - DNA, 203 bp, Homo sapiens
  source 1..203: mol_type = other DNA
ggcgcgccagtcctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggaccgactcggaccgatg

SEQ ID NO: 2879 - DNA, 203 bp, Homo sapiens
  source 1..203: mol_type = other DNA
ggcgcgccagtcctagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaacgactcggaccgatg

SEQ ID NO: 2880 - DNA, 203 bp, Homo sapiens
  source 1..203: mol_type = other DNA
ggcgcgccagtcctattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagccaaccacaatgacgagctgcggccgactcggaccgatg

SEQ ID NO: 2881 - DNA, 203 bp, Homo sapiens
  source 1..203: mol_type = other DNA
ggcgcgccagtccttcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacacgactcggaccgatg

SEQ ID NO: 2882 - DNA, 203 bp, Homo sapiens
  source 1..203: mol_type = other DNA
ggcgcgccagtcctagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggcgactcggaccgatg

SEQ ID NO: 2883 - DNA, 203 bp, Homo sapiens
  source 1..203: mol_type = other DNA
ggcgcgccagtcctagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctaccgactcggaccgatg

SEQ ID NO: 2884 - DNA, 203 bp, Homo sapiens
  source 1..203: mol_type = other DNA
ggcgcgccagtcctctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtcgactcggaccgatg

SEQ ID NO: 2885 - DNA, 203 bp, Homo sapiens
  source 1..203: mol_type = other DNA
ggcgcgccagtcctccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaacgactcggaccgatg

SEQ ID NO: 2886 - DNA, 203 bp, Homo sapiens
  source 1..203: mol_type = other DNA
ggcgcgccagtcctcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgactcggaccgatg

SEQ ID NO: 2887 - DNA, 203 bp, Homo sapiens
  source 1..203: mol_type = other DNA
ggcgcgccagtcctcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggacgactcggaccgatg

SEQ ID NO: 2888 - DNA, 203 bp, Homo sapiens
  source 1..203: mol_type = other DNA
ggcgcgccagtcctgcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagccgactcggaccgatg

SEQ ID NO: 2889 - DNA, 203 bp, Homo sapiens
  source 1..203: mol_type = other DNA
ggcgcgccagtccttctcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattacgactcggaccgatg

SEQ ID NO: 2890 - DNA, 203 bp, Homo sapiens
  source 1..203: mol_type = other DNA
ggcgcgccagtcctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagacgactcggaccgatg

SEQ ID NO: 2891 - DNA, 203 bp, Homo sapiens
  source 1..203: mol_type = other DNA
ggcgcgccagtcctgtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtcgactcggaccgatg

SEQ ID NO: 2892 - DNA, 203 bp, Homo sapiens
  source 1..203: mol_type = other DNA
ggcgcgccagtccttacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtcgactcggaccgatg

SEQ ID NO: 2893 - DNA, 203 bp, Homo sapiens
  source 1..203: mol_type = other DNA
ggcgcgccagtcctttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggcgactcggaccgatg

SEQ ID NO: 2894 - DNA, 203 bp, Homo sapiens
  source 1..203: mol_type = other DNA
ggcgcgccagtccttgccaaaaacctgtggattttctctacaaaaattatcatgactgttatctttttgatggaaaagatgaagttcagcgaagaacaaatctacaacttggccagaagactgtagactttgccttcaaagagtgagcaaccctaattaacctgattttttgctgataatcactctcacgactcggaccgatg

SEQ ID NO: 2895 - DNA, 203 bp, Homo sapiens
  source 1..203: mol_type = other DNA
ggcgcgccagtcctattcagccccgtgctcagcagacatcagggatcaccgactctgtgccaggagctgttcttgatgctgggaacgcaggggtggacaaaacagagaaagccctgccctcagtgagaaatatgctgtcatgtaaattgctttttcccctatagaatgccagcagttactctgcagagcgactcggaccgatg

SEQ ID NO: 2896 - DNA, 203 bp, Homo sapiens
  source 1..203: mol_type = other DNA
ggcgcgccagtcctctcaaccacaacttctgacctcccagggtgtctgaggcctctaaagagcttagtttgcccctctgggaagtgaatccttggcttatggtgccggggggaccctggaggccccctcacacgaaggctgcttcttgcagagtcgctcaaaagtagggccccagggctcgcagcagccgactcggaccgatg

SEQ ID NO: 2897 - DNA, 203 bp, Homo sapiens
  source 1..203: mol_type = other DNA
ggcgcgccagtcctggcaagatggctcccctgcatgtctccggctgatcgctgccgctccgccaatacaatagagccagccactaccagcagcctggccctcttcctccttctccagagagaccaatccagccgaactcggggtttgccaaagggataaacagcacttccagggggagaaaaaaaatccgactcggaccgatg

SEQ ID NO: 2898 - DNA, 203 bp, Homo sapiens
  source 1..203: mol_type = other DNA
ggcgcgccagtccttaagcacctcgtgtgtgttcttcggcctcactgctctgtggcttaggtatctgtgctgtggggtttgagaaacatggtgaaggtgtatgaacagagcttgacatttgtgctctgctgtgtgcgtgcaccagctgcctccaggccaactacacgtgtgagacagatggggcctgccgactcggaccgatg

SEQ ID NO: 2899 - DNA, 203 bp, Homo sapiens
  source 1..203: mol_type = other DNA
ggcgcgccagtccttcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagaccgactcggaccgatg

SEQ ID NO: 2900 - DNA, 203 bp, Homo sapiens
  source 1..203: mol_type = other DNA
ggcgcgccagtccttatagcaagcaagaagtggcagggcgcgcaccggctgtcgccaagtgctgttcaactcagggagccggggcttcgctccgtccctcccccggcttccagagctttttggggttggagggtgggaggccaggggcgttctcacagctgtgtgtcctctttcccatcctgcgcagacgactcggaccgatg

SEQ ID NO: 2901 - DNA, 203 bp, Homo sapiens
  source 1..203: mol_type = other DNA
ggcgcgccagtcctagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaacgactcggaccgatg

SEQ ID NO: 2902 - DNA, 203 bp, Homo sapiens
  source 1..203: mol_type = other DNA
ggcgcgccagtcctgagagaaagaaaaggaacgggagctgagagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccacccgactcggaccgatg

SEQ ID NO: 2903 - DNA, 203 bp, Homo sapiens
  source 1..203: mol_type = other DNA
ggcgcgccagtcctagaacttaagaaacttgagacagggaaggagagccgggagcagccaaaacctgctaagtctcagaagactggtttctgcacaagggaatggaagaagtgactggaggtggctgtggattcaactctggcctgagattgattcccttgagataacaaatccagtttgctgatgaccgactcggaccgatg

SEQ ID NO: 2904 - DNA, 203 bp, Homo sapiens
  source 1..203: mol_type = other DNA
ggcgcgccagtcctaggccacagtaccctattcacgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcacgactcggaccgatg

SEQ ID NO: 2905 - DNA, 203 bp, Homo sapiens
  source 1..203: mol_type = other DNA
ggcgcgccagtcctaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcacgactcggaccgatg

SEQ ID NO: 2906 - DNA, 203 bp, Homo sapiens
  source 1..203: mol_type = other DNA
ggcgcgccagtcctcccggcccgccaccatgacttccagcaagatagagatgcccggcgaggtgaaggccgaccccgccgccctcatggcgtcgctgcacctcctgccgtcgcccacgcccaatctcgaaattaagtacaccaaggtgtgaaaattggacttgctggcagaatcctttttgggagaagcgactcggaccgatg

SEQ ID NO: 2907 - DNA, 203 bp, Homo sapiens
  source 1..203: mol_type = other DNA
ggcgcgccagtcctcccacttgtgatgcttcaagacccctggagcacgtcaggttcttagatctcgttttgaggagtgatgtggagtgacgcatccttacagatcccaaagcgttgaataaacggttgtacaaagagatccaggatgagaagactgataaaagaagaagctagctgaacagctgtaaacgactcggaccgatg

SEQ ID NO: 2908 - DNA, 203 bp, Homo sapiens
  source 1..203: mol_type = other DNA
ggcgcgccagtcctaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatccgactcggaccgatg

SEQ ID NO: 2909 - DNA, 203 bp, Homo sapiens
  source 1..203: mol_type = other DNA
ggcgcgccagtcctagcggagcgcggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcagggcaggatgtacacgctgctgtcgggccgactcggaccgatg

SEQ ID NO: 2910 - DNA, 203 bp, Homo sapiens
  source 1..203: mol_type = other DNA
ggcgcgccagtcctgagccgtccgtccggagccaggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaaccgactcggaccgatg

SEQ ID NO: 2911 - DNA, 203 bp, Homo sapiens
  source 1..203: mol_type = other DNA
ggcgcgccagtcctcctgaagatgtagctcctactgttggattttcaaaaattaaccttagacaaggaaagtttgaagtcaccatctttgacttgggaggtggaataagaattcggggaatctggaagaattactatgctgaatcctatggggtaatatttgttgtggattccagtgatgaagagagacgactcggaccgatg

SEQ ID NO: 2912 - DNA, 203 bp, Homo sapiens
  source 1..203: mol_type = other DNA
ggcgcgccagtcctcctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaaccgactcggaccgatg

SEQ ID NO: 2913 - DNA, 203 bp, Homo sapiens
  source 1..203: mol_type = other DNA
ggcgcgccagtcctagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagacgactcggaccgatg

SEQ ID NO: 2914 - DNA, 203 bp, Homo sapiens
  source 1..203: mol_type = other DNA
ggcgcgccagtcctttatatggtcatttaaatctcccagggcttcctccaagggccaaaaataatccggagacacagcagctgtgtccagcacacagaggacccggccatctgctttggttcagagccctgtgtctgtcagtcagtctctccctggctctccctccatcctcattcctgcctgaagcccgactcggaccgatg

SEQ ID NO: 2915 - DNA, 203 bp, Homo sapiens
  source 1..203: mol_type = other DNA
ggcgcgccagtcctagggttcttgtggcctctggcgggcctccagccagttagaccatttgaccagaacgtgtgcagctcagccagccacagaactggaatttttcaggagcagggggagcatggagtttggactttgctgagcaactgaagtggagcgcagagcttgctcgcttaggagagagcatccgactcggaccgatg

SEQ ID NO: 2916 - DNA, 203 bp, Homo sapiens
  source 1..203: mol_type = other DNA
ggcgcgccagtcctgcgtcggggagcggcggtaccgggcggctgcggggctggctcgacccagcttgaggtctcggcgtccgcgtcctgcggtgccctggggtctcccgaggaccttgtacccgcgcggcttccttgggctggctttggacgacgctttcgccttcctgctgcctaggatccgccgaccgactcggaccgatg

SEQ ID NO: 2917 - DNA, 203 bp, Homo sapiens
  source 1..203: mol_type = other DNA
ggcgcgccagtcctctcgcaccgctgccccgcgagcagctcctcttctcccgaggcgcgcggggcgcccccgcgagccccgcggctgagaccccgcagcctggaggagggctgtccggggctttggtgtggccgtggctgacactaaagactttgtagccatcaacccgagtgcagtttcgatggaaacgactcggaccgatg

SEQ ID NO: 2918 - DNA, 203 bp, Homo sapiens
  source 1..203: mol_type = other DNA
ggcgcgccagtcctcagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggttcctgacggagacttcgcccttccgactcggaccgatg

SEQ ID NO: 2919 - DNA, 203 bp, Homo sapiens
  source 1..203: mol_type = other DNA
ggcgcgccagtcctcactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagcgactcggaccgatg

SEQ ID NO: 2920 - DNA, 203 bp, Homo sapiens
  source 1..203: mol_type = other DNA
ggcgcgccagtccttcttggtcttggactgagccacactcctggcatcccagcgtctccagcttgcatggcctgtcacgagaaccctgactaatacacctggagtgcagaatctgctggagaaactgccattccgttattgactggctggtcaggccatacagcctggtggtctagatgtgtttggagcgactcggaccgatg

SEQ ID NO: 2921 - DNA, 203 bp, Homo sapiens
  source 1..203: mol_type = other DNA
ggcgcgccagtcctaaggccgcgaggttggagggcacggggacacagcatagcgaggaaggaacgctcgagatttctgtggctcctcaagatattggtcataatcctggtacttggcattgttggatttatgttcggaagcatgttccttcaagcagtgttcagcagccccaagccagaactcccaagcgactcggaccgatg

SEQ ID NO: 2922 - DNA, 203 bp, Homo sapiens
  source 1..203: mol_type = other DNA
ggcgcgccagtccttgtgtcatccccggtagagggtgcccgtcacggccaaccacagagatcccggtcctccgggattctagagcgtccggccgaaccctccactgacttccggtggctgagcctctccgcagcttccggccaagttggactgcagctcgcggtttcctggcttctagtttccagagtcgactcggaccgatg

SEQ ID NO: 2923 - DNA, 203 bp, Homo sapiens
  source 1..203: mol_type = other DNA
ggcgcgccagtcctctgcgcctgcgcatgccacacgcgcactcgcgtggccttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgactcggaccgatg

SEQ ID NO: 2924 - DNA, 203 bp, Homo sapiens
  source 1..203: mol_type = other DNA
ggcgcgccagtcctggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacacgactcggaccgatg

SEQ ID NO: 2925 - DNA, 203 bp, Homo sapiens
  source 1..203: mol_type = other DNA
ggcgcgccagtcctaggttcggctcacactgagatcggggctggagagagagtcagattttggagcggagcgtttggaaagcgagccccagtttggtcccctcattgagctcgctgaagttggcttcctagcggtgtaggctggaatagactcttggcaagctccggttccaccaggtgagaagagtgcgactcggaccgatg

SEQ ID NO: 2926 - DNA, 203 bp, Homo sapiens
  source 1..203: mol_type = other DNA
ggcgcgccagtcctgtaaaccaatagcccccatgctctgtgcgatttcattgtgtgctcgcgttcgcaagctccgtagtgcaggaagttccaccaggtgagaagagtgatgaccatccttttccttactatggttatttcatactttggttgcatgaaggctgcccccatgaaagaagcaaacatccgcgactcggaccgatg

SEQ ID NO: 2927 - DNA, 203 bp, Homo sapiens
  source 1..203: mol_type = other DNA
ggcgcgccagtcctcagccggggtttctgcagagggcgcgggacgcggggttccccggggctgaggctggggctggaacacccctcgaagccgcgggcgtcctgtccaaggcgccccaggagggcgcaggactcgcagggcgatgtcgcggggccctaggggaggagttccaccaggtgagaagagtgcgactcggaccgatg

SEQ ID NO: 2928 - DNA, 203 bp, Homo sapiens
  source 1..203: mol_type = other DNA
ggcgcgccagtccttgtgactccgccgccggggacccgtgaggtttgtgtggaccccgagcatgagcagagatcattaaaaattaaacttacaaagctgctaaagtgggaagaaggagaacttgaagccacaatttttgcacttgcttagaagccatctaatctcagttccaccaggtgagaagagtgcgactcggaccgatg

SEQ ID NO: 2929 - DNA, 203 bp, Homo sapiens
  source 1..203: mol_type = other DNA
ggcgcgccagtcctatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggcgactcggaccgatg

SEQ ID NO: 2930 - DNA, 203 bp, Homo sapiens
  source 1..203: mol_type = other DNA
ggcgcgccagtcctaccgaggccacagctgcgatttcatagtgtgggaccccactggcaaagacacgctggctgctgtggccgtggtttctgtcccagccgtctgtttccatagaaaaagacccgtgcctgtatattccacgctttgcgcacctgctggaattcggggagaagaaccacgaggtgtcccgactcggaccgatg

SEQ ID NO: 2931 - DNA, 203 bp, Homo sapiens
  source 1..203: mol_type = other DNA
ggcgcgccagtcctctttttcctttcttccggatgagaggctaagccataatagaaagaatggagaattattgattgaccgtctttattctgtgggctctgattctccaatgggaataccaagggctcagttttctgtgcttggaccctctgggcccatcctggccatggtgggtgaagacgctgatccgactcggaccgatg

SEQ ID NO: 2932 - DNA, 203 bp, Homo sapiens
  source 1..203: mol_type = other DNA
ggcgcgccagtcctggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacagatactgtggcctcatgaataggacgactcggaccgatg

SEQ ID NO: 2933 - DNA, 203 bp, Homo sapiens
  source 1..203: mol_type = other DNA
ggcgcgccagtcctaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgcgactcggaccgatg

SEQ ID NO: 2934 - DNA, 203 bp, Homo sapiens
  source 1..203: mol_type = other DNA
ggcgcgccagtcctcgactaggcctagtcgtagcggcggccagcgggagggcgtagccgtagtcttggcccacgtcattctgtgccccgggtcaggtcaccgcccggagggtatgggaagagaaatgaagaagactggtactcccagacccttccgtatcgaggaccccaatcaacaacccacctgagcgactcggaccgatg

SEQ ID NO: 2935 - DNA, 203 bp, Homo sapiens
  source 1..203: mol_type = other DNA
ggcgcgccagtcctccccacctcctgctcccatccccctggctcccgccgccctgtagctcggcagccctgccaggagcccggaagtgggtccgcacgagacagaatagactacactcaaactccaggggaaccgttcattgggcttggacacgaaggcgggaccctgccgacgcagtgattggatgccgactcggaccgatg

SEQ ID NO: 2936 - DNA, 203 bp, Homo sapiens
  source 1..203: mol_type = other DNA
ggcgcgccagtcctaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgcccgactcggaccgatg

SEQ ID NO: 2937 - DNA, 203 bp, Homo sapiens
  source 1..203: mol_type = other DNA
ggcgcgccagtcctggagactcgagacttgaagccagcttattctggacccacgcaggcgactgaagacgatgggacccactgccctgcattcggtaagtcccgggtctaacggatgatccatatatttcaggtgaggagcaaaagaagggatccacctattcagttccaaaatctaaggagaagttgcgactcggaccgatg

SEQ ID NO: 2938 - DNA, 203 bp, Homo sapiens
  source 1..203: mol_type = other DNA
ggcgcgccagtcctaggcgacatgtgagggccctgagccccctgactggaagcaggggctgtttttcaactcctggactaaagcccagaagcagctggggaagctccaggctacctacacaacctggcccaggctggtcacggtgtcccccctccctgctctgtgccctctccttccagaaatccacccgactcggaccgatg

SEQ ID NO: 2939 - DNA, 203 bp, Homo sapiens
  source 1..203: mol_type = other DNA
ggcgcgccagtcctctgaaatgctggtttttgtttttgtttttttattttacgagtggacacaattctcacctgagtccttggccacgtggcgctatggcggtcactaccgggaattaaccacggccaccctctcagagcgccgggcgcggactcagggacacgccggctaccacctgagccggcccccgactcggaccgatg

SEQ ID NO: 2940 - DNA, 203 bp, Homo sapiens
  source 1..203: mol_type = other DNA
ggcgcgccagtcctctctactcaaggaaatctttgtttccactgggacggaatcggagctctggaggctgggctggccaagcgccccgaaggcccgatgcctgacggctcatgcggcctccttgtttgcagggcctgggcaaaaatttacactgagtcccactcttcgctccagggcccggcaggaagcgactcggaccgatg

SEQ ID NO: 2941 - DNA, 203 bp, Homo sapiens
  source 1..203: mol_type = other DNA
ggcgcgccagtcctccatgcactgagctggggacatgcaacaataacaggccatacaatgaaagtcgctgaagaagaatatgaattttgcctgcggatttgctaacactcgacaatcctaggaggtgagttccaacaaattggttcaaaaagaggggggataaacacgctggcccatgctgggcaagccgactcggaccgatg

SEQ ID NO: 2942 - DNA, 203 bp, Homo sapiens
  source 1..203: mol_type = other DNA
ggcgcgccagtcctggcgaggcctcacggtggaactctcagatgacagcatgcaggcaccaagagagtggacgcacatacagaagacagccatgcactgagctggggacatgcaacaataacaggtgagttccaacaaattggttcaaaaagaggggggataaacacgctggcccatgctgggcaagccgactcggaccgatg

SEQ ID NO: 2943 - DNA, 203 bp, Homo sapiens
  source 1..203: mol_type = other DNA
ggcgcgccagtccttagatacgtaaacacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagccgactcggaccgatg

SEQ ID NO: 2944 - DNA, 203 bp, Homo sapiens
  source 1..203: mol_type = other DNA
ggcgcgccagtcctacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccggaataatgctgacagccgactcggaccgatg

SEQ ID NO: 2945 - DNA, 203 bp, Homo sapiens
  source 1..203: mol_type = other DNA
ggcgcgccagtcctcgctccgcactcacccgccctctgggcctcccacaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagcgactcggaccgatg

SEQ ID NO: 2946 - DNA, 203 bp, Homo sapiens
  source 1..203: mol_type = other DNA
ggcgcgccagtccttctgcccaggcagggagcggctgggatgggactgaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagcgactcggaccgatg

SEQ ID NO: 2947 - DNA, 203 bp, Homo sapiens
  source 1..203: mol_type = other DNA
ggcgcgccagtcctggatgggagtcctctggggcagggagtgaaagccccggaggcagaaagggacggagaacaggggcttgcccagagcatggataggaaaggagctggggttctccggggctcagcgcgcactgagaacctgtgcccggggctgcagctgcggacgataaaggcgctgtctggctccgactcggaccgatg

SEQ ID NO: 2948 - DNA, 203 bp, Homo sapiens
  source 1..203: mol_type = other DNA
ggcgcgccagtcctataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctcccgactcggaccgatg

SEQ ID NO: 2949 - DNA, 203 bp, Homo sapiens
  source 1..203: mol_type = other DNA
ggcgcgccagtcctaacacctccctccagtggtcaaatccagctcaacagactctgtactttgacgacaagaaagctttaagggacaataggatcgagctggttcgcgcttcctggcatgaattgagtattagtgtcagtgatgtgtctctctctgatgaaggacagtacacctgttctttatttacacgactcggaccgatg

SEQ ID NO: 2950 - DNA, 203 bp, Homo sapiens
  source 1..203: mol_type = other DNA
ggcgcgccagtcctgggtcccaaagcaaaaaaggaacactgtcatcacaaacaggcttcagtggccaaagatctggcagtaagaaaaagaaagtcaccaaagctgaacgattgaagctgctacaagaggaggaggagagacgactgaaagaggaagaggaagcccgtttgaaatatgagaaagaagaacgactcggaccgatg

SEQ ID NO: 2951 - DNA, 203 bp, Homo sapiens
  source 1..203: mol_type = other DNA
ggcgcgccagtcctcagtgatcggcttaggaccgctttctaggtggtgaggacaagagtgatggctgttttagtacttcaggtggaattcgtccttttcatcttcagaactggaagcagaaagttaatcagactaagaaagcagaatttgtacgcacagcagaaaaatttaaaaatcaagtaattaaccgactcggaccgatg

SEQ ID NO: 2952 - DNA, 203 bp, Homo sapiens
  source 1..203: mol_type = other DNA
ggcgcgccagtcctccgaccctggggcgtcgggtccggtggtcttgcagcctccaaaccccgagtgctataccgaactgcgcgccaagggtgggagagctgacggcctgggccacccttcttccttcactgggcaggctttgaggtgcttgtcggtctggactgatgaaaatccatatgacctgaaagcgactcggaccgatg

SEQ ID NO: 2953 - DNA, 203 bp, Homo sapiens
  source 1..203: mol_type = other DNA
ggcgcgccagtcctgggagagttgcatcgccctccacagagcaggcttgcatctgactgacccaccatgacacccacagacttcacatctcctccaggccccgctccagatcaccttccctcgctggcccaggaatccatctccttccaggaccttagcccaggactaacacaagccctattcctaaccgactcggaccgatg

SEQ ID NO: 2954 - DNA, 203 bp, Homo sapiens
  source 1..203: mol_type = other DNA
ggcgcgccagtcctgggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgacccgactcggaccgatg

SEQ ID NO: 2955 - DNA, 203 bp, Homo sapiens
  source 1..203: mol_type = other DNA
ggcgcgccagtcctggctgccagcttcctttcggcccctgcttttgtgctccctccgctcccaaactgtacctgtcacagaccaggaaaaatgtttgctgtgctgcgtctgttggcgagtcccctcctcacccggttcccttcctctgcatcctttcctcagcttgagaaacacctctttgccccgtccgactcggaccgatg

SEQ ID NO: 2956 - DNA, 203 bp, Homo sapiens
  source 1..203: mol_type = other DNA
ggcgcgccagtcctagtcctggcattatttctctctctacaaggagccttaggaggtacggggagctcgcaaatactccttttggtttattcttaccaccttgcttctgtgttccttgggaatgctgctgtgcttatgcatctggtctctttttggagctacagtggacaggcatttgtgacagcactcgactcggaccgatg

SEQ ID NO: 2957 - DNA, 203 bp, Homo sapiens
  source 1..203: mol_type = other DNA
ggcgcgccagtcctcacccttctcctcctccgcccagtactcgtggccagggtcgtatcagttctccgtcaacttgcttggggccttggacgagcctcctggcgcttcctgtcagtggcgaaaagctgctttgctccccctgtggatgtaaccccttagctggcattttgcatctcaattggcttgtgcgactcggaccgatg

SEQ ID NO: 2958 - DNA, 203 bp, Homo sapiens
  source 1..203: mol_type = other DNA
ggcgcgccagtccttagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgcccgactcggaccgatg

SEQ ID NO: 2959 - DNA, 203 bp, Homo sapiens
  source 1..203: mol_type = other DNA
ggcgcgccagtcctgagcaatcttctcagccgtgcactcacagcttggaaaataaagggaggaaggagtcccagccacagggtagaggaacggcctctccacagagaagctgctgctgctgagctgaagtgacagtcaagttcagcagctgtgtggggaccaaggggacacaatatgagaccaacagccgactcggaccgatg

SEQ ID NO: 2960 - DNA, 203 bp, Homo sapiens
  source 1..203: mol_type = other DNA
ggcgcgccagtccttggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggcgactcggaccgatg

SEQ ID NO: 2961 - DNA, 203 bp, Homo sapiens
  source 1..203: mol_type = other DNA
ggcgcgccagtccttttccggagcaggggaagctgccccgtgcccgggagggagcgggcgcaccgcggcccccaggacacgcgctgtgagtcccgcgggcggtgcgcctgggaggaagggggaggtcggaggagggggcaccgcggcgccgggtataaggagcaaaggacccggctgcccagtccctccgactcggaccgatg

SEQ ID NO: 2962 - DNA, 203 bp, Homo sapiens
  source 1..203: mol_type = other DNA
ggcgcgccagtccttctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaaccgactcggaccgatg

SEQ ID NO: 2963 - DNA, 203 bp, Homo sapiens
  source 1..203: mol_type = other DNA
ggcgcgccagtcctgagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagcgactcggaccgatg

SEQ ID NO: 2964 - DNA, 203 bp, Homo sapiens
  source 1..203: mol_type = other DNA
ggcgcgccagtcctcaagccggggaccaagccggggaccaagccggggactaaggcgagccggagaccgagcccgaacagcagtcccgcagcgtggacaagcagcatgccgtcatcaactacgaccaggacagggacgagcactgggtgaaggacctgggcagcctcaatgggacgtttgtgaatgaccgactcggaccgatg

SEQ ID NO: 2965 - DNA, 203 bp, Homo sapiens
  source 1..203: mol_type = other DNA
ggcgcgccagtcctgctcccagctttgaaggtcttgcggtgaagcatcaagtgtacctgatttgtgaacctatcttgcttcagttggtttcctcctaaatattaggcagatgggattggctggtctgtgctctgctaggtgaaaaattagacgatttcaagaattggagctgaatctgatgttaagtacgactcggaccgatg

SEQ ID NO: 2966 - DNA, 203 bp, Homo sapiens
  source 1..203: mol_type = other DNA
ggcgcgccagtcctaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgatacgactcggaccgatg

SEQ ID NO: 2967 - DNA, 203 bp, Homo sapiens
  source 1..203: mol_type = other DNA
ggcgcgccagtcctcattcccgcgcctccaaaacctaggccgggggcgctggaaacccttaccggcacccggccaccgcggcagacgcttgctcctgccacgccccccccccctcccccgcatcacgtgtctgcactcgctttcctcggattcccggatgtggttgccaaaacaaaggggatttggtgcgactcggaccgatg

SEQ ID NO: 2968 - DNA, 203 bp, Homo sapiens
  source 1..203: mol_type = other DNA
ggcgcgccagtcctacgctcttaccagctggagggagtaaactggctcgcccagcgcttccattgtcagaatggctgtatcctgggagatgagatgggcctggggaagacctgccaggaagattaaatgatgaagggccatttctgattctttgtcccttgtctgttttgagcaactggaaagaagaacgactcggaccgatg

SEQ ID NO: 2969 - DNA, 203 bp, Homo sapiens
  source 1..203: mol_type = other DNA
ggcgcgccagtccttgataaccacagaatcagaacatataaaaagctctgcgggactggtgctgactgcaaccatgacaaagcttattctcctcacaggtcttgtccttatactgaatttgcagctcggaacagccagctgaaaactctcctggccattggaggctggaacttcgggactgccccgaacgactcggaccgatg

SEQ ID NO: 2970 - DNA, 203 bp, Homo sapiens
  source 1..203: mol_type = other DNA
ggcgcgccagtcctctgaaagccggaaggggcaagacgggttcagttcgtcatggggctgtttggaaagacccaggagaagccgcccaaagaactgatatccaaagagaagaagaaaaagtgaaacgatctgtgaaagatgctgccaagaagggccagaaggatgtctgcatagttctggccaaggagcgactcggaccgatg

SEQ ID NO: 2971 - DNA, 203 bp, Homo sapiens
  source 1..203: mol_type = other DNA
ggcgcgccagtcctgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagcgactcggaccgatg

SEQ ID NO: 2972 - DNA, 203 bp, Homo sapiens
  source 1..203: mol_type = other DNA
ggcgcgccagtcctcacggggcgctggctccgggtctggcggccgctgatgggagtcggagcccgggcgggcgagcggcggcgcggcggccaccatggggaacaagcagaccatcttcaccgaagagcagctagacaactaccaggctgcattcgcgattctatgagctggcccccaacctcgtcccacgactcggaccgatg

SEQ ID NO: 2973 - DNA, 203 bp, Homo sapiens
  source 1..203: mol_type = other DNA
ggcgcgccagtcctagaatgttcttttggccactgtgaagcctcaggaaggggctcggattgctcaaggacccatgggagagaggaggctttgactgggctgcctgcctgtgaggtctctggactagaggtccaacgcagtccagctgacaaggatggaatacgccatgaagtcccttagccttctctcgactcggaccgatg

SEQ ID NO: 2974 - DNA, 203 bp, Homo sapiens
  source 1..203: mol_type = other DNA
ggcgcgccagtcctactgttgaagccgcagtctccactctcctactgacaccagagaccacccagcccagccaaaccatatggcctcttgttttcctgatgtatgagggctccggctggcacctgaggagcggcgtgaccccgagggcccagggagctgcccggctggcctaggcaggcagccgcacccgactcggaccgatg

SEQ ID NO: 2975 - DNA, 203 bp, Homo sapiens
  source 1..203: mol_type = other DNA
ggcgcgccagtccttccctatggttgcccaagatccagttgcgcggaggccacccggggccctggaagctcctaggggcttggaccctggagcctgccgggcaccctctccagctgacctctgcctccaggatttgcctgaaggctgcccccaactctgcacccgccccccgagggccaccgaggacccgactcggaccgatg

SEQ ID NO: 2976 - DNA, 203 bp, Homo sapiens
  source 1..203: mol_type = other DNA
ggcgcgccagtccttctcccgccacccacaccagctgtcccactcaccatggagaagatcctgatcctcctgcttgtcgccctctctgtggcctatgcagctcctggcccccgggggatcattatcaacctggctggagtgtagtggcacaatctcggctcactgcaatctctgcttcccgggttcaacgactcggaccgatg

SEQ ID NO: 2977 - DNA, 203 bp, Homo sapiens
  source 1..203: mol_type = other DNA
ggcgcgccagtccttctgaaactatcttgttgttgatgcaggctattttcttgaccccttcatgggactcccaacaggggtaccccatttactcagcctgccctgctcaacctcttgcaggagggagcacacgagtgaacgagtgcaggaaccagctggctgctttagtgctgtgaggagtaaactcccgactcggaccgatg

SEQ ID NO: 2978 - DNA, 203 bp, Homo sapiens
  source 1..203: mol_type = other DNA
ggcgcgccagtcctacctgcaggcccgggccgcggggttggtttccaccctggaggttgctgacaccctgtgccctcggctgacttccagccggtggcacagacgcctccagggggcagcactcaagcgcatcttaggaatgacagtaacagcgggaacatgaagccgccactcttggtgtttattgtcgactcggaccgatg

SEQ ID NO: 2979 - DNA, 203 bp, Homo sapiens
  source 1..203: mol_type = other DNA
ggcgcgccagtccttagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagcgactcggaccgatg

SEQ ID NO: 2980 - DNA, 203 bp, Homo sapiens
  source 1..203: mol_type = other DNA
ggcgcgccagtcctttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggacgactcggaccgatg

SEQ ID NO: 2981 - DNA, 203 bp, Homo sapiens
  source 1..203: mol_type = other DNA
ggcgcgccagtcctcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctcccgactcggaccgatg

SEQ ID NO: 2982 - DNA, 203 bp, Homo sapiens
  source 1..203: mol_type = other DNA
ggcgcgccagtcctggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgcgactcggaccgatg

SEQ ID NO: 2983 - DNA, 203 bp, Homo sapiens
  source 1..203: mol_type = other DNA
ggcgcgccagtcctagcggctgcagcatccagccagcttggatgtctggcctgtgagcctggggaaactattattaataatatttactgttgataatattggggaaaacagcccttaactctgaggtttctgctgtgctcctttccaaaacagacttccaggactctgaagaaacagttacaagcaggcgactcggaccgatg

SEQ ID NO: 2984 - DNA, 203 bp, Homo sapiens
  source 1..203: mol_type = other DNA
ggcgcgccagtcctcgggcagcgaagatgttagccttcgctgccaggaccgtggaccgatcccagggctgtggtgtaacctcagcggccaggcagtctctgtcctccagccaagttttccctcatcaaaacgatcttcgcagattctgacaggtgaagcctctgggcttcctgaagcccttctccttgcgactcggaccgatg

SEQ ID NO: 2985 - DNA, 203 bp, Homo sapiens
  source 1..203: mol_type = other DNA
ggcgcgccagtcctgatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctacccgactcggaccgatg

SEQ ID NO: 2986 - DNA, 203 bp, Homo sapiens
  source 1..203: mol_type = other DNA
ggcgcgccagtcctgaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaacgactcggaccgatg

SEQ ID NO: 2987 - DNA, 203 bp, Homo sapiens
  source 1..203: mol_type = other DNA
ggcgcgccagtcctgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactccgactcggaccgatg

SEQ ID NO: 2988 - DNA, 203 bp, Homo sapiens
  source 1..203: mol_type = other DNA
ggcgcgccagtcctgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaacccgactcggaccgatg

SEQ ID NO: 2989 - DNA, 203 bp, Homo sapiens
  source 1..203: mol_type = other DNA
ggcgcgccagtcctttgacagctctgggcgaccggaggtggcgcccaaaggctgcccgggagatcggggctgggctggcgggggccaggaccccgcgccctctcggccgctcactctcgcgtccactccctcgcagtcacgccgggcgcgcactcccactccctctccgcacgcggctgcgggacgcgcgactcggaccgatg

SEQ ID NO: 2990 - DNA, 203 bp, Homo sapiens
  source 1..203: mol_type = other DNA
ggcgcgccagtcctctctgaagggagctactcagaagcgggagtctccgagagaagaaaagcaggtggaaggagaggaagcggatgccgtggggtttacagcaggaaaatccgtggagacagcagatccgagaagcggcgatgtttgcgtagaaccctctcttcccttctctctgaccagcaccatgccgactcggaccgatg

SEQ ID NO: 2991 - DNA, 203 bp, Homo sapiens
  source 1..203: mol_type = other DNA
ggcgcgccagtcctaagcgggagtctccgagagaagaaaagcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcacccgactcggaccgatg

SEQ ID NO: 2992 - DNA, 203 bp, Homo sapiens
  source 1..203: mol_type = other DNA
ggcgcgccagtcctagcatcccaaggcccgactccccgcaccactcagggtcctgtggacagctcacctagcggcaatggctgcaggaagaagcctatatcacaaaggaacagaagtattcattcctgcatgactcccagacctccttctgcttctcagactctattccgacatcctccaacatggagcgactcggaccgatg

SEQ ID NO: 2993 - DNA, 203 bp, Homo sapiens
  source 1..203: mol_type = other DNA
ggcgcgccagtcctgcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggttgtggcagcactgcctgaaggtcgactcggaccgatg

SEQ ID NO: 2994 - DNA, 203 bp, Homo sapiens
  source 1..203: mol_type = other DNA
ggcgcgccagtcctcagtatctcagtgcctcctgtgggccctcctcccctccttatccattccccctcagatctcccaggccccctgcaggccctcgtgccctccttacttcccccccgggtctcccagcgccccctgcggggccctcctcccttcctcatccacttcaaccccaaggccaagtcattcgactcggaccgatg

SEQ ID NO: 2995 - DNA, 203 bp, Homo sapiens
  source 1..203: mol_type = other DNA
ggcgcgccagtccttcccttccccttccctgcccccttcccccacccccgactcgggcttggcgcggcggccagaggaaccccgagcccgcatttgctgcatcgagcagttggtttagtatcagccaaacttgcagctgttcagaccgcgctccgccgagtcccggcccaggcccctgagctggagggcgactcggaccgatg

SEQ ID NO: 2996 - DNA, 203 bp, Homo sapiens
  source 1..203: mol_type = other DNA
ggcgcgccagtccttgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaaccgactcggaccgatg

SEQ ID NO: 2997 - DNA, 203 bp, Homo sapiens
  source 1..203: mol_type = other DNA
ggcgcgccagtcctagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaaccgactcggaccgatg

SEQ ID NO: 2998 - DNA, 203 bp, Homo sapiens
  source 1..203: mol_type = other DNA
ggcgcgccagtcctgtaatggcagcgctgtgagcaggggaacgcgagctgacagccgccgccgccgccgcctccgcccaccttcctcgccggggcttcgtctttcactccttcgggctgcctccccctccccttgtcccctgccccttgccctgcttctgcagaagatttcaacactacacttgcacacgactcggaccgatg

SEQ ID NO: 2999 - DNA, 203 bp, Homo sapiens
  source 1..203: mol_type = other DNA
ggcgcgccagtcctctcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggcgactcggaccgatg

SEQ ID NO: 3000 - DNA, 203 bp, Homo sapiens
  source 1..203: mol_type = other DNA
ggcgcgccagtcctctcggtggcggcggcggcggccggctccaggccgggttttggcgccgcccgcctgctgcctcctggcggctcctgaactccagccccctctctatcagccgctcactccgtctcaatatgtctcaagatggcggccaatgtgggatcgatgtttcaatattggaagcgctttgacgactcggaccgatg

SEQ ID NO: 3001 - DNA, 203 bp, Homo sapiens
  source 1..203: mol_type = other DNA
ggcgcgccagtcctcccagtgtggtccagtgagtactctgggctccctctcgtgggcagggaagctgagggccccatgagctctcccagcttcctgaaggctccccattaatgagagctgactgtgctgtgctttgctgactgcagggcctgctccctgccccccacctccaggttggggccttcacccgactcggaccgatg

SEQ ID NO: 3002 - DNA, 203 bp, Homo sapiens
  source 1..203: mol_type = other DNA
ggcgcgccagtcctccatgtttactactgtttgtgcggccagatggtcctagtgctgggtgagtagccgggaactgcgggggcgtctgcaaggagccagacttcgggttcttgaaggcgaatttcctctggctgtgatctgggagccacttctcaacgaagattgactgccagttagagaaattgccccgactcggaccgatg

SEQ ID NO: 3003 - DNA, 203 bp, Homo sapiens
  source 1..203: mol_type = other DNA
ggcgcgccagtcctgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgcgactcggaccgatg

SEQ ID NO: 3004 - DNA, 203 bp, Homo sapiens
  source 1..203: mol_type = other DNA
ggcgcgccagtcctgagaaggaagctccctcctggccccactcctcttcctattattggaaatatgctacagatagatgttaaggacatctgcaaatctttcaccaatgtaagtctgccttatgttcctccagccaattgcaaaggttctcaaaagtctatggtcctgtgttcaccgtgtattttggccgactcggaccgatg

SEQ ID NO: 3005 - DNA, 203 bp, Homo sapiens
  source 1..203: mol_type = other DNA
ggcgcgccagtccttttagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaacgactcggaccgatg

SEQ ID NO: 3006 - DNA, 203 bp, Homo sapiens
  source 1..203: mol_type = other DNA
ggcgcgccagtcctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagcgactcggaccgatg

SEQ ID NO: 3007 - DNA, 203 bp, Homo sapiens
  source 1..203: mol_type = other DNA
ggcgcgccagtcctcctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttcgactcggaccgatg

SEQ ID NO: 3008 - DNA, 203 bp, Homo sapiens
  source 1..203: mol_type = other DNA
ggcgcgccagtcctgaagagaagcagaggccagctgtttttgaggatcctgctccacagagaatgctctgcacccgttgatatgcctcccaggacccagagggagactgtagcctcatttctgtggagacctttggctggactctcctggctctcccagagactccagttccaacaccatcttctgagcgactcggaccgatg

SEQ ID NO: 3009 - DNA, 203 bp, Homo sapiens
  source 1..203: mol_type = other DNA
ggcgcgccagtcctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtcccgactcggaccgatg

SEQ ID NO: 3010 - DNA, 203 bp, Homo sapiens
  source 1..203: mol_type = other DNA
ggcgcgccagtcctaacagcgcgggccgcgcgggcgtaggcggggtatctggaggaggcgcagggaacctggagagggtccagccctcagtgccccggccagaggcgggaaggggctctagagcttcgggaggcaagatgacttctctgccccaagcttggaacagctaaagggaaaaacagtgcaagcgactcggaccgatg

SEQ ID NO: 3011 - DNA, 203 bp, Homo sapiens
  source 1..203: mol_type = other DNA
ggcgcgccagtcctgagctcatctgagagttgtaagactctaaggcagcccctgcatctcagtcctgacatcgctgtccctggagcatcctccgctggagctggagcttgacagagtctccatctgtcgctcaggttggagtgcagtggcgtgatcttggctcactgcaagctccgcatcccgtgttccgactcggaccgatg

SEQ ID NO: 3012 - DNA, 203 bp, Homo sapiens
  source 1..203: mol_type = other DNA
ggcgcgccagtcctctcagtgccttcaagacatgtcgttttgtagtcagagaaaacagagatcaatgcattttcaaactgacagagggaacggatgctctttagtagcacatgcccaggatcgtgtgtgtggggcttgcgctgtgctgagaagctgaataccggtccatatgctccttatttactgcacgactcggaccgatg

SEQ ID NO: 3013 - DNA, 203 bp, Homo sapiens
  source 1..203: mol_type = other DNA
ggcgcgccagtcctaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtacgactcggaccgatg

SEQ ID NO: 3014 - DNA, 203 bp, Homo sapiens
  source 1..203: mol_type = other DNA
ggcgcgccagtcctcgctcactctcattggtcagttgctcgctgtggtcccatcccacatgcttccattgcttgattcctcgaaaagggcggggactctgggcagcggttgtggagtgccgcgggtccacagtgctgcactgagcagagaggaaggggcgtcccgggatatttggaggataaagggtgcgactcggaccgatg

SEQ ID NO: 3015 - DNA, 203 bp, Homo sapiens
  source 1..203: mol_type = other DNA
ggcgcgccagtcctcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacgtgagctgggcgactcggaccgatg

SEQ ID NO: 3016 - DNA, 203 bp, Homo sapiens
  source 1..203: mol_type = other DNA
ggcgcgccagtcctctctcttgggggtttgtgtttttacatcgtctttctgcacggttctccagcttcttgtccgcacgggctctgcaggtgttgcttgcctggaactcctgtaaggccagtacagtggtagcagttggactgaccattgctgctgcaggatttgcaggccgttacgttttgcaagcccgactcggaccgatg

SEQ ID NO: 3017 - DNA, 203 bp, Homo sapiens
  source 1..203: mol_type = other DNA
ggcgcgccagtcctccgagcgggccatggccaccgccattcagaacccgctcaagtcgcgaggacttctaccgcgaggccatcgagcactgccgcagttacaacgcgcgcctgtgcgccgagcgcagcctgcgactgcccttcctcgactcgcagaccggcgtggcccagaacaactgctacatctggcgactcggaccgatg

SEQ ID NO: 3018 - DNA, 203 bp, Homo sapiens
  source 1..203: mol_type = other DNA
ggcgcgccagtcctggcggcgcagcatgaagcggcgcaggcccgctccatagcgcacgtcgggagggtccgggcggggccggggggaaggctttgatggtgaggaaaggaaagattcctgtgagaagagcaggatgagcagagggattctatgcttgaagtcgagtcacttgaaaaagatctctttgacgactcggaccgatg

SEQ ID NO: 3019 - DNA, 203 bp, Homo sapiens
  source 1..203: mol_type = other DNA
ggcgcgccagtcctctcgacccgccgcagccccggccccgaccgtggacactgggggtccccgagggcgctgcgacctcctcccgggtgaaatgaaacccgagggcagtcccccttaccgaccccattagagacgtatctgccgtgccaggggtctaggctccagaaacagggagtttaccacctaggcgactcggaccgatg

SEQ ID NO: 3020 - DNA, 203 bp, Homo sapiens
  source 1..203: mol_type = other DNA
ggcgcgccagtcctttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagacgactcggaccgatg

SEQ ID NO: 3021 - DNA, 203 bp, Homo sapiens
  source 1..203: mol_type = other DNA
ggcgcgccagtcctggcgcttcgtgtgaggttccacgggggaaggcgagaggcgcaggctgccacacacgcactgtttggaagaggggaagggctgcacttcctgctttcatccagaccaagttcggatcaagtgggagttcttcaaagagagagtttgcattgccccccctgcaccacctcaccaagcgactcggaccgatg

SEQ ID NO: 3022 - DNA, 203 bp, Homo sapiens
  source 1..203: mol_type = other DNA
ggcgcgccagtcctggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagccgactcggaccgatg

SEQ ID NO: 3023 - DNA, 203 bp, Homo sapiens
  source 1..203: mol_type = other DNA
ggcgcgccagtcctggtaagcttaccgtgaaaggagggtttgggctgttgttgctacacgtggatgtgaaatgagtcaagcggaactttgattacaaggaatttcatatactccttcccaccatggattgccaagaaaatgagtactgggaccaatggggacggtgtgtcacctgccaacggtgtggtcgactcggaccgatg

SEQ ID NO: 3024 - DNA, 203 bp, Homo sapiens
  source 1..203: mol_type = other DNA
ggcgcgccagtcctgtcctctggtgttgagtggtcggcttggtgtggtgtgcggaggagctccaggcccgtcggcgcggagggtcttgctgtgttgcccagcctggtcttgaattcctggactcaagtgatgctcctgccttggcttcccaaactcctggaattacaacttggtctcacgtgtgaaaccgactcggaccgatg

SEQ ID NO: 3025 - DNA, 203 bp, Homo sapiens
  source 1..203: mol_type = other DNA
ggcgcgccagtcctcttgagcctggcttaggccaccacctactccagctctctccaccccctattttactgcagctcagggggtaggctctaggctccaaagtacctgggtattgtcccttcatcaagaaagccccacagctctggagggctctgataatcccgttgtcagctctctgaaaagacagccgactcggaccgatg

SEQ ID NO: 3026 - DNA, 203 bp, Homo sapiens
  source 1..203: mol_type = other DNA
ggcgcgccagtcctggggggcttgtgggtcctcctccccctcccactgacaactgccccaactgctcttcccgccccggtcacagtgaaaatgtagacggggtcgttgtccactatgttaggtcttaatggtgggaggacgcccgagtgctcggcccgtttcaccccgaggaggaaggacactgggtccgactcggaccgatg

SEQ ID NO: 3027 - DNA, 203 bp, Homo sapiens
  source 1..203: mol_type = other DNA
ggcgcgccagtcctagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttcgactcggaccgatg

SEQ ID NO: 3028 - DNA, 203 bp, Homo sapiens
  source 1..203: mol_type = other DNA
ggcgcgccagtcctctcgctcgctccctccctccgctggtgcgtttagtcagtcagccagcagcagccggcgggcccgcgagccgcagagggcccgagcctcggacgccggcgcctcctcctgccattgttcgtcgggctgcagcagtggcgggcgcaggagcccggccccggagccaccgcaacatccgactcggaccgatg

SEQ ID NO: 3029 - DNA, 203 bp, Homo sapiens
  source 1..203: mol_type = other DNA
ggcgcgccagtcctagggaataaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgcccgactcggaccgatg

SEQ ID NO: 3030 - DNA, 203 bp, Homo sapiens
  source 1..203: mol_type = other DNA
ggcgcgccagtcctttctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctggggcttctctgcagacgactcggaccgatg

SEQ ID NO: 3031 - DNA, 203 bp, Homo sapiens
  source 1..203: mol_type = other DNA
ggcgcgccagtcctcggcttcggcttctttaaaatccccgacgactcacctgattaacctgctgcagttctgaccctgccaagagctgacaatttactggttcatcaatgaaacaatattaaattatgaagatgtaaggaaaaaatcctacgctaacactgtcgcagtttgaaaggcttctctgcagacgactcggaccgatg

SEQ ID NO: 3032 - DNA, 203 bp, Homo sapiens
  source 1..203: mol_type = other DNA
ggcgcgccagtcctccccagcagccacagccaggggagcgctcaagacagaaagccggtggcttcctcacctccacctgtaatgcaggcatccagcccgcactgtggagcagggaggacgtgctgcactggctgcgctgggcagagcaggagtactctctgccatgcaccgcggagcacgggttcgagcgactcggaccgatg

SEQ ID NO: 3033 - DNA, 203 bp, Homo sapiens
  source 1..203: mol_type = other DNA
ggcgcgccagtcctggcttcctcacctccacctgtaatgcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagcgactcggaccgatg

SEQ ID NO: 3034 - DNA, 203 bp, Homo sapiens
  source 1..203: mol_type = other DNA
ggcgcgccagtcctgatctcggggctcagggcggaaacgcagcggatatgtattttcttccggggttggtggcgctcggctctcatgacctgcaggtgacagtgttggccggtggcgcggccctgcttgcctcgtgccccgcccttcgtgcttgaaaaaaaatcccgcgaagccttctccgaaagaaccgactcggaccgatg

SEQ ID NO: 3035 - DNA, 203 bp, Homo sapiens
  source 1..203: mol_type = other DNA
ggcgcgccagtcctggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggccgcccgactcggaccgatg

SEQ ID NO: 3036 - DNA, 203 bp, Homo sapiens
  source 1..203: mol_type = other DNA
ggcgcgccagtcctagcaagcatgttctgcctggatgacctagggccccacattgaactggggcctgggggatgcataagtttgtcacgtaaggggcatgtgcaagaatggaagatgtgcaaaaaagggaggaggaggcatttcacggagaaggaaacggagtggaagcagcctgaggccctcatccacgactcggaccgatg

SEQ ID NO: 3037 - DNA, 203 bp, Homo sapiens
  source 1..203: mol_type = other DNA
ggcgcgccagtcctcctgtacgtagtcacggtcttgtgctctaaggtgagtggaggacgagcttgggcttagcggcagcccgtatcacatcctagactttttacttcgaggagaagagtctcacgagttgtcctggaagaaaacgacagcacgtgttctttttcactagtagaagtgacgttggtttccgactcggaccgatg

SEQ ID NO: 3038 - DNA, 203 bp, Homo sapiens
  source 1..203: mol_type = other DNA
ggcgcgccagtcctttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgaccgactcggaccgatg

SEQ ID NO: 3039 - DNA, 203 bp, Homo sapiens
  source 1..203: mol_type = other DNA
ggcgcgccagtcctgtggcagagctacgccttgcaccccgaccttccgttgctagctccagctgctttccaaaataccaccttgacttctcagtctccaggtttaaaggagagcaactagaagtcgtccaaacacctgcatctcataaggagaagaaaagtccacctggatcttgtttctggactgagcgactcggaccgatg

SEQ ID NO: 3040 - DNA, 203 bp, Homo sapiens
  source 1..203: mol_type = other DNA
ggcgcgccagtcctactgaggcacggagctggacagtgactcagacaccaggagctgcctggagtggagctgagagctcaggtctgggctcagccagtccagagtgcaaatctactgtcccttcctagctgtgtgatcttgacaggcactggacggggcctgcaggggtctccacagagaccatcaggcgactcggaccgatg

SEQ ID NO: 3041 - DNA, 203 bp, Homo sapiens
  source 1..203: mol_type = other DNA
ggcgcgccagtcctttagcggggagcagctagagggacaggagggagggaaggaaggaaggaggaaacctggaagatgaggtcagccacgagagataaggggtaagaatatccggcagacttagcgttccggaggtggccctggagaggacatcgtgacccagagtgaaggatctgtcgcaggaaagacgactcggaccgatg

SEQ ID NO: 3042 - DNA, 203 bp, Homo sapiens
  source 1..203: mol_type = other DNA
ggcgcgccagtccttttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaaggcgactcggaccgatg

SEQ ID NO: 3043 - DNA, 203 bp, Homo sapiens
  source 1..203: mol_type = other DNA
ggcgcgccagtcctcgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcacccgactcggaccgatg

SEQ ID NO: 3044 - DNA, 203 bp, Homo sapiens
  source 1..203: mol_type = other DNA
ggcgcgccagtcctctcggctgcagacttggccaaatggacgggactattaaggaattctttctctgggtcatccactgctgagccccctccccaggaagtggaattgaggctctgtcggtggtgagcgacgaccagtccctctttgactcagcgtacggagcggcagcccatctccccaaggccgaccgactcggaccgatg

SEQ ID NO: 3045 - DNA, 203 bp, Homo sapiens
  source 1..203: mol_type = other DNA
ggcgcgccagtcctagacatgagtctagcacctgggactcatgaagttctgaaaagaggggtgtcctgaaggtccaaggcgcctttgttgggggtcccggaatccgcggtgtgccaggtcggaaaaggcgtccgctttcctggagaggaggctaaggtgccgggcgcttcgattctctttgtggccagcgactcggaccgatg

SEQ ID NO: 3046 - DNA, 203 bp, Homo sapiens
  source 1..203: mol_type = other DNA
ggcgcgccagtcctgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaacgactcggaccgatg

SEQ ID NO: 3047 - DNA, 203 bp, Homo sapiens
  source 1..203: mol_type = other DNA
ggcgcgccagtcctctgcgcgcccccgggcacgaccccggagtctccgcgggcggccagggcgcgcgtgcgcggaggttctcctcgtccgcccgttgttcagcgagggaggctctgcgcgtgccgcagctgacggggaaactgaggcacggagcgggcctgtaggagctgtccaggccatctccaacccgactcggaccgatg

SEQ ID NO: 3048 - DNA, 203 bp, Homo sapiens
  source 1..203: mol_type = other DNA
ggcgcgccagtcctcgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgcccgactcggaccgatg

SEQ ID NO: 3049 - DNA, 203 bp, Homo sapiens
  source 1..203: mol_type = other DNA
ggcgcgccagtcctggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgaccgactcggaccgatg

SEQ ID NO: 3050 - DNA, 203 bp, Homo sapiens
  source 1..203: mol_type = other DNA
ggcgcgccagtcctttggggctgctgtttctcttcgccgacggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggcgactcggaccgatg

SEQ ID NO: 3051 - DNA, 203 bp, Homo sapiens
  source 1..203: mol_type = other DNA
ggcgcgccagtcctcttctcttacactgcatacctgtgtctgagtactcttttcatcagtcactcagccagggtctgcagcatgaacccagcagctggtgtcccctatgaggaactcagcaacagattgcgacagaacccttgagaacaaaggagagaggaggtgctgcaagactctctggtagaaaacgactcggaccgatg

SEQ ID NO: 3052 - DNA, 203 bp, Homo sapiens
  source 1..203: mol_type = other DNA
ggcgcgccagtcctaggaaaactaggcccctgcgcggccaacgcccaggatccgcaagctgcgcgcccacgagctccaccagcccattggagaaaagttactgttcagtccctgaaggcttgtgccataaaagagtgggagacattcccagggagtttcagcacccatttggactttcacaatcagagcgactcggaccgatg

SEQ ID NO: 3053 - DNA, 203 bp, Homo sapiens
  source 1..203: mol_type = other DNA
ggcgcgccagtcctgcctgcagctcggtgcgctctgggcacccgggcgccttgcccggtgcacggcggctggcgcaccgcggctagattggctacaggagcggggtgcaggactggctagaggtgggtgtgtgcgcgcgttggactggagatccgagcagaagcagaaccaggcggctctgagcagcccgactcggaccgatg

SEQ ID NO: 3054 - DNA, 203 bp, Homo sapiens
  source 1..203: mol_type = other DNA
ggcgcgccagtcctggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcacccgactcggaccgatg

SEQ ID NO: 3055 - DNA, 203 bp, Homo sapiens
  source 1..203: mol_type = other DNA
ggcgcgccagtcctagtaggacaatatgagactctggggcagtgaaagacttaccaggattccttctggaactgactcgtcagctcattcatgtcttacccagtctttaaacagtatttcatgataatggtctgcttttaattgctgggctttaccttaccctttttgtgattgcaggtcctacaggtcgactcggaccgatg

SEQ ID NO: 3056 - DNA, 203 bp, Homo sapiens
  source 1..203: mol_type = other DNA
ggcgcgccagtcctaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgcccgactcggaccgatg

SEQ ID NO: 3057 - DNA, 203 bp, Homo sapiens
  source 1..203: mol_type = other DNA
ggcgcgccagtcctagtcgtctacccgcgcgcccgagcgcggaaaccgaggggcaggctcgcgctctgcctgcttcgtggcgcttggttcgtccctcgcccgaggagcgcggtggcggcgtgggagggagcctctgacggcgtctggaactctattttaagaacctctcaaaacgaaacaagcaaatccgactcggaccgatg

SEQ ID NO: 3058 - DNA, 203 bp, Homo sapiens
  source 1..203: mol_type = other DNA
ggcgcgccagtcctggaggcaggttgatgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgccgactcggaccgatg

SEQ ID NO: 3059 - DNA, 203 bp, Homo sapiens
  source 1..203: mol_type = other DNA
ggcgcgccagtcctggggacacctcccgcgccatctcgggggcactggagataaggaaaggaacctcctccctggctgggatggctgcccgggcgcgggaggagggccggggacccggtgagggaggaccgtagggcccgtgggggcttcacgcctggcaggcggccggccaggcctccctccctgaccgactcggaccgatg

SEQ ID NO: 3060 - DNA, 203 bp, Homo sapiens
  source 1..203: mol_type = other DNA
ggcgcgccagtcctggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtacccgactcggaccgatg

SEQ ID NO: 3061 - DNA, 203 bp, Homo sapiens
  source 1..203: mol_type = other DNA
ggcgcgccagtcctaaaaaaggtctttgccaatcctgattcccggaagagagtcggcagaattccttcctttaggcccctctggagccttggccgaccagccacttctgtggtctggggacagtcaccgagggtatcaaaaagccattcacagaggtcatccgagccaacatcggggacgcccaggctcgactcggaccgatg

SEQ ID NO: 3062 - DNA, 203 bp, Homo sapiens
  source 1..203: mol_type = other DNA
ggcgcgccagtcctagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctcgactcggaccgatg

SEQ ID NO: 3063 - DNA, 203 bp, Homo sapiens
  source 1..203: mol_type = other DNA
ggcgcgccagtcctgccctcccgaattctctgctcctctccccaccccactgttggtctgtgatttcgaggcaggcgtggccccctgcagcctggaatgaagtcactggggctgtttggagaccggggctgtttggaggacaagggcacacaactggttccgttaagcccctctctcgctcagacgcccgactcggaccgatg

SEQ ID NO: 3064 - DNA, 203 bp, Homo sapiens
  source 1..203: mol_type = other DNA
ggcgcgccagtccttcggattccaagggaaacagacaaacctcacgaaaggaaggaagcaagcaagcaaggaaggaactgcaggaggaaaagaacaggcagaacagcgagaagaataaagggaaagggggggaaacaccaaatctatgattggacctgggcttctttttcgccaatgcaaaaaggaatcgactcggaccgatg

SEQ ID NO: 3065 - DNA, 203 bp, Homo sapiens
  source 1..203: mol_type = other DNA
ggcgcgccagtcctgctccctcctttgtgctcccagggcccacaactgcttgaatgactattggtgttcctgtttgtgtgccctctgggccgggaagtcagagaaagaaaggagacaatttgtgattgaacagccactgtggccatcattctccttacctgtctgatgagagctgatcttcatgccaccgactcggaccgatg

SEQ ID NO: 3066 - DNA, 203 bp, Homo sapiens
  source 1..203: mol_type = other DNA
ggcgcgccagtcctccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagccgactcggaccgatg

SEQ ID NO: 3067 - DNA, 203 bp, Homo sapiens
  source 1..203: mol_type = other DNA
ggcgcgccagtcctagtgttgcctgactcagtttccaagcttgactcttccctttggcatagtgagtttggagtcaagagatttttattttcccttcacaagctgaacaggagcctttggagagaacgctctggaccggaagcgcgcccccggggccggtcccggagggctcgatccgcatctacagccgactcggaccgatg

SEQ ID NO: 3068 - DNA, 203 bp, Homo sapiens
  source 1..203: mol_type = other DNA
ggcgcgccagtcctccatctttactttctccacaaaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctcgactcggaccgatg

SEQ ID NO: 3069 - DNA, 203 bp, Homo sapiens
  source 1..203: mol_type = other DNA
ggcgcgccagtcctactttactagtcaagccgcggagtgggcggggccccctgcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcgactcggaccgatg

SEQ ID NO: 3070 - DNA, 203 bp, Homo sapiens
  source 1..203: mol_type = other DNA
ggcgcgccagtcctggccaccgcggtctccgcgcctgtctgcaccctgtcgcctgagctgcctgacagtgacaatgacatcccagttaccagtgtccttgaattgatagtggcttctgtttgtcagtctcatataagaactacagctcatcaggaggagatcgcagcagggtaagagacaccaacacccgactcggaccgatg

SEQ ID NO: 3071 - DNA, 203 bp, Homo sapiens
  source 1..203: mol_type = other DNA
ggcgcgccagtcctgaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttacgactcggaccgatg

SEQ ID NO: 3072 - DNA, 203 bp, Homo sapiens
  source 1..203: mol_type = other DNA
ggcgcgccagtcctcttgggaaagggacgctacaaaataaagctcaccccaacagctgagaagagggtgcagaaatccagggaggtcatagatagcatcataaaagagaaaacagggagcttcaggtcaacttagtacgctcacattcttcaggtgttgggaaaccactaagtcctgagaggtgtcggcgactcggaccgatg

SEQ ID NO: 3073 - DNA, 203 bp, Homo sapiens
  source 1..203: mol_type = other DNA
ggcgcgccagtcctaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggcgactcggaccgatg

SEQ ID NO: 3074 - DNA, 203 bp, Homo sapiens
  source 1..203: mol_type = other DNA
ggcgcgccagtcctgttccgctgattcctttcgtaaccgcaccacacccgagctacaatctctggacaaaattttaagagaaactccctcagaactcctaaaggtaaacaaaagcaggcagattgaggatggcagtcagaatatgaagtgaccatatatggacgtgggttggcaataagagaagaaagcgactcggaccgatg

SEQ ID NO: 3075 - DNA, 203 bp, Homo sapiens
  source 1..203: mol_type = other DNA
ggcgcgccagtcctcttggctcaggcttggaggcctccgagcagcaacatcgtcccaattataccccgttggagcatcttcagatcttccactcttttcacaacgcaatcaaaatcttcgtacccattttgcagtagtgatctctaaactctcagcgtaggcatcgggaaccttcgtgccaaggagcccgactcggaccgatg

SEQ ID NO: 3076 - DNA, 203 bp, Homo sapiens
  source 1..203: mol_type = other DNA
ggcgcgccagtcctgagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagcccgactcggaccgatg

SEQ ID NO: 3077 - DNA, 203 bp, Homo sapiens
  source 1..203: mol_type = other DNA
ggcgcgccagtcctacccaaggccggccctttcctgtggagtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggcgactcggaccgatg

SEQ ID NO: 3078 - DNA, 203 bp, Homo sapiens
  source 1..203: mol_type = other DNA
ggcgcgccagtcctgagggacatcttttcaagtagaggctgtgttggggcatggtgagagagggtcttagcaggtaaccttcctttcctctccagactgaggaatcagagttctgattgtggagtgcctctctctaggacggggctgcagcataggagtctcagctgcttacatccaggtccaggattcgactcggaccgatg

SEQ ID NO: 3079 - DNA, 203 bp, Homo sapiens
  source 1..203: mol_type = other DNA
ggcgcgccagtcctccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtccgactcggaccgatg

SEQ ID NO: 3080 - DNA, 203 bp, Homo sapiens
  source 1..203: mol_type = other DNA
ggcgcgccagtcctccggttgtagatgtatctctccaggaagcgctgtgtcccattaaacgcgtagcattcctgccgtccctggaaaagtgctagaggcccacagtttcagtctcatctgcctccactcggcctcagttcctcatcactgttcctgtgctcacagtcatcaattatagaccccacaaccgactcggaccgatg

SEQ ID NO: 3081 - DNA, 203 bp, Homo sapiens
  source 1..203: mol_type = other DNA
ggcgcgccagtcctgcacccttgtggcccaggcactttatggatgatcccttttagtgctcccagtaaccttccaagattgtcaagtggtcagactgttgtttgccattagcttgcagacctggggatccttatcggctaattgctgaagcaagtgtggacaacttcagcaagctgggggtggcgttccgactcggaccgatg

SEQ ID NO: 3082 - DNA, 203 bp, Homo sapiens
  source 1..203: mol_type = other DNA
ggcgcgccagtcctcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcacgactcggaccgatg

SEQ ID NO: 3083 - DNA, 203 bp, Homo sapiens
  source 1..203: mol_type = other DNA
ggcgcgccagtcctggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactgcgactcggaccgatg

SEQ ID NO: 3084 - DNA, 203 bp, Homo sapiens
  source 1..203: mol_type = other DNA
ggcgcgccagtcctgcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcgggggaccgactcggaccgatg

SEQ ID NO: 3085 - DNA, 203 bp, Homo sapiens
  source 1..203: mol_type = other DNA
ggcgcgccagtcctcctagaacgagctggtgcacgtggcttcccaaagatctctcagataatgagaggaaatgcagtcatcagtttgcagaaggctagggattctgggccatagctcagacctgcgcccaccatctccctccaggcagcccttggctggtccctgcgagcccgtggagactgccagagcgactcggaccgatg

SEQ ID NO: 3086 - DNA, 203 bp, Homo sapiens
  source 1..203: mol_type = other DNA
ggcgcgccagtcctacagtaaacacaaacaaaagggtgatgggattattttactgcatgcactgctgagcccgacattgtcacctcctctttgaggggttagaagaagctgagatctcccgacagagctggaaatggtgatgaatcttttttaatcaaaggacaatttcttttcattgcactttgactcgactcggaccgatg

SEQ ID NO: 3087 - DNA, 203 bp, Homo sapiens
  source 1..203: mol_type = other DNA
ggcgcgccagtcctcaagtggatccgagccgcagagagggctggagagagtctgctctccgatgactttgcccactctcttcgcagtggggacacgggaccgagtgcacactggaggtcccagagcacgacgagcgcggaggaccgggaggctcccgggcttgcgtgggcatcacgtgccctcccccccgactcggaccgatg

SEQ ID NO: 3088 - DNA, 203 bp, Homo sapiens
  source 1..203: mol_type = other DNA
ggcgcgccagtcctcgagggctcctgctggtactgtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctcgactcggaccgatg

SEQ ID NO: 3089 - DNA, 203 bp, Homo sapiens
  source 1..203: mol_type = other DNA
ggcgcgccagtcctgccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggcgactcggaccgatg

SEQ ID NO: 3090 - DNA, 203 bp, Homo sapiens
  source 1..203: mol_type = other DNA
ggcgcgccagtccttggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctcgactcggaccgatg

SEQ ID NO: 3091 - DNA, 203 bp, Homo sapiens
  source 1..203: mol_type = other DNA
ggcgcgccagtcctcccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaacccgactcggaccgatg

SEQ ID NO: 3092 - DNA, 203 bp, Homo sapiens
  source 1..203: mol_type = other DNA
ggcgcgccagtcctctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctgagatgtcactggtatctaggcaacagggcgactcggaccgatg

SEQ ID NO: 3093 - DNA, 203 bp, Homo sapiens
  source 1..203: mol_type = other DNA
ggcgcgccagtccttaattaggaagctgtcagattttattgatcctcaagaaggatggaagaagttagctgtagctattaaaaaaccatctggtgatgatagatacaatcagtttcacataagatgctgttcccaaaactgctaatacactaccttctaaagaagctataacagttcagcaaaaacagcgactcggaccgatg

SEQ ID NO: 3094 - DNA, 203 bp, Homo sapiens
  source 1..203: mol_type = other DNA
ggcgcgccagtcctgcccggcaggttgggggaccggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaacgactcggaccgatg

SEQ ID NO: 3095 - DNA, 203 bp, Homo sapiens
  source 1..203: mol_type = other DNA
ggcgcgccagtcctggcggctctgggccgccgagtcccctcctcccgcccctgaggaggaggagccgccgccacccgccgcgcccgacacccgggaggccccgccagcccgcgggagaggcccagcgggagtcgcggaacagcaggcccgagcccaccgcgccgggccccggacgccgcgcggaaaagcgactcggaccgatg

SEQ ID NO: 3096 - DNA, 203 bp, Homo sapiens
  source 1..203: mol_type = other DNA
ggcgcgccagtccttgctggcgtcctcccttctctttgctgggttgtcagctgttcctcaaagcttctcgccatctctgaggccatggtaagtgtgactgtggcaagtgcaagtgtgaccagggatggtatggggatgcttgccagtacccaactaactgtgacttgacaaagaagaaaagtaaccaacgactcggaccgatg

SEQ ID NO: 3097 - DNA, 203 bp, Homo sapiens
  source 1..203: mol_type = other DNA
ggcgcgccagtcctcagcctgaggcttccttttggttcccgccccgggacgggaggctccgtccgctccctggacagccggggtgctccctccttctccctcccgcgctctcctcccccgtccgtttgcagggaggtgctctcctcgggcggcggggaaggcggggctggcctgccactcctcctgctcgactcggaccgatg

SEQ ID NO: 3098 - DNA, 203 bp, Homo sapiens
  source 1..203: mol_type = other DNA
ggcgcgccagtcctgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgacgactcggaccgatg

SEQ ID NO: 3099 - DNA, 203 bp, Homo sapiens
  source 1..203: mol_type = other DNA
ggcgcgccagtcctcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctcccgactcggaccgatg

SEQ ID NO: 3100 - DNA, 203 bp, Homo sapiens
  source 1..203: mol_type = other DNA
ggcgcgccagtcctgctcccagcgccacggacgcccccgggccgagcggcggtgcgctcccgtgcagacccgtggacagacgcccctggccggtggactctcgagtctcgcttctgcaccctgcgtccctagacatgaatgtgaggagggtggaaagcatttcggctcagctggaggaggccagctctcgactcggaccgatg

SEQ ID NO: 3101 - DNA, 203 bp, Homo sapiens
  source 1..203: mol_type = other DNA
ggcgcgccagtcctgcatttcggctcagctggaggaggccagctctacaggcgaagcggttattgagcattcgctgtgtaccaagtgctgtccttgacaagaagacttacacccagtggtcccagagggagacttcggaagtgggagcacctgtcagatcatcatacagcgtggaagatgaactggagcgactcggaccgatg

SEQ ID NO: 3102 - DNA, 203 bp, Homo sapiens
  source 1..203: mol_type = other DNA
ggcgcgccagtcctccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtcgactcggaccgatg

SEQ ID NO: 3103 - DNA, 203 bp, Homo sapiens
  source 1..203: mol_type = other DNA
ggcgcgccagtcctgtctggagccggtgctctgcggcggggcgggagggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctcgactcggaccgatg

SEQ ID NO: 3104 - DNA, 203 bp, Homo sapiens
  source 1..203: mol_type = other DNA
ggcgcgccagtcctacccttcaaggacctgctacaccctgaccaccccctgccgcccccacaggcagagctgacctgtccggtaatcaaggcaatgcagccggccgcctagctacagttcacgagccagttgtcacccagtgggcggtgcatcctccagcccccgctcaccccagtctcctggacaaacgactcggaccgatg

SEQ ID NO: 3105 - DNA, 203 bp, Homo sapiens
  source 1..203: mol_type = other DNA
ggcgcgccagtcctgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacgcagatcctggcccgactcggaccgatg

SEQ ID NO: 3106 - DNA, 203 bp, Homo sapiens
  source 1..203: mol_type = other DNA
ggcgcgccagtcctccacctggccgtggacacctgtgtcagcatgtgggacctggttctctccatcgccttgtctgtggggtgcactggaatagccaggtctggctgggtcggcacaacctgtttgagcctgaagacacaggccagagggtccctgtcagccacagcttcccacacccgctctacaatcgactcggaccgatg

SEQ ID NO: 3107 - DNA, 203 bp, Homo sapiens
  source 1..203: mol_type = other DNA
ggcgcgccagtcctgtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatccgactcggaccgatg

SEQ ID NO: 3108 - DNA, 203 bp, Homo sapiens
  source 1..203: mol_type = other DNA
ggcgcgccagtcctcggaacttggatcacatcagatcctctcgagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagcgactcggaccgatg

SEQ ID NO: 3109 - DNA, 203 bp, Homo sapiens
  source 1..203: mol_type = other DNA
ggcgcgccagtccttcctttcccggccgcacagggtagattttcgttccgtcacccaggctggagtgcagtggtgtgaccttggcttgctgcaaccctttgcctcctgggttcaagtgattctcattgcctcagcctcctaagtagctgggattacaggttttataggatcacattgacaaaagtacccgactcggaccgatg

SEQ ID NO: 3110 - DNA, 203 bp, Homo sapiens
  source 1..203: mol_type = other DNA
ggcgcgccagtcctaactgggcggtaaaatagcccttctgttactgtccggggctgcggggtgagaggccagggccgagaagggcttcaggacgcgggaggcgcacttgcttcaagtcgcgggcgtgggaacggggttgcaaaacggggcctctttgtccgggcttgcttccggcgtcatggctcaaacgactcggaccgatg

SEQ ID NO: 3111 - DNA, 203 bp, Homo sapiens
  source 1..203: mol_type = other DNA
ggcgcgccagtcctagactaagctgcaacactggcagagcctcccaaggaagggaggagggaggacagaggccaaggcggctcctggccaccctcgcagcttcctccctccctggccacaaggacccaaagctcagagggatggatgaacagacaggaaggctcaggctggacacgtattgtatgagtcgactcggaccgatg

SEQ ID NO: 3112 - DNA, 203 bp, Homo sapiens
  source 1..203: mol_type = other DNA
ggcgcgccagtcctggccagaaaagccaaacttaagaaatctgcctatgtacagaacaagtcaactaaggggttctcattaatctaccgtctgtgaatatcgttatttttcaggagaagcgctacaaagcagccactgtgcttactgaacggcctccccctgtatcgcttaattgagaaggtatacaacgactcggaccgatg

SEQ ID NO: 3113 - DNA, 203 bp, Homo sapiens
  source 1..203: mol_type = other DNA
ggcgcgccagtccttgggagcgatctggaaagctgcacttgtgctcccttcctcgtaggtttgctgtggaacgttgtggcttctgtggctcctcaggcccgggggcgccccttgaaccctccactcttggctccaagcaccttccctgggaagctgtatctgctgggttcgcagacaggaacagaaaccgactcggaccgatg

SEQ ID NO: 3114 - DNA, 203 bp, Homo sapiens
  source 1..203: mol_type = other DNA
ggcgcgccagtcctcggggccagccatgcctgtcctaacagcagccacccagcagtggcccagcctgctgagaactagaaaatcagaagaaaaaggagaatccaccaggagacccaggtaactctgaagcgtgagctgccagaattcaaggccacctgcttaacagaagacaactagaaacctcatcccgactcggaccgatg

SEQ ID NO: 3115 - DNA, 203 bp, Homo sapiens
  source 1..203: mol_type = other DNA
ggcgcgccagtcctaagcagtccttccacctcggcctcccaaagagctgggattacaggtgaaaattctggatctgttatctgtgaggaggccactccgttgacagttgtgtaaaactctgctgctttccccagctccaacctctctggtcttcaacaacactatcatcagggaaaacgtgggggaagcgactcggaccgatg

SEQ ID NO: 3116 - DNA, 203 bp, Homo sapiens
  source 1..203: mol_type = other DNA
ggcgcgccagtcctaagcagctgaaagaagtctttaaggagcgaagcaccattcttcgtcagctgacaaagacatcaagagaacttgatggaattaaagtcaatcttcagtccttaaaaaacgatgagcagtctgccaaaactgatgttcagaaacttctggaattaggacagaaacaaagagaagaacgactcggaccgatg

SEQ ID NO: 3117 - DNA, 203 bp, Homo sapiens
  source 1..203: mol_type = other DNA
ggcgcgccagtcctttgcgcatcccagtgattcttgggttccgcgtgtagtttcggaaggagacatcgaagcagggcgaggcgcagagggcgttgcggactcatgccccagtcggcagtgcggggtcccaagccctgcagtgctacagctttgagcacacctactttggcccctttgacctcagggcccgactcggaccgatg

SEQ ID NO: 3118 - DNA, 203 bp, Homo sapiens
  source 1..203: mol_type = other DNA
ggcgcgccagtcctgagcagaaagggcccagacagtgccaggagtcaaggttctcaggggacagggagagcaagaggtcaagagctgtgggacaccacagagcagcactgaaggagaagacctgcctgtgggtccccatcgcccaagtcctgcccacactcccacctgctaccctgatcagagtcatccgactcggaccgatg

SEQ ID NO: 3119 - DNA, 203 bp, Homo sapiens
  source 1..203: mol_type = other DNA
ggcgcgccagtcctggagttgaggaccttttcttcagagggtgactcaggtcaacacaggggcccccatgtagtcgacagacacagtggtcctaagatctaccaagcatccaggttctgaggagacaggccccggagcagcactagctcctgcccacactcctacctgctgccctgaccagagtcatccgactcggaccgatg

SEQ ID NO: 3120 - DNA, 203 bp, Homo sapiens
  source 1..203: mol_type = other DNA
ggcgcgccagtcctaagtctgaggttgcaaaaggactgtgatcatatgaagatcatccaggagtacaactcgaaattctcagaaaacaggaccttgatgtgagaggagcaggttcaggtaaacaaagggtgccacatctcctgcctttctgctcactttcctgcctgttttgcctgaccacagccatccgactcggaccgatg

SEQ ID NO: 3121 - DNA, 203 bp, Homo sapiens
  source 1..203: mol_type = other DNA
ggcgcgccagtcctttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacacgactcggaccgatg

SEQ ID NO: 3122 - DNA, 203 bp, Homo sapiens
  source 1..203: mol_type = other DNA
ggcgcgccagtccttagagatggggtcttgctgtgttgcccagactggtctcaaactcctggcctcaagtgatccttctgcctcagcttcccaaagtactgggattacagcttgaaatccatggcccaaaatgactctaccagtggagactctcttctgtgaagaagacgaccagataagaggttgggcgactcggaccgatg

SEQ ID NO: 3123 - DNA, 203 bp, Homo sapiens
  source 1..203: mol_type = other DNA
ggcgcgccagtccttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttccgactcggaccgatg

SEQ ID NO: 3124 - DNA, 203 bp, Homo sapiens
  source 1..203: mol_type = other DNA
ggcgcgccagtccttgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctcgactcggaccgatg

SEQ ID NO: 3125 - DNA, 203 bp, Homo sapiens
  source 1..203: mol_type = other DNA
ggcgcgccagtcctcctggaggtccacgtcccgcaggtgcgtgcagcagcacccgccaggaggcgcctgagattggagctggagtgagccttccaggaattttggctgccaaatgtggtgcagaagtaatactgtcagacagctcagaactgcctcactgtctggaagtctgtcggcaaagctgccaacgactcggaccgatg

SEQ ID NO: 3126 - DNA, 203 bp, Homo sapiens
  source 1..203: mol_type = other DNA
ggcgcgccagtcctggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagcgactcggaccgatg

SEQ ID NO: 3127 - DNA, 203 bp, Homo sapiens
  source 1..203: mol_type = other DNA
ggcgcgccagtcctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggtgagcagggcagcatttccttctcccactgctgctgagcgactcggaccgatg

SEQ ID NO: 3128 - DNA, 203 bp, Homo sapiens
  source 1..203: mol_type = other DNA
ggcgcgccagtcctcgtcctggcggtggggactccccgcggagcgcttgcgcgtgccaggccacccgggactacgtttcccagcgggccgagcggccggcgccgcggctgcggtcaggattgtcagtggcttcgccccgaggagagctgactgccctgggctgctgcctccggcagagctgagccaaacgactcggaccgatg

SEQ ID NO: 3129 - DNA, 203 bp, Homo sapiens
  source 1..203: mol_type = other DNA
ggcgcgccagtccttggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggcgactcggaccgatg

SEQ ID NO: 3130 - DNA, 203 bp, Homo sapiens
  source 1..203: mol_type = other DNA
ggcgcgccagtcctgtgttgagagaaggtgcacgtaagcgtgtggcagaacgtctgcaatcgcatctttgtaataatctcctttctgagacggttcagtggactcaatgttccgccaaagggccaaggcagccctgcagttccgccgagcatcctggggcctccaagcctccgataagctcctccagtcgactcggaccgatg

SEQ ID NO: 3131 - DNA, 203 bp, Homo sapiens
  source 1..203: mol_type = other DNA
ggcgcgccagtcctagcagttttgaggatgaccccttcttctcgtgagttacgggagccaggagtccggggtcgcgcgggaattaagacatacaggtggtcttactctgcagcagctgaaactgaagcacaagaagcccttggaactatcatcaggacattgagtccattcttgcacaccgagaaaatcgactcggaccgatg

SEQ ID NO: 3132 - DNA, 203 bp, Homo sapiens
  source 1..203: mol_type = other DNA
ggcgcgccagtcctgacgtcctagccaatgacagaggccgtacggcggaagtatagaaaaggactctctggaacatggcaacattaatctgaccacaagctgactggcaggtgctttaaccacaagctctgactccaggccctgtcccctgagctctgccctcggatgtccgaccgcccagagcctgccgactcggaccgatg

SEQ ID NO: 3133 - DNA, 203 bp, Homo sapiens
  source 1..203: mol_type = other DNA
ggcgcgccagtcctggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgccgactcggaccgatg

SEQ ID NO: 3134 - DNA, 203 bp, Homo sapiens
  source 1..203: mol_type = other DNA
ggcgcgccagtcctgcctttcctcatctccgctggcggggatccccgttcgcctcaggaggcttccgaccccacagcatcccgccgctctgggcgcccgtcctctgtgaggtctctccggtgacaccagcccctcttcccgccctcactttgtgtgtttacgccgagcagctgccaagtcgtctctcccgactcggaccgatg

SEQ ID NO: 3135 - DNA, 203 bp, Homo sapiens
  source 1..203: mol_type = other DNA
ggcgcgccagtcctaggagaataactcagttttagacagggtctcgcactgtcacccaggctggagtgcagtggtgcaaccccacctcccgggttcaagcaattctcatgcctcagcctcccaagtagctgggattacagggtcctcctgccgcaggagtatcttgcagtccaactcccacgattgtccgactcggaccgatg

SEQ ID NO: 3136 - DNA, 203 bp, Homo sapiens
  source 1..203: mol_type = other DNA
ggcgcgccagtcctctacacatctcattatagtttagggagtctcgctctatcccctaggctggagtgcattggcgccatctcggctcatttgcaacctctgtctcccgggttcaagcgattctcctgcctcagcttcccgaggagctgggattacaggtcctgagggagtctaacaagttagcagaacgactcggaccgatg

SEQ ID NO: 3137 - DNA, 203 bp, Homo sapiens
  source 1..203: mol_type = other DNA
ggcgcgccagtcctggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcaggcgactcggaccgatg

SEQ ID NO: 3138 - DNA, 203 bp, Homo sapiens
  source 1..203: mol_type = other DNA
ggcgcgccagtcctggagctggtggcggcgctccgcaggggctcggctgttttccgcgcggcaggcgcggccatggcgcagctgggaaagctgctcaaggagcagaagtacgaccggcagctgaggcgattcctccatacatttgacagctgtctgggcccttatggagcatacagtggagtggaaagcgactcggaccgatg

SEQ ID NO: 3139 - DNA, 203 bp, Homo sapiens
  source 1..203: mol_type = other DNA
ggcgcgccagtcctgagtctagggtacaggtccgaaagtagaagaacacagaaggcaggccaggggcactgtgagatggtaaaagagatctgaagggatccagaattcaagccaggaagaagcagcaatctgtcttctggattaaaactgaagatcaacctactttcaacttactaagaaaggggatccgactcggaccgatg

SEQ ID NO: 3140 - DNA, 203 bp, Homo sapiens
  source 1..203: mol_type = other DNA
ggcgcgccagtccttggcctgggaagtgggaagccagattggaccctactgactggggaccctcagccttggggctcctctggagaagtgatcagttgccctgctggaaactcacatccagggggcagtggctggagagcaagagcgaacggtcaggaagaggaggcctcctgctccacgacgtgacccgactcggaccgatg

SEQ ID NO: 3141 - DNA, 203 bp, Homo sapiens
  source 1..203: mol_type = other DNA
ggcgcgccagtcctccgacgctgagcgccggcctcgccctcggcggcccctccctcctccttaccccgcctcccccggcccgcccctccctccccggaggagcagtctctccgcgcgtctcccggagctttctccattgtctctgcctttacaacagagggagacgatggactgagctgatccgcacccgactcggaccgatg

SEQ ID NO: 3142 - DNA, 203 bp, Homo sapiens
  source 1..203: mol_type = other DNA
ggcgcgccagtccttgctgcctgcggctctcagaagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagccgactcggaccgatg

SEQ ID NO: 3143 - DNA, 203 bp, Homo sapiens
  source 1..203: mol_type = other DNA
ggcgcgccagtcctatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctcccgactcggaccgatg

SEQ ID NO: 3144 - DNA, 203 bp, Homo sapiens
  source 1..203: mol_type = other DNA
ggcgcgccagtcctccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaacctcgccaatacgactcggaccgatg

SEQ ID NO: 3145 - DNA, 203 bp, Homo sapiens
  source 1..203: mol_type = other DNA
ggcgcgccagtccttggttttggctatatcttcatgtaggacctactccctatcccgtcggccgcggtgaatcccacctgcggctgggcttcatcaccaggcctcctcacagattcctgtcccttctgtgtcctggactccggatacctcaactctcagtactttgtgctcagcccaggcccagagcccgactcggaccgatg

SEQ ID NO: 3146 - DNA, 203 bp, Homo sapiens
  source 1..203: mol_type = other DNA
ggcgcgccagtcctggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtccgactcggaccgatg

SEQ ID NO: 3147 - DNA, 203 bp, Homo sapiens
  source 1..203: mol_type = other DNA
ggcgcgccagtcctaggacaaaagccagacacatttcaacatgagggacccactgacagattgtccgggcaaacctggaaattagctatgccaaaggacttcagaaactggcaagcaagctgagcaaagcattacagaacacgagaaaaagttgtgttagcagtgcctgggcctgggcctcagagggacgactcggaccgatg

SEQ ID NO: 3148 - DNA, 203 bp, Homo sapiens
  source 1..203: mol_type = other DNA
ggcgcgccagtcctagagggaaagggagagagagagactcttagagaaagagagagacacacacactcttggagagagagcgcgaggtgtagagaggagagagagtgaacagggagcggggcttttgtctgttggtctccctggactgaagagagggagaatagaagcccaagactaagattctcaaacgactcggaccgatg

SEQ ID NO: 3149 - DNA, 203 bp, Homo sapiens
  source 1..203: mol_type = other DNA
ggcgcgccagtcctgatccactcacttcccatcaggcctcacttccaacattgggaatcacatttcagcatgagatttggaggggagaaacatccacaccataccacaaataaaaagtcccagagttgtctactttcagactttttaaaaaagtagattggggtcaactggactacttagttgtagaccgactcggaccgatg

SEQ ID NO: 3150 - DNA, 203 bp, Homo sapiens
  source 1..203: mol_type = other DNA
ggcgcgccagtcctggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatgagctgccccgttcagaccatcgactcggaccgatg

SEQ ID NO: 3151 - DNA, 203 bp, Homo sapiens
  source 1..203: mol_type = other DNA
ggcgcgccagtccttaaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaacccgactcggaccgatg

SEQ ID NO: 3152 - DNA, 203 bp, Homo sapiens
  source 1..203: mol_type = other DNA
ggcgcgccagtcctgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagcccgactcggaccgatg

SEQ ID NO: 3153 - DNA, 203 bp, Homo sapiens
  source 1..203: mol_type = other DNA
ggcgcgccagtcctaggtaactgtgatgcgggggtcagcgggagaggcacccggaagctcccggcgtctgcaccccggcagcgcgaggaaatgcccaaagaaactatagtgacactgaaactgaaggagagatttttaattccttagtgcaatactttggtgacaacttggggcgaaaagttaaagcgcgactcggaccgatg

SEQ ID NO: 3154 - DNA, 203 bp, Homo sapiens
  source 1..203: mol_type = other DNA
ggcgcgccagtcctatgggccgcggagcccgagcggcggctgcgcagtcccgctgggggagggcgtcgcgggcatcggtctcacctggacggacgatccgctcagcgcccgcagtcggtggttagcccacggcgatgcctctcccggcctcagcccctgctgaggctacacccatgccttcttcagaacgactcggaccgatg

SEQ ID NO: 3155 - DNA, 203 bp, Homo sapiens
  source 1..203: mol_type = other DNA
ggcgcgccagtcctcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcacgactcggaccgatg

SEQ ID NO: 3156 - DNA, 203 bp, Homo sapiens
  source 1..203: mol_type = other DNA
ggcgcgccagtcctgcttaggagcacccaccaagctctggcagggtctccagcacccatctcgggcagaggctgggggagtgactgctggtgcaagccccaaagtgcatgcggcaaaaacatggatgcagagctggtggcaagaagaggggctaagttatagagtcaacgtggaggtaccaggccacccgactcggaccgatg

SEQ ID NO: 3157 - DNA, 203 bp, Homo sapiens
  source 1..203: mol_type = other DNA
ggcgcgccagtcctctcagcctctacagtctggtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagcccgactcggaccgatg

SEQ ID NO: 3158 - DNA, 203 bp, Homo sapiens
  source 1..203: mol_type = other DNA
ggcgcgccagtcctgctgaatagaacgggcgtggaggcaggaggaggagcaggacgccgggcactgctgatgctgctttcgctggggtgagtgacctgcaggaagaaggcaagaatgccatcaactcaccgatgtcccccgccctggtggatgttcaccctgaagacacccagcttgaggagaacgagcgactcggaccgatg

SEQ ID NO: 3159 - DNA, 203 bp, Homo sapiens
  source 1..203: mol_type = other DNA
ggcgcgccagtcctaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagccgactcggaccgatg

SEQ ID NO: 3160 - DNA, 203 bp, Homo sapiens
  source 1..203: mol_type = other DNA
ggcgcgccagtcctagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtcgactcggaccgatg

SEQ ID NO: 3161 - DNA, 203 bp, Homo sapiens
  source 1..203: mol_type = other DNA
ggcgcgccagtcctacactggccctcggccgggagctccgagtctcaggcggtcccggttgtcttcctgtcggtgccgcttccgcctgcccttcttgaaaacccacccccagctttgacctggaaaatgggctctcgtgtgggaggagggccctggaccctcagtccagccctggcctgggccggattcgactcggaccgatg

SEQ ID NO: 3162 - DNA, 203 bp, Homo sapiens
  source 1..203: mol_type = other DNA
ggcgcgccagtcctcccgttgcactgccgggctgggcaatatgaaggagcagccctcatgtgccggcaccgggcatccgagcatggcgggaggaggcctaccagaaactggccagcgagaccctggaggagctggactggtgtctggaccagctagagaccctacagaccaggcactccgtcagtgagcgactcggaccgatg

SEQ ID NO: 3163 - DNA, 203 bp, Homo sapiens
  source 1..203: mol_type = other DNA
ggcgcgccagtcctagtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaatcgactcggaccgatg

SEQ ID NO: 3164 - DNA, 203 bp, Homo sapiens
  source 1..203: mol_type = other DNA
ggcgcgccagtcctcggctcctccagctaccggcccaaggccatctacctggacatcgatggacgcattcagaagcactccgtacaaagtgagacctgtggccatcaagcaactctccgagcattcaaaatcaatgaactgaaagctgaagttgcaaatcacttggctgtcctagagaaacgcgtggacgactcggaccgatg

SEQ ID NO: 3165 - DNA, 203 bp, Homo sapiens
  source 1..203: mol_type = other DNA
ggcgcgccagtcctgcccagagagccccagggctgctaccaggaaggccagcgcatccctccagagcattcaaaatcaatgaactgaaagctgaagttgcaaatcacttggctgtcctagagaaacgcgtggaattggaaggactaaaagtggtggagattgagaaatgcaagagtgacattaagaagcgactcggaccgatg

SEQ ID NO: 3166 - DNA, 203 bp, Homo sapiens
  source 1..203: mol_type = other DNA
ggcgcgccagtccttggagaggacatggcactgcttcagagacacgaaccaccttgagtggatgtgattggcgatccccgtagagcaggaaagctcgtctgctgtgcagccggcgcagaggattctgtggcaggaaattagacactaggaaattcagtagcgatttgaaggaaacctcgaccttgaagcgactcggaccgatg

SEQ ID NO: 3167 - DNA, 203 bp, Homo sapiens
  source 1..203: mol_type = other DNA
ggcgcgccagtcctttccggcctggcagcctctccccagctgggcaggggccccaggcaccgtgatgtggagtcaagccgcctatacctcccttggctgccccagggctgctaggatccagcaatgcctgtgagaaaacctccttcaccttcctcaggcaggagctgcctgtgcgcctggccaacatccgactcggaccgatg

SEQ ID NO: 3168 - DNA, 203 bp, Homo sapiens
  source 1..203: mol_type = other DNA
ggcgcgccagtcctgtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggaatcccagtcagaagttccagcctgccactgttctctgatgcccgactcggaccgatg

SEQ ID NO: 3169 - DNA, 203 bp, Homo sapiens
  source 1..203: mol_type = other DNA
ggcgcgccagtcctcaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaaccgactcggaccgatg

SEQ ID NO: 3170 - DNA, 203 bp, Homo sapiens
  source 1..203: mol_type = other DNA
ggcgcgccagtcctggctcaggtgtgggaccccatccttcctgtcttcgcagaggagtcctcgcgtgaaataagcgggttttgaaaacaaaaaaaagaaggagtggaagagggggccaggatccaggcctccatccccacagaagtgaagctacagctgggaggtctcctcccaccccaaccgtcacccgactcggaccgatg

SEQ ID NO: 3171 - DNA, 203 bp, Homo sapiens
  source 1..203: mol_type = other DNA
ggcgcgccagtcctacagagcgctgctcccgagaaccctgcacccctcaatggagtaaattaccataaagcctcttccttacccatgctttggggtgttaacagctgaggctattcgtcggtgacctgtgggactcgagctattcctgcagctcagcagacctcctggccgtggcagacttctgcgttcgactcggaccgatg

SEQ ID NO: 3172 - DNA, 203 bp, Homo sapiens
  source 1..203: mol_type = other DNA
ggcgcgccagtcctttagccaacctgaaccgtgtgatttatttcatctgtgacaccatcctctgggtgaggagcgtaggtctcacctctggcatcaacaaagagaaatggcgaacgagggctgctcaccactactactattctcttctgctgagcctggtcagggatctgtatgaaatctccctgcagcgactcggaccgatg

SEQ ID NO: 3173 - DNA, 203 bp, Homo sapiens
  source 1..203: mol_type = other DNA
ggcgcgccagtccttcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccacgactcggaccgatg

SEQ ID NO: 3174 - DNA, 203 bp, Homo sapiens
  source 1..203: mol_type = other DNA
ggcgcgccagtcctgtggggcaaccctctggaggcagcgcgcccgcgggcagcctcgttgtggctccttgggctctgttggcggcggcgctagcttcggagtctcccgcgcgcacctcagccgcctcctagcggcgcggcgctcgctcctacgcctaaaatgaccaatgtgtgatttcagtggaataacgactcggaccgatg

SEQ ID NO: 3175 - DNA, 203 bp, Homo sapiens
  source 1..203: mol_type = other DNA
ggcgcgccagtccttgtgggaccaacgcttccggtgagcgacagaggcagctccccagggcctggagacccgtggggcggactctgggatctgagcctatcgccctggcctggagcccccctttgtacctattccccattcccctaccgagctgggcagttagccagcccactccaactctcggaacccgactcggaccgatg

SEQ ID NO: 3176 - DNA, 203 bp, Homo sapiens
  source 1..203: mol_type = other DNA
ggcgcgccagtcctgaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggccgactcggaccgatg

SEQ ID NO: 3177 - DNA, 203 bp, Homo sapiens
  source 1..203: mol_type = other DNA
ggcgcgccagtcctcctcattccccatgaatgctgtgggaagtcctgaggggcaggagctgcaaaagctggggagtggagcctgggacaaccccgcctacagtggtcccccttccccacacgggacgctgagagtctgcaccatctccagcacggggcctctccagccccaacccaagaagcctgaagcgactcggaccgatg

SEQ ID NO: 3178 - DNA, 203 bp, Homo sapiens
  source 1..203: mol_type = other DNA
ggcgcgccagtcctactttaaccagtctgcagaactgatccccagcccagctgggcctcatgcctctgacaacccaacagtgtggagcagacccacagagagggagacccagagaggtgtgcagtggcatggaagggccagcggggtatctgcggcgggccagtgtggcccaactgacccaggagctgcgactcggaccgatg

SEQ ID NO: 3179 - DNA, 203 bp, Homo sapiens
  source 1..203: mol_type = other DNA
ggcgcgccagtcctagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtccgactcggaccgatg

SEQ ID NO: 3180 - DNA, 203 bp, Homo sapiens
  source 1..203: mol_type = other DNA
ggcgcgccagtcctcagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagagactaagctgaaactgctgctcagctcccaagcgactcggaccgatg

SEQ ID NO: 3181 - DNA, 203 bp, Homo sapiens
  source 1..203: mol_type = other DNA
ggcgcgccagtcctagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagccccgactcggaccgatg

SEQ ID NO: 3182 - DNA, 203 bp, Homo sapiens
  source 1..203: mol_type = other DNA
ggcgcgccagtcctccgaggccgcctggcccttgtttactaaccctccctcaaacgtttcctgggtggctccccagggacggcagggctgggggcttctctccagggagctgctgctgaggcctgtgtctcccgtggctcctctgacaggtcccgcctgactccgctctggaaagtccttttgaagaacgactcggaccgatg

SEQ ID NO: 3183 - DNA, 203 bp, Homo sapiens
  source 1..203: mol_type = other DNA
ggcgcgccagtcctagacacaaaatcagccagggggagcccacattggagggcagtccacaatggaaggcttcttggaggaggagatgattgagctgcttctactaagatgagtatctcagagtcctcaacgtgggtgtggccgaggtgaagaaatccttcctggggcccttgtccccgtcctgtaagcgactcggaccgatg

SEQ ID NO: 3184 - DNA, 203 bp, Homo sapiens
  source 1..203: mol_type = other DNA
ggcgcgccagtcctggtaccaacccctgccgcaggactttcctgggccggctcgcggagagcgtagcgcggccttggtggcggaatggcgttgagtgacggcccggccccgccatctggttaaagggactcgttcaacacggaagtgtcccggggctgcattgtgctacagctagaatgaagcacatccgactcggaccgatg

SEQ ID NO: 3185 - DNA, 203 bp, Homo sapiens
  source 1..203: mol_type = other DNA
ggcgcgccagtcctcacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtcgactcggaccgatg

SEQ ID NO: 3186 - DNA, 203 bp, Homo sapiens
  source 1..203: mol_type = other DNA
ggcgcgccagtcctctgcgcggaagagtgctggccctggggaagccccttcctcacccaggcttcacacatttgaccctggctctctctcaggaggacccctcgctggaaaggcattttaagggccaccgagatgcagttacctgtgtggacttcagtatcaacacaaagcagctggccagtggctcccgactcggaccgatg

SEQ ID NO: 3187 - DNA, 203 bp, Homo sapiens
  source 1..203: mol_type = other DNA
ggcgcgccagtcctatcccagccgccagaattcgaggtctgcggcggctttcaaaacttgacaactttcctttccaggaggaccccgttctggagcgttatttcaaaggccacaaagctgcgatcacctccttggacctcagccccaacggcaagcaacttgctactgcttcttgggatacctttctccgactcggaccgatg

SEQ ID NO: 3188 - DNA, 203 bp, Homo sapiens
  source 1..203: mol_type = other DNA
ggcgcgccagtcctggacgcgacgggacgcgctgggaccggcgtcgggggtcgcggggaccatgcagcggagcctccctgcccttcgctatcctgacgctggtgaacgccccgtacaagcgaggattttactgcggggatgactccatccggtacccctaccgtccagataccatcacccacgggctccgactcggaccgatg

SEQ ID NO: 3189 - DNA, 203 bp, Homo sapiens
  source 1..203: mol_type = other DNA
ggcgcgccagtcctgttttgggcatgcacgtgatactcacacagtggcttctgctcaccaacagatgaagacagatgcaccaacgaggctgatgggaaccaccctgtagaggtccatctgcgttcagacccagacgatgccagagctatgactgggcctgcaggtgtggcgccgaggggagatcagcccgactcggaccgatg

SEQ ID NO: 3190 - DNA, 203 bp, Homo sapiens
  source 1..203: mol_type = other DNA
ggcgcgccagtcctgcacgttccgggagggcgccggggcacgcgtgtgtctgagctgcctttctcctcccgttgctagggaaatggtccaggagtgctgggtgtgagcctcccttctcctcaagccggagactgcggttgtcattgatcaattgaagaagcaaggacccgaaatcacagacattagcacgactcggaccgatg

SEQ ID NO: 3191 - DNA, 203 bp, Homo sapiens
  source 1..203: mol_type = other DNA
ggcgcgccagtccttttcaaatgtagaagaacaattcaaaatgctatcactgtgtatgtaagaaggatggggcagatttcattttaccctctagtctccctcaatgcatgcacggatttatctgtacgctaagctctctgctctgcatctgtagctccttgtggattatattgtctcagtgatcagaacgactcggaccgatg

SEQ ID NO: 3192 - DNA, 203 bp, Homo sapiens
  source 1..203: mol_type = other DNA
ggcgcgccagtcctaaaatagagtggctagtgtgagcctcgaaggcctgaatttggcaagggtccacccagccaagtgatctgaggaaacatcggagaaagattgcagttgtggaagaagatggtcgagaggacaaagcaacaattaaatgtgaaacttctcctcctcctacccctagagccctcagacgactcggaccgatg

SEQ ID NO: 3193 - DNA, 203 bp, Homo sapiens
  source 1..203: mol_type = other DNA
ggcgcgccagtcctgtaaccactccaggacgctgccagggcctgagaagggacaaactccaattgctccagttcaaactggtcctggcctggtcaaacggaggagacagagcagtgattcacagcaggacgtggtacttgcagactgaccgtcctctcaggactcactagggtctcttctctgacgagcgactcggaccgatg

SEQ ID NO: 3194 - DNA, 203 bp, Homo sapiens
  source 1..203: mol_type = other DNA
ggcgcgccagtcctgtgccagctcaatggggccgccgacctcgaagtttccgaagaagtaaaatagaaagaagaccttttttgaaatgacctgtgttagtcacctctctcaggatgcgtgaggcggacacgttgaggccacctcagctgatggaagtttccgctgacatcatctctaccgttgagttccgactcggaccgatg

SEQ ID NO: 3195 - DNA, 203 bp, Homo sapiens
  source 1..203: mol_type = other DNA
ggcgcgccagtccttcaggcacatcgaggagaaccagctgcccaagctcttggctgctgcccttctgaggcctgcctgatttgggccacatagatctggttttggccattgactggcaacatggcagtagccaactgcagagccaccagggagcagcctcattctgattgagtataacgaagacgctgcgactcggaccgatg

SEQ ID NO: 3196 - DNA, 203 bp, Homo sapiens
  source 1..203: mol_type = other DNA
ggcgcgccagtcctctcgctcaccccgcctgctcctgcggagtgactgccgcagcggggccggaagacaggtgcgccccagcctcgccagctctggccctggcctccggggaactcggcgcctccctcgtcaccgtcggtggcggttaaaactggcctctacgcttctgcttcaatctccaatttggccgactcggaccgatg

SEQ ID NO: 3197 - DNA, 203 bp, Homo sapiens
  source 1..203: mol_type = other DNA
ggcgcgccagtcctgtcggcggccgctgcgcgcgctcgttgcccaacccggtccccgcccccagacacgccgggctctcggggcaccacagccatgtgctcgttagcgtcaggcgctaccggttattcacatctgctgaagaaacattttcacactgtaagtctgagcatcagtttaatattgacagccgactcggaccgatg

SEQ ID NO: 3198 - DNA, 203 bp, Homo sapiens
  source 1..203: mol_type = other DNA
ggcgcgccagtccttatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggacgactcggaccgatg

SEQ ID NO: 3199 - DNA, 203 bp, Homo sapiens
  source 1..203: mol_type = other DNA
ggcgcgccagtcctgagtcctctcggcacccagcaagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggccgactcggaccgatg

SEQ ID NO: 3200 - DNA, 203 bp, Homo sapiens
  source 1..203: mol_type = other DNA
ggcgcgccagtcctgctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcagaccctctggagactttggggaccagtttgaccgactcggaccgatg

SEQ ID NO: 3201 - DNA, 203 bp, Homo sapiens
  source 1..203: mol_type = other DNA
ggcgcgccagtccttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaacgactcggaccgatg

SEQ ID NO: 3202 - DNA, 203 bp, Homo sapiens
  source 1..203: mol_type = other DNA
ggcgcgccagtcctgttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggcgactcggaccgatg

SEQ ID NO: 3203 - DNA, 203 bp, Homo sapiens
  source 1..203: mol_type = other DNA
ggcgcgccagtcctgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagcgactcggaccgatg

SEQ ID NO: 3204 - DNA, 203 bp, Homo sapiens
  source 1..203: mol_type = other DNA
ggcgcgccagtcctcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggcgactcggaccgatg

SEQ ID NO: 3205 - DNA, 203 bp, Homo sapiens
  source 1..203: mol_type = other DNA
ggcgcgccagtcctgcactccagcctgggcgacagagtgagaccctatctctaaacaaaagaaagaacgtcttcaagcatggagccatgaagctggatttggctttctgtcgctctctctacagggtacagacagtgacaataccctcccctcccttgggctggacccctctctacagctaggagccacgactcggaccgatg

SEQ ID NO: 3206 - DNA, 203 bp, Homo sapiens
  source 1..203: mol_type = other DNA
ggcgcgccagtcctctgctgacaccttgatcttggacttcccatcttccaggaaggcctgacctcagttgttccagggtaaagaatttgggcagtgcccacacccacgctgttggataacatttcttcaccataccagtgagggtgaatgtgtacacgcccagcttcctgcctgttactctccacagtcgactcggaccgatg

SEQ ID NO: 3207 - DNA, 203 bp, Homo sapiens
  source 1..203: mol_type = other DNA
ggcgcgccagtcctggaggaggaggtggaggaggtggaggaggtggaggaggcgcgggaccgggggggatagattcccagaagtgggataactggatcagagggtgattaccctgtgtataagagtatgtgtctcactgcaccttcaatggcattgagtagatcgtcagtatttaaacagatcacatccgactcggaccgatg

SEQ ID NO: 3208 - DNA, 203 bp, Homo sapiens
  source 1..203: mol_type = other DNA
ggcgcgccagtcctaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagcgactcggaccgatg

SEQ ID NO: 3209 - DNA, 203 bp, Homo sapiens
  source 1..203: mol_type = other DNA
ggcgcgccagtcctctttcccctccccctcctgtaacttcctcttcttccccggttgggccctctgctcctctgcactctcctccccagttcgcagatttccgcccaccttccgcctcgtctagccgcgccacagctagcggggtgatctttccccccctctggtaggagttggtgaaggtgagactccgactcggaccgatg

SEQ ID NO: 3210 - DNA, 203 bp, Homo sapiens
  source 1..203: mol_type = other DNA
ggcgcgccagtcctcggacttagacgcggggacttcagggcagggggcgccccctgcccgggtcaccagtcggggcgaggggacgtctcctctcccccagctgctctgctcggatggcgccgccggctgagtgacgggggcggcgcgcaggacttcccagctcggacctcttgccttcgaggggaaagcgactcggaccgatg

SEQ ID NO: 3211 - DNA, 203 bp, Homo sapiens
  source 1..203: mol_type = other DNA
ggcgcgccagtcctcgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttccgactcggaccgatg

SEQ ID NO: 3212 - DNA, 203 bp, Homo sapiens
  source 1..203: mol_type = other DNA
ggcgcgccagtccttgtgtggtgctgtccttcctcaagactacctcattctcactggctcggagactcctgcctgctgagctgactacacagacttagtcttctccactccgtgttcctgcagctagagacatgacctaacaccctgatgaccactctcagggaccttgagtgactggccggtgcacccgactcggaccgatg

SEQ ID NO: 3213 - DNA, 203 bp, Homo sapiens
  source 1..203: mol_type = other DNA
ggcgcgccagtccttgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtccccgactcggaccgatg

SEQ ID NO: 3214 - DNA, 203 bp, Homo sapiens
  source 1..203: mol_type = other DNA
ggcgcgccagtcctcacctgcagtgtagtggtttatactaaggaatacacacaaattacaggcctttgagcccagaatgcaacttgggaggtatttgacctgtccaaagacgacttgatacctctataatgtaacagaaaaggtcagaaaatattaagcaagtagaagtgtggagcatattaagcaagcgactcggaccgatg

SEQ ID NO: 3215 - DNA, 203 bp, Homo sapiens
  source 1..203: mol_type = other DNA
ggcgcgccagtcctacaattgcattcccgggctggatgccggttgttaagcgcgctgttgctttgtaaaaatgcgtgtgttctggtgttttggctggggcagggaggggacaccccacgaggtctggggctgttgcccttgtgtcatccccccgccttttaactgcaaaggtcaccatggctgaccggcgactcggaccgatg

SEQ ID NO: 3216 - DNA, 203 bp, Homo sapiens
  source 1..203: mol_type = other DNA
ggcgcgccagtcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccaggcacatccctgctcaccctgcgactcggaccgatg

SEQ ID NO: 3217 - DNA, 203 bp, Homo sapiens
  source 1..203: mol_type = other DNA
ggcgcgccagtcctgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgcccgactcggaccgatg

SEQ ID NO: 3218 - DNA, 203 bp, Homo sapiens
  source 1..203: mol_type = other DNA
ggcgcgccagtcctcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacacgactcggaccgatg

SEQ ID NO: 3219 - DNA, 203 bp, Homo sapiens
  source 1..203: mol_type = other DNA
ggcgcgccagtcctacccaggatgcggaggcccttgtggggctgtggccactagggagtttcttggtcacaggacgtgaccccagccaggccctggtgttgaggtcaggacctttaccaggagaagtcaatacctaccagatccagaagattcccagaggtgtgtccctggaatcctccaacctctgccgactcggaccgatg

SEQ ID NO: 3220 - DNA, 203 bp, Homo sapiens
  source 1..203: mol_type = other DNA
ggcgcgccagtcctgtatttacgatggagatgaatttagaaaagcagagtctgtccaaggtggagaaaccaggatctatttggatttgccacagaatttcaagatatttgtgagcgctatctgctctatgcaagcacttagacaacctatgggaagaacaccgtggcagcgtggtcctgtttgcctggcgactcggaccgatg

SEQ ID NO: 3221 - DNA, 203 bp, Homo sapiens
  source 1..203: mol_type = other DNA
ggcgcgccagtcctcgggaactggcgaggtagttccttcgcggtggagagacctggaatggccaaatatcaagaaatgtacatcaaaacattcacccagaaaaccaggagctagtaagggtacttcgagaacagcttcaaacagaacaggatgcacctgctgccactcgacagcagttctacactgaccgactcggaccgatg

SEQ ID NO: 3222 - DNA, 203 bp, Homo sapiens
  source 1..203: mol_type = other DNA
ggcgcgccagtcctagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagcgactcggaccgatg

SEQ ID NO: 3223 - DNA, 203 bp, Homo sapiens
  source 1..203: mol_type = other DNA
ggcgcgccagtcctcacactctcccggcgcctcggccggccgggcgcggtgtgcaggggtgaggcggtgtctccaggctgaggagggacgcggaggagggtccggcgcggccccgggactggagggtgagtccctcacaaagggcggagcggggctgtcacctggagatcacggagggaagttcatcccgactcggaccgatg

SEQ ID NO: 3224 - DNA, 203 bp, Homo sapiens
  source 1..203: mol_type = other DNA
ggcgcgccagtcctgtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccacgactcggaccgatg

SEQ ID NO: 3225 - DNA, 203 bp, Homo sapiens
  source 1..203: mol_type = other DNA
ggcgcgccagtccttcggcagaactccgccaccaggcgcgatgccggaactacatgtcccatgacgctctgggaggccgcagctttccaccggaaagagggtggctgaggtgggggaggagcccaaaaggcattgtgggagtacagctctttcctttccgtctggcggcagccatcaggtaagccaagcgactcggaccgatg

SEQ ID NO: 3226 - DNA, 203 bp, Homo sapiens
  source 1..203: mol_type = other DNA
ggcgcgccagtcctgtctgcaggtatggatgttgttctcttttccctgtctttatttccttaccaatcggctgccatccgaggagctgaggaagcctagagctctcagaagcagtcctttgagctggtgtaggggcactcagaatggtccagcgtttgacataccgacgtaggctttcctacaatacacgactcggaccgatg

SEQ ID NO: 3227 - DNA, 203 bp, Homo sapiens
  source 1..203: mol_type = other DNA
ggcgcgccagtcctgactacttacctgcgaatcccggttgcccgcccgccagcacgtccgttccctaagcagaccgcctggcctcctgcctgacccgtcttctcaccgttgcccggagtctgacctccccacgctcagtccactaacgaagctatccctgctcctgccccacagcttctaagtgccagcgactcggaccgatg

SEQ ID NO: 3228 - DNA, 203 bp, Homo sapiens
  source 1..203: mol_type = other DNA
ggcgcgccagtcctctcaggtgagaacttctcaggtggaaagcaggaagagggtggctagtgcaaggatcagatagcacctgcttggaagttcactgattaatgatttaacaagggcggtcacatgggacaactgctgcttttctctgccctcatttttcttactaacaggtctgaaaattgaacaagcgactcggaccgatg

SEQ ID NO: 3229 - DNA, 203 bp, Homo sapiens
  source 1..203: mol_type = other DNA
ggcgcgccagtcctgaagtggagcctgggagccttgacgttaggaacgaagtctaacctggatctggagccgggagataatctgaatgctggctggggcagaaaattactaagatcctgtggaagtgtgaggattattaaactgatcactgtctgataaggtgagatcaaattgggaatgctttcatacgactcggaccgatg

SEQ ID NO: 3230 - DNA, 203 bp, Homo sapiens
  source 1..203: mol_type = other DNA
ggcgcgccagtcctcagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctccgactcggaccgatg

SEQ ID NO: 3231 - DNA, 203 bp, Homo sapiens
  source 1..203: mol_type = other DNA
ggcgcgccagtcctctcccgcagcttgtccacactctgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgcgactcggaccgatg

SEQ ID NO: 3232 - DNA, 203 bp, Homo sapiens
  source 1..203: mol_type = other DNA
ggcgcgccagtcctgacttggaggcagagacccaagcagctggaggctctgtgtgtgggtcgctgatttcttggagcctgaaaagaaagtaacacagcagggatgaggacagatggtgtgagtcagtgagagcagcgactggacccagagccatgtggctgtgccctctggccctcaacctcatcttgcgactcggaccgatg

SEQ ID NO: 3233 - DNA, 203 bp, Homo sapiens
  source 1..203: mol_type = other DNA
ggcgcgccagtccttggaccaccgggcccggagggtccgagccgagagcggagcctgcaccctccacctcccgcccttcgggaaatatcagaactgagccaggagctgctgccgcccacccctcgtcttctggctgcctccctctttgtgccccacaggctccccctctccacctcctggggcccatccgactcggaccgatg

SEQ ID NO: 3234 - DNA, 203 bp, Homo sapiens
  source 1..203: mol_type = other DNA
ggcgcgccagtcctatgttgagtgacagctgtccaatggaggccctccgtgctagtacggcttgcggcttaagcgccgccgcggtctgcggaatgtcaactattcaacatggaggcggaggtcgataagctggaactgatggtgagtgcaaagtgaaggagatctactgggtagtttatttttccccccgactcggaccgatg

SEQ ID NO: 3235 - DNA, 203 bp, Homo sapiens
  source 1..203: mol_type = other DNA
ggcgcgccagtcctagtcaagttgacctacatagaagagaaggaactggaagtgcatgtctgtgttctggctccgattgggaaaagctgcttaaccactgttacacttccaggggctccccactcagtccccagtcatctatcgacagtgagctgagtacttcagaattggaggatgattctatctcccgactcggaccgatg

SEQ ID NO: 3236 - DNA, 203 bp, Homo sapiens
  source 1..203: mol_type = other DNA
ggcgcgccagtcctcacccccaccgacctctcggagacaggaatccgctctgcccctgcatcctcctctgctcacccttctctcagtagtgtttgtcagacaccagtccggacctcagctctcgatctagttcccgagtaagatttagctcccgggaaagcgtgcctgaaacaagccggagtgagcctcgactcggaccgatg

SEQ ID NO: 3237 - DNA, 203 bp, Homo sapiens
  source 1..203: mol_type = other DNA
ggcgcgccagtcctgcagtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaagtgggctgatcatggccagcgccacgactcggaccgatg

SEQ ID NO: 3238 - DNA, 203 bp, Homo sapiens
  source 1..203: mol_type = other DNA
ggcgcgccagtcctcctccttcttcattagcggtctcccatgtggggccacatcttccctcaccaggaacccagtgggcgcgctccagcccccctcagcttgccttttgcgtggtcattagagctagggcacacgtcatgctgattcacatatttttgccctttgtcatgtattgagaaaaagtaaggcgactcggaccgatg

SEQ ID NO: 3239 - DNA, 203 bp, Homo sapiens
  source 1..203: mol_type = other DNA
ggcgcgccagtcctaacaaatctcctaaccttcagaggctcggatttcttgtctatgagatgaagtgagtttccttcgtctgggcagactccctcccctcttccataaaggctgcaggagacctgtagctgtcacaggaccttccctaagagcccgcaggggaagactgccccagtccggccatcacccgactcggaccgatg

SEQ ID NO: 3240 - DNA, 203 bp, Homo sapiens
  source 1..203: mol_type = other DNA
ggcgcgccagtcctacacggagccgtgtgtggatggctgggtctatgaccgcagcatcttcacctccacaatcgtggccaagtggaacctcgtgtgtgactctcatgctctgaagcccatggcccagtccatctacctggctgggattctggtgggagctgctgcgtgcggccctgcctcagacagtgcgactcggaccgatg

SEQ ID NO: 3241 - DNA, 203 bp, Homo sapiens
  source 1..203: mol_type = other DNA
ggcgcgccagtcctaggaagccgaggaaggctgtgtttctgactcacacgggggagtcgggggagtcgtaaacaaccctgaagagaacagccaggcctggcgctctgggcttggtcctgggacacccgtttgacactgtaaaggtgaggctgcagacccagaccacctaccggggcatcgttgattgccgactcggaccgatg

SEQ ID NO: 3242 - DNA, 203 bp, Homo sapiens
  source 1..203: mol_type = other DNA
ggcgcgccagtcctgatgcagcacggggtcgcggggcgggcgcccagtgcaccggaggaggtgagcgccaggtcgccttcgcggcccggggacacaggcagggacgcgggagctgatgcggctggaccggccggggaaacagtattttctggaagggggcccctctgaagcggtccaggatcctgcaccgactcggaccgatg

SEQ ID NO: 3243 - DNA, 203 bp, Homo sapiens
  source 1..203: mol_type = other DNA
ggcgcgccagtcctttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggaccgactcggaccgatg

SEQ ID NO: 3244 - DNA, 203 bp, Homo sapiens
  source 1..203: mol_type = other DNA
ggcgcgccagtcctgctgaccacaggagccggtgctggggactgagggaaacttagagttcagagagggggtgtgatttgcctgaggtcacacagcaagttagagacccagctccacgactcattgtcttggctttggccctcgtcatcctgcccacccagcggggcttcccaacccaccacacagcccgactcggaccgatg

SEQ ID NO: 3245 - DNA, 203 bp, Homo sapiens
  source 1..203: mol_type = other DNA
ggcgcgccagtcctcctcagtttcctctttcagtctgtggtgtgtggtccatcctcttgctgagcacattgaaaggaactggctatctttgatctcttcctccagggaatctcttagttataacatttgttagctactttggagccaaacttcacaggccaaaaataattggagcagggtgtgtaatccgactcggaccgatg

SEQ ID NO: 3246 - DNA, 203 bp, Homo sapiens
  source 1..203: mol_type = other DNA
ggcgcgccagtccttgcactgggcgcctcgcagctggtgaggatgccctgctgcgcggccctgcgcccccagccccagtcccaggtgggcaagactgactgggcccggcttcggcccctcgtgccggtggatgaaacgtgccggagtgcttgggtgccatcagctatcaaatctgaattctaagcgcccgactcggaccgatg

SEQ ID NO: 3247 - DNA, 203 bp, Homo sapiens
  source 1..203: mol_type = other DNA
ggcgcgccagtcctagagatagcaggtggtgctaattcactgtgttggtgggaactctggctacactgaaaggctggagtgcagtggcacgatcttggttcaccacaatctcgtctcgaaggctcaggtgattctctcacctcagccgcctgagtagctgggaccacagtttcagctgtgagttcaaccgactcggaccgatg

SEQ ID NO: 3248 - DNA, 203 bp, Homo sapiens
  source 1..203: mol_type = other DNA
ggcgcgccagtccttacaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaacgactcggaccgatg

SEQ ID NO: 3249 - DNA, 203 bp, Homo sapiens
  source 1..203: mol_type = other DNA
ggcgcgccagtcctaatcagagaatggagggatataatgagtggaactgagggccgcgatgggcctcttggaacattggtgtgttcatctgcattcgatgtgctggaatccacaggaatctgggggtgcacatatccagggtaaagtcagttaacctcgaccagtggactcaagaacagattcagtgccgactcggaccgatg

SEQ ID NO: 3250 - DNA, 203 bp, Homo sapiens
  source 1..203: mol_type = other DNA
ggcgcgccagtcctcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaaggttgtagaaccaatagggtttgagacctgcgactcggaccgatg

SEQ ID NO: 3251 - DNA, 203 bp, Homo sapiens
  source 1..203: mol_type = other DNA
ggcgcgccagtcctcgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaacgactcggaccgatg

SEQ ID NO: 3252 - DNA, 203 bp, Homo sapiens
  source 1..203: mol_type = other DNA
ggcgcgccagtccttccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctccgactcggaccgatg

SEQ ID NO: 3253 - DNA, 203 bp, Homo sapiens
  source 1..203: mol_type = other DNA
ggcgcgccagtcctagaggaggagggcacttttgtgtgatggcaacttcacttctagggcgtggtgcttgctcccgaatcagacgccggcagccaaacttgtcccctcctgtagagtaggaagcggccgggcgccggggctgttgggggtgccaggaagaaccgaggttgggatcgactcctctggcccgactcggaccgatg

SEQ ID NO: 3254 - DNA, 203 bp, Homo sapiens
  source 1..203: mol_type = other DNA
ggcgcgccagtcctaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacacgactcggaccgatg

SEQ ID NO: 3255 - DNA, 203 bp, Homo sapiens
  source 1..203: mol_type = other DNA
ggcgcgccagtccttcgccgcgagccgcaggtctgcctgcagtcccacttccaggctgaactccctgaggtctctgattccctaggtgtcctggagtctggcccaggacctggccccacaggagtcccagcaggggtagctcctcccgggacaaggaccgaagtgcgacggtcagtagttcagtgccccgactcggaccgatg

SEQ ID NO: 3256 - DNA, 203 bp, Homo sapiens
  source 1..203: mol_type = other DNA
ggcgcgccagtcctaagagtcggagttttggcgttagacctaggttcagagctcagatccacttcttcctagccttacgacttaggagcactccgctggtccaggcggcaacatgtccatgcttttagtgatgtccctgcctctaatccagaagccatggaggagataaggtagcccccctcgatcggcgactcggaccgatg

SEQ ID NO: 3257 - DNA, 203 bp, Homo sapiens
  source 1..203: mol_type = other DNA
ggcgcgccagtcctaccgtctgaggccaggagcgctgcgacggagccttgaccgccgttgcccggccctctcccgcgcagccccgggcttccgcagtccttccttcagaagggaaatttctgagggtcaggaaggggaatctgtacctcactccttgaacaccaaggaaggaatattgggaaaccaaacgactcggaccgatg

SEQ ID NO: 3258 - DNA, 203 bp, Homo sapiens
  source 1..203: mol_type = other DNA
ggcgcgccagtcctacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatccgactcggaccgatg

SEQ ID NO: 3259 - DNA, 203 bp, Homo sapiens
  source 1..203: mol_type = other DNA
ggcgcgccagtccttgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggacccgactcggaccgatg

SEQ ID NO: 3260 - DNA, 203 bp, Homo sapiens
  source 1..203: mol_type = other DNA
ggcgcgccagtcctcgtgcgagtcggcctcagtgtctgcgagattaatctctcatggccgctgcacaagaacctggcttttagctgaactaaggagaaagtcctacaacagtttggcgtgcaacatggggcttgagaaaggatgaggacggggacttggttgccttttccagtgacgaggaattgacacgactcggaccgatg

SEQ ID NO: 3261 - DNA, 203 bp, Homo sapiens
  source 1..203: mol_type = other DNA
ggcgcgccagtcctcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggcgactcggaccgatg

SEQ ID NO: 3262 - DNA, 203 bp, Homo sapiens
  source 1..203: mol_type = other DNA
ggcgcgccagtcctaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtgagccagcccgactcggaccgatg

SEQ ID NO: 3263 - DNA, 203 bp, Homo sapiens
  source 1..203: mol_type = other DNA
ggcgcgccagtcctctccccacgcgccaccatgcctctgctggacgttttctggtcttgcttcaggaaggtgaagtgcttcccattgctgcaggtgaagaagaacgctgaagccgaggccaaaagagcatgtgagtggcttcaagcaacaggattccctcagtatgtgcagctttttgaaggaggctgcgactcggaccgatg

SEQ ID NO: 3264 - DNA, 203 bp, Homo sapiens
  source 1..203: mol_type = other DNA
ggcgcgccagtcctagaggcagttctagtctcagatcgtggggcagagaaagctccttgggaacatgggagaggaacgagttggtgcattgtagaaactgcccgaaggccagcagggctggtgcttaggagaacatgcagtagaacttttcatcaaacaaatggaacacgtcacagaattttgctaaccgactcggaccgatg

SEQ ID NO: 3265 - DNA, 203 bp, Homo sapiens
  source 1..203: mol_type = other DNA
ggcgcgccagtcctattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgccgactcggaccgatg

SEQ ID NO: 3266 - DNA, 203 bp, Homo sapiens
  source 1..203: mol_type = other DNA
ggcgcgccagtcctactgaagtaggcctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtccgactcggaccgatg

SEQ ID NO: 3267 - DNA, 203 bp, Homo sapiens
  source 1..203: mol_type = other DNA
ggcgcgccagtcctaggtgggcggtggcggtaggtgggtggccagcgactggcaacgcggtggcttagacgcgcgagatccggccagggtcagagtactgtaagattgatgttaaaggcatggtgttcaccccacttcatcagcgtacataagttatctcttcttttggacccttattttatgccatacgactcggaccgatg

SEQ ID NO: 3268 - DNA, 203 bp, Homo sapiens
  source 1..203: mol_type = other DNA
ggcgcgccagtcctgcaagctgctgaagtttctcagctgcggggagcaagggtaatcactcctgaagatcttctgtttttgatgcgcaaagataagacaaattgagtggcagcaataatgcgaacaaaagacaaaagattgctcaggacttcctcaactctattgaccagacaggagaacttttagcacgactcggaccgatg

SEQ ID NO: 3269 - DNA, 203 bp, Homo sapiens
  source 1..203: mol_type = other DNA
ggcgcgccagtccttggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagcgactcggaccgatg

SEQ ID NO: 3270 - DNA, 203 bp, Homo sapiens
  source 1..203: mol_type = other DNA
ggcgcgccagtcctgagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagccgactcggaccgatg

SEQ ID NO: 3271 - DNA, 203 bp, Homo sapiens
  source 1..203: mol_type = other DNA
ggcgcgccagtcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccacccgactcggaccgatg

SEQ ID NO: 3272 - DNA, 203 bp, Homo sapiens
  source 1..203: mol_type = other DNA
ggcgcgccagtcctgaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgcgactcggaccgatg

SEQ ID NO: 3273 - DNA, 203 bp, Homo sapiens
  source 1..203: mol_type = other DNA
ggcgcgccagtcctccttctgcgccacagagatggggtctcactctgtcatccaggctggaatatagtggcacaatcatagcccattgtagcctccatctcaaggactcaggggatcctcccttctaggcctcccaagtagctgggattacaggtagttacttttggtgacgctgtccagttcccacacgactcggaccgatg

SEQ ID NO: 3274 - DNA, 203 bp, Homo sapiens
  source 1..203: mol_type = other DNA
ggcgcgccagtcctggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaacgactcggaccgatg

SEQ ID NO: 3275 - DNA, 203 bp, Homo sapiens
  source 1..203: mol_type = other DNA
ggcgcgccagtccttgcttagaacagagcttggtgagcatccggtcaacagctggtccctgcagacggcttcccatttttatgaccggatgctgggaagcctgctggtccacaggtccatacatgaagtcaccataagagggtggttcccacttcatcaacacctcatcgccgcgaggtgaggctaagcgactcggaccgatg

SEQ ID NO: 3276 - DNA, 203 bp, Homo sapiens
  source 1..203: mol_type = other DNA
ggcgcgccagtcctctgatgtgagctagtttgtctggttgagttggatgtttaaatagaaggcagaacaacaacaggtactccacatcagcattctcaagactggagaagttaggcctcagacatcccaagccttctcctttcattggaaacttgacatttttccgccagggtttttgggaaagccaacgactcggaccgatg

SEQ ID NO: 3277 - DNA, 203 bp, Homo sapiens
  source 1..203: mol_type = other DNA
ggcgcgccagtcctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgacgactcggaccgatg

SEQ ID NO: 3278 - DNA, 203 bp, Homo sapiens
  source 1..203: mol_type = other DNA
ggcgcgccagtcctggacgggcgggctgggactggtgctggccattggctgcctcaaggctcccaccccgcctgcctccctagcctgcggctggcggcccctgcctctccagctgcctctgaactccctggagcaagcacctcctgctgggctgtgtgagctgcgactggttctcagtggcccctgcccgactcggaccgatg

SEQ ID NO: 3279 - DNA, 203 bp, Homo sapiens
  source 1..203: mol_type = other DNA
ggcgcgccagtcctccctggaaagcggcctacagttccttggacacctccaagttcaagaaccagggtctgtcatccccacagcccctgcccctgggagccagcgctcaaggcagctccctagggcagtgccacttgaaggagattccccctccacccccgactgctgccagcagggattctctgggccgactcggaccgatg

SEQ ID NO: 3280 - DNA, 203 bp, Homo sapiens
  source 1..203: mol_type = other DNA
ggcgcgccagtcctggttcttcagctttggaacttgactggctctccttgctcctcagcctgcagacagcctattgtgggaccttttgatcgtgaccaccaaggatccagatataattctttcctcagtaatagaaaaaagaatctgggatctaagaagatacctactcattttctaagtgactggcccgactcggaccgatg

SEQ ID NO: 3281 - DNA, 203 bp, Homo sapiens
  source 1..203: mol_type = other DNA
ggcgcgccagtcctgcgggggtcgcgctgcacagcctgcggcgcagcggagggggaccgcagtcgagtctgcagagtgttgggtctgtagccagcaaattacttcatcatctagattatccattcagttgatcctaattagcaaggataacaagaatcgtccgcactaaagtcccctgcagcgtgacccgactcggaccgatg

SEQ ID NO: 3282 - DNA, 203 bp, Homo sapiens
  source 1..203: mol_type = other DNA
ggcgcgccagtcctcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatccgactcggaccgatg

SEQ ID NO: 3283 - DNA, 203 bp, Homo sapiens
  source 1..203: mol_type = other DNA
ggcgcgccagtccttgtgcactttctccctccacctggagcatgggctaacaccggaggaaaggaaaagacagagtcagacaggggcctgccccatcacctgaattccagagatgccagtgtgcactgaagccccaggcagggcgtgcccaggaccggatcctggatggtggagcctggggaggggcccgactcggaccgatg

SEQ ID NO: 3284 - DNA, 203 bp, Homo sapiens
  source 1..203: mol_type = other DNA
ggcgcgccagtcctcccctacttcatcacctacaagtgcagcggcctgtgagtgcgggaagggcgcggggcggagagggcgcggggcccgggccgaccctcacctcccgcttctccaggtccgagtacaacgccttctggaaatgcgtccaggctggagtcacctacctctttgtccaactctgcaagcgactcggaccgatg

SEQ ID NO: 3285 - DNA, 203 bp, Homo sapiens
  source 1..203: mol_type = other DNA
ggcgcgccagtcctgacaactgccgctcaggccatctctggcttcttcgtgtggacggccctgctcatcacatgccaccagcccagggctcggctgggccaagtgtgatgtcatgagagctgggacgagacacccaggggctgcctggactgaggactgtggtagagcagctcttggcatttatctaccgactcggaccgatg

SEQ ID NO: 3286 - DNA, 203 bp, Homo sapiens
  source 1..203: mol_type = other DNA
ggcgcgccagtcctcgtctaaattcgcgtcggttcttatttctctccctggcaaggtctgaagacggatggagtctagttctgtcgcccaggctggagcccagtggtgtgatctcagctcactgcaatctccacctcctggcttcaagcgattcttctgcttcagcctcccgactgtgtcagcgtgttcgactcggaccgatg

SEQ ID NO: 3287 - DNA, 203 bp, Homo sapiens
  source 1..203: mol_type = other DNA
ggcgcgccagtcctcacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagacccgactcggaccgatg

SEQ ID NO: 3288 - DNA, 203 bp, Homo sapiens
  source 1..203: mol_type = other DNA
ggcgcgccagtcctgagagaaagcccgggcaggagagcacagagccggcgactggacgcgagcgcggggcgggtggagagcgtctctccgggcgccgctgctgttgtcccgggtgctgaaaagccgggaacttcccgggaagcagcggcacttttctccctggaaggctaaacatatttttgactggtcgactcggaccgatg

SEQ ID NO: 3289 - DNA, 203 bp, Homo sapiens
  source 1..203: mol_type = other DNA
ggcgcgccagtcctcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcgggggagcttttggaagagtcccagcgactcggaccgatg

SEQ ID NO: 3290 - DNA, 203 bp, Homo sapiens
  source 1..203: mol_type = other DNA
ggcgcgccagtcctcggcagcgggttcggttgcgcgtggcgcacggggtgggagcggagcccaggccgggagcaggcgccgccgccagtgagaaccggggccggagccgggtgcggatttgctggggctgagtcgggggcgcgcgggccctgacctctgccctctgacctctcccctagcaggcgacccgactcggaccgatg

SEQ ID NO: 3291 - DNA, 203 bp, Homo sapiens
  source 1..203: mol_type = other DNA
ggcgcgccagtcctggctgctcgggctggtctcggccgcggccgccgcctgggacctggcttccctgcgctgcaccttgggcgccttttgcgaatgcgacttccggcccgacttgccggaaggatctgaagagctgggtccaagggaacctcactgcctgtggccgctccctcttcctcttcgatgagcgactcggaccgatg

SEQ ID NO: 3292 - DNA, 203 bp, Homo sapiens
  source 1..203: mol_type = other DNA
ggcgcgccagtcctatacacacagtgacttggaggaatctcaaaggcattctgctcaatgacaggagccagcctcaaaagatttggctgactgaggacgcgacaggtactcagcttctttctgcatctcagttgcccagcacaggggctggcacgcacccttctgcagaggccgggctggaggagaagcgactcggaccgatg

SEQ ID NO: 3293 - DNA, 203 bp, Homo sapiens
  source 1..203: mol_type = other DNA
ggcgcgccagtcctccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctacccgactcggaccgatg

SEQ ID NO: 3294 - DNA, 203 bp, Homo sapiens
  source 1..203: mol_type = other DNA
ggcgcgccagtcctcctggtctcccgcgtccatcggtccattcctgcgtcgttctgtccttccgaacgcacacttcaggagcagccgcgaggagtgagcactgcacgcaggatccgcccagtgcttgggccaagcaccctgtggcatccaagctcccctggacgttacccttggtgaaccaaggtggccgactcggaccgatg

SEQ ID NO: 3295 - DNA, 203 bp, Homo sapiens
  source 1..203: mol_type = other DNA
ggcgcgccagtcctgtcactctaagttggtggtatccaatcccttaggaacgaacctctgaggttttccatttatgagactctcctactactagagtgggccaaagggagagagaatcctatttggagcaatgaggaggtaacagtccacccacaaatgaattatcaggagtgaacccagaggcacgtcgactcggaccgatg

SEQ ID NO: 3296 - DNA, 203 bp, Homo sapiens
  source 1..203: mol_type = other DNA
ggcgcgccagtcctgaggggctttcagctggtcgcctgcttgtcacctctcgctgcctgaaaggcagctctcagagccctttcctgtccttctaattacagcggcgggggcagtgcgcgcttcgggacgcaattggaaaccagcgtgcagggtcaaagacagccggccccccatgtcagtggtctaggcgactcggaccgatg

SEQ ID NO: 3297 - DNA, 203 bp, Homo sapiens
  source 1..203: mol_type = other DNA
ggcgcgccagtcctcgagaccttcagagtcacctcgcagtgtaacctgtagcctgtagagatgacttctacccggcctccccctcagagctcttggagtccaggctgagggtcttgaagaaggaactggaggactgtgaggtgttccggtccacggaaaagaaggagagcaaggagctgctgaaacagcgactcggaccgatg

SEQ ID NO: 3298 - DNA, 203 bp, Homo sapiens
  source 1..203: mol_type = other DNA
ggcgcgccagtcctagtgtgatggagagtctctgccgtgccatctgggatgcaaaccgtccctgtgttccccacgtccaggccgtagatgctccccgccggtcagtcacttagtcgtcagatcgcccgtcctggtatcacagtgcttctgttcaggttgcacactgggccacagaggatccagcaaggcgactcggaccgatg

SEQ ID NO: 3299 - DNA, 203 bp, Homo sapiens
  source 1..203: mol_type = other DNA
ggcgcgccagtcctagggaccctgagcaccgcctggtctctttcctgtggccagcccagctgggaggctgtggcgtgctgggtgtcggcatctggctggccgccacacaggggagcttcgccacgctgtcctcttccttcccgtccctgtcggctgccaacttgctcatcatcaccggcgcctttgtccgactcggaccgatg

SEQ ID NO: 3300 - DNA, 203 bp, Homo sapiens
  source 1..203: mol_type = other DNA
ggcgcgccagtccttttgaaagcgtgggctgaatgctgacctcccggacatcatgagtgttgttctacctgcgccccctggacatcctggcggaagtggtcccttctgatggcgccacaagcgggatcaggatagttcaggttcacggtgcacggggactccagctctcagtagccgccccccgcacccgactcggaccgatg

SEQ ID NO: 3301 - DNA, 203 bp, Homo sapiens
  source 1..203: mol_type = other DNA
ggcgcgccagtcctattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatcgactcggaccgatg

SEQ ID NO: 3302 - DNA, 203 bp, Homo sapiens
  source 1..203: mol_type = other DNA
ggcgcgccagtcctgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtccgactcggaccgatg

SEQ ID NO: 3303 - DNA, 203 bp, Homo sapiens
  source 1..203: mol_type = other DNA
ggcgcgccagtcctcacaggcgtccacagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaacccgactcggaccgatg

SEQ ID NO: 3304 - DNA, 203 bp, Homo sapiens
  source 1..203: mol_type = other DNA
ggcgcgccagtcctcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggttctaacgactcggaccgatg

SEQ ID NO: 3305 - DNA, 203 bp, Homo sapiens
  source 1..203: mol_type = other DNA
ggcgcgccagtcctcctgtaccataaccaggaggctgatggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactcgactcggaccgatg

SEQ ID NO: 3306 - DNA, 203 bp, Homo sapiens
  source 1..203: mol_type = other DNA
ggcgcgccagtcctgcgggggcggggcacctctgtgcagggttcccagtcaccgcgacgctcctcgggaagccatagggcgcctcccagcccgtctccccgctccagtttagaacctaattcccaattccgggaccgggcccagccctgggctcttactgtccgcttttgctgggacctgttccacaacgactcggaccgatg

SEQ ID NO: 3307 - DNA, 203 bp, Homo sapiens
  source 1..203: mol_type = other DNA
ggcgcgccagtcctttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtgcgactcggaccgatg

SEQ ID NO: 3308 - DNA, 203 bp, Homo sapiens
  source 1..203: mol_type = other DNA
ggcgcgccagtcctagtgggaatccttaaccccgccccctgctcaggtcaatcccccacccaccgcccccactgtccctcccagtcttccttcccagaggagaaggctgggtatgaggaaactgctgtcttttcactggatcagacgtaaatattaactggacctctctttagattctttgctcaatacgactcggaccgatg

SEQ ID NO: 3309 - DNA, 203 bp, Homo sapiens
  source 1..203: mol_type = other DNA
ggcgcgccagtcctgactggaggagcacaggccttggaaaggaaagcagctgagatccagaggagtggaaggctcccccttgactaaagctaaacaccagtttctcaggaggatgccttgaatctcatgaacgagaatatagacattctggagacagcgatcaagcaggcagctgagcagggtgctcgcgactcggaccgatg

SEQ ID NO: 3310 - DNA, 203 bp, Homo sapiens
  source 1..203: mol_type = other DNA
ggcgcgccagtcctaggagtcaaacttgcgggaattttgcagtttatctgcagggctgttgtttccagcaagacccaaagctagaaaaggaggaggaagaaactgacccgatcagtgccagtcattgtattcaaagaagaataagcaagaaagaaaagaaggaaggaagagaggtagacagatacaagcgactcggaccgatg

SEQ ID NO: 3311 - DNA, 203 bp, Homo sapiens
  source 1..203: mol_type = other DNA
ggcgcgccagtcctaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgcgactcggaccgatg

SEQ ID NO: 3312 - DNA, 203 bp, Homo sapiens
  source 1..203: mol_type = other DNA
ggcgcgccagtccttcctctttcctctgcccagtcctggggtcccgcggccgcctaggagggagcccgccggggcggggcggggccgggtgcccatgaacagcggggtcccggccacgctggccgtgcggagagtgaaattcttcggccagcacggcggggaggtcaactcttctgccttctcccctgcgactcggaccgatg

SEQ ID NO: 3313 - DNA, 203 bp, Homo sapiens
  source 1..203: mol_type = other DNA
ggcgcgccagtccttgggcttaggaaggaagaggtcatctcgctcggagcttcgctcggaagggtctttgttccctgcagccctcccacggcagagtctccagagatttgggccgctacaaaaagtgcattttgcccattcggctgtggatagagaagcaggaagagcactggacttggagtcagggacgactcggaccgatg

SEQ ID NO: 3314 - DNA, 203 bp, Homo sapiens
  source 1..203: mol_type = other DNA
ggcgcgccagtcctttcttcttgttgggggactcccagccttccgcgcgtccggaggaggagaagcggcggcgccgggaagcagtgtctgttgacttcacttggcactgtttaacattccacctctggaaattgtaaagatggagagatgaggggaagggacaaggggatgaagaaagaggaaagggccgactcggaccgatg

SEQ ID NO: 3315 - DNA, 203 bp, Homo sapiens
  source 1..203: mol_type = other DNA
ggcgcgccagtcctcgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggtgtgcaactgaggaaccgactcggaccgatg

SEQ ID NO: 3316 - DNA, 203 bp, Homo sapiens
  source 1..203: mol_type = other DNA
ggcgcgccagtcctatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaaccgactcggaccgatg

SEQ ID NO: 3317 - DNA, 203 bp, Homo sapiens
  source 1..203: mol_type = other DNA
ggcgcgccagtcctccagttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctcgactcggaccgatg

SEQ ID NO: 3318 - DNA, 203 bp, Homo sapiens
  source 1..203: mol_type = other DNA
ggcgcgccagtccttggaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatccgactcggaccgatg

SEQ ID NO: 3319 - DNA, 203 bp, Homo sapiens
  source 1..203: mol_type = other DNA
ggcgcgccagtcctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagacgactcggaccgatg

SEQ ID NO: 3320 - DNA, 203 bp, Homo sapiens
  source 1..203: mol_type = other DNA
ggcgcgccagtcctaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagcgactcggaccgatg

SEQ ID NO: 3321 - DNA, 203 bp, Homo sapiens
  source 1..203: mol_type = other DNA
ggcgcgccagtcctgcggcgggaaggaggcggcaccggaggggagggccgggcgcggcggcggcggcggtggaggagccggagcataatgctaaagaagtaaacaggtcatggcacgtttaacaaaaagacgacaggcggatacaaaagctatccagcatctttgggcagccattgagattatacggacgactcggaccgatg

SEQ ID NO: 3322 - DNA, 203 bp, Homo sapiens
  source 1..203: mol_type = other DNA
ggcgcgccagtcctcctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaagctaaagaagtaaacaggtccgactcggaccgatg

SEQ ID NO: 3323 - DNA, 203 bp, Homo sapiens
  source 1..203: mol_type = other DNA
ggcgcgccagtcctggtttgagccaagtatgtgtcttgcgggtctttgcgaaagtgaaccagttattaggggcgcctaacgacctggggggtcaactaaggggactgtggcacgtttcaggcaggattcctccttcattcaaactgcatcacccaggagtctgcaaattccccaaagtaggaggaaaacgactcggaccgatg

SEQ ID NO: 3324 - DNA, 203 bp, Homo sapiens
  source 1..203: mol_type = other DNA
ggcgcgccagtcctctgtgtcccctgctagccgtaggtcgtgtgacccgcaggcaccgggagatccagaagtgaaacgccaggctctctggaggccaggagatggcatattctcacgatgcaggtgtgatttgtccagagaatctttcctaagaggaaatcccagagaagcaggagaaagagaaagaacgactcggaccgatg

SEQ ID NO: 3325 - DNA, 203 bp, Homo sapiens
  source 1..203: mol_type = other DNA
ggcgcgccagtcctagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattccgactcggaccgatg

SEQ ID NO: 3326 - DNA, 203 bp, Homo sapiens
  source 1..203: mol_type = other DNA
ggcgcgccagtcctatggctgttgaacatccacaaggcacctgcaagggaggaaatttggacacacagagagatgccaaggatacacacagaggaaagaccatgtgagtgcatagcaagaaagtgaccatctgcaagccaagactatgaatcaaagttgagaccaagaaattatttctgaaaaaggatcgactcggaccgatg

SEQ ID NO: 3327 - DNA, 203 bp, Homo sapiens
  source 1..203: mol_type = other DNA
ggcgcgccagtcctatgtgcactgagggtgacacttctgagtgtgggggccctggctagggagtgggactggcaggcttgggtggggttcccaagctttaatcttcctaccccacagaatgttttctctgcccttcaggcagcctgagccgggcagggcccctgcctctgctacggcagcccccgatccgactcggaccgatg

SEQ ID NO: 3328 - DNA, 203 bp, Homo sapiens
  source 1..203: mol_type = other DNA
ggcgcgccagtccttctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagcgactcggaccgatg

SEQ ID NO: 3329 - DNA, 203 bp, Homo sapiens
  source 1..203: mol_type = other DNA
ggcgcgccagtcctagtccgtggatctcacaaaaatgtttgctgacccttgacattgacaaactgctgacagctcagatgatccatgattggaaggatgtggtcatcaccaagatgtctttctttctccggttcccagttttccagacctgaagtgttttccaatcaaagcgaagagacgatctgtggcgactcggaccgatg

SEQ ID NO: 3330 - DNA, 203 bp, Homo sapiens
  source 1..203: mol_type = other DNA
ggcgcgccagtcctgagtgatgtcttccagactcggtgctgtacccgcccaggacccagtgctccataaaggataatagtttccagtacactatccctcatgatgactccttaagtggttcatcgtctgcatcttcgtgtgaaccagtgagtgattttccagcatctttccgaaaatctacctactggcgactcggaccgatg

SEQ ID NO: 3331 - DNA, 203 bp, Homo sapiens
  source 1..203: mol_type = other DNA
ggcgcgccagtcctggaccccggctcccttttccgttgacctggtgttcgttttccatgtgttgctgagagatggatgttaaaaatcaacaccaggactacagtaaggctgaaatcattgaagtgcttggagtgcagaactgaaagagtttcattggggatcatgtccatggagctcctcatgctgtccgactcggaccgatg

SEQ ID NO: 3332 - DNA, 203 bp, Homo sapiens
  source 1..203: mol_type = other DNA
ggcgcgccagtcctctcactgcaagctctgcctcccggttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttccccgactcggaccgatg

SEQ ID NO: 3333 - DNA, 203 bp, Homo sapiens
  source 1..203: mol_type = other DNA
ggcgcgccagtccttacatttcccagagggcctggtggcctgccacttttctcgcaggaattcgaacgtttcgtcactcctggcgggacccttagatctgggaggaaacctctctgaggtctggtcagattccaaccctggacagcagtgaacacaacctttcccctgagccactggaattggacagacgactcggaccgatg

SEQ ID NO: 3334 - DNA, 203 bp, Homo sapiens
  source 1..203: mol_type = other DNA
ggcgcgccagtcctgaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagaccgactcggaccgatg

SEQ ID NO: 3335 - DNA, 203 bp, Homo sapiens
  source 1..203: mol_type = other DNA
ggcgcgccagtcctgatacaagccatctctaaactgtgggccattcagtggacaagagaaaatttatgacattgtgtcagaaacgattgagaaagactttcctgtgtggtttggctccgtggttggacacatcagtagccccgtggtcatcctgcccgcagtactcctgcttttcatgctcatctattcgactcggaccgatg

SEQ ID NO: 3336 - DNA, 203 bp, Homo sapiens
  source 1..203: mol_type = other DNA
ggcgcgccagtcctcagccgcctctgcagcccgagatgcctgacctcagccacctcacggaggaggagaggaaaatcatcctggccgtcatggataggcagaagaaagaagaggagaaggagcagtccgtgctcaaaaaactgcatcagcagtttgaaatgtataaagagcaggtaaagaagatgggacgactcggaccgatg

SEQ ID NO: 3337 - DNA, 203 bp, Homo sapiens
  source 1..203: mol_type = other DNA
ggcgcgccagtcctgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgcgactcggaccgatg

SEQ ID NO: 3338 - DNA, 203 bp, Homo sapiens
  source 1..203: mol_type = other DNA
ggcgcgccagtcctcagattttcctcagtgtcatagtaggagctttaaatcttggcaatgcctctccttgtttggaagcctttgcaactggacgtgcagcagccaccagcatttttgagacaatagacaggaaacccatcattgactgcatgtcagaagatggttacaagttggatcgaatcaagggtcgactcggaccgatg

SEQ ID NO: 3339 - DNA, 203 bp, Homo sapiens
  source 1..203: mol_type = other DNA
ggcgcgccagtcctaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagcgactcggaccgatg

SEQ ID NO: 3340 - DNA, 203 bp, Homo sapiens
  source 1..203: mol_type = other DNA
ggcgcgccagtcctagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccaccgactcggaccgatg

SEQ ID NO: 3341 - DNA, 203 bp, Homo sapiens
  source 1..203: mol_type = other DNA
ggcgcgccagtcctaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatcgactcggaccgatg

SEQ ID NO: 3342 - DNA, 203 bp, Homo sapiens
  source 1..203: mol_type = other DNA
ggcgcgccagtcctccgcagacttgagcgatgcatcaaagagctgacctatcaggcagaggaagacaagaagaatctgagcaggatgcaaactcagatggataaacttcagctaaaagtgcaaaattacaagcagcaagtcgaggtggcggaaacacaagccaatcaatacctttccaagtataagaacgactcggaccgatg

SEQ ID NO: 3343 - DNA, 203 bp, Homo sapiens
  source 1..203: mol_type = other DNA
ggcgcgccagtccttcagccttctgaagtgaatcagaacacagcagagaatattgagaaagaaagatctatgcttccttcagaaaataacattgaaaacagcttactagcagatagaagtgatgcttgggataaaagcaaagcagaatcagctgtgaccaaacaagaccagatttctgcctctgagctcgactcggaccgatg

SEQ ID NO: 3344 - DNA, 203 bp, Homo sapiens
  source 1..203: mol_type = other DNA
ggcgcgccagtcctgtgtgctcttctacacagcttgtctcgatcccaattttccagccacgctattcaaagacaagatgaaatgcactgtgaataaccagcaatcaaagaaaatcatggtggcagcagatattgtgacgatattcaacctgatccaaatgaatggcggggctgccaaggagaagctgccgactcggaccgatg

SEQ ID NO: 3345 - DNA, 203 bp, Homo sapiens
  source 1..203: mol_type = other DNA
ggcgcgccagtcctacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatcgactcggaccgatg

SEQ ID NO: 3346 - DNA, 203 bp, Homo sapiens
  source 1..203: mol_type = other DNA
ggcgcgccagtcctagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacgactcggaccgatg

SEQ ID NO: 3347 - DNA, 203 bp, Homo sapiens
  source 1..203: mol_type = other DNA
ggcgcgccagtcctgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgcgactcggaccgatg

SEQ ID NO: 3348 - DNA, 203 bp, Homo sapiens
  source 1..203: mol_type = other DNA
ggcgcgccagtcctgtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggataccgactcggaccgatg

SEQ ID NO: 3349 - DNA, 203 bp, Homo sapiens
  source 1..203: mol_type = other DNA
ggcgcgccagtccttcatccaggagtatggagcccagagtgggggcctggagaaattgctggaaatcatcaccacgacaattgaagaaacagagacgcaaaaccaaggcatcaaagtggcggccatcagaggggaggtgacagctgcagacctgttcaactccagggtcatcgatcagaagaccctgccgactcggaccgatg

SEQ ID NO: 3350 - DNA, 203 bp, Homo sapiens
  source 1..203: mol_type = other DNA
ggcgcgccagtcctgattacactactagacgttgtgtttgtgctggatcattcaggtagcataaaaaaacaatatcaagatcacatgattaacctaactatccatttggtgaagaaagcagatgttggcagggaccgagttcagtttggagccctcaaatactctgaccaacctaacatccttttctacgactcggaccgatg

SEQ ID NO: 3351 - DNA, 203 bp, Homo sapiens
  source 1..203: mol_type = other DNA
ggcgcgccagtccttgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaacgactcggaccgatg

SEQ ID NO: 3352 - DNA, 203 bp, Homo sapiens
  source 1..203: mol_type = other DNA
ggcgcgccagtcctgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcgactcggaccgatg

SEQ ID NO: 3353 - DNA, 203 bp, Homo sapiens
  source 1..203: mol_type = other DNA
ggcgcgccagtcctcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagcgactcggaccgatg

SEQ ID NO: 3354 - DNA, 203 bp, Homo sapiens
  source 1..203: mol_type = other DNA
ggcgcgccagtcctagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaaaccgactcggaccgatg

SEQ ID NO: 3355 - DNA, 203 bp, Homo sapiens
  source 1..203: mol_type = other DNA
ggcgcgccagtcctgccattagtgctatgactcagggtcgcaggggcaacgtgtactgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctcgactcggaccgatg

SEQ ID NO: 3356 - DNA, 203 bp, Homo sapiens
  source 1..203: mol_type = other DNA
ggcgcgccagtccttaaatagctaacgtgtcgtatgtgtcatgtatgcgtccatgtcgccgccagaggagctgctgagccgccgtgcgcccgctttccaagatggctaccccttcgatgatgccgcagtggtcttacatgcacatctcgggccaggacgcctcggagtacctgagccccgggctggtgcgactcggaccgatg

SEQ ID NO: 3357 - DNA, 203 bp, Homo sapiens
  source 1..203: mol_type = other DNA
ggcgcgccagtcctggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataacgactcggaccgatg

SEQ ID NO: 3358 - DNA, 203 bp, Homo sapiens
  source 1..203: mol_type = other DNA
ggcgcgccagtcctcgcctcagccgcttttttgggggcgcgcggggaggcggcggcgacggcgacggggacgacacgtcctccatggttggtggacgtcgcgccgcaccgcgtccgcgctcgggggtggtttcgcgctgctcctcttcccgactggccatttccttctcctataggcagaaaaagatccgactcggaccgatg

SEQ ID NO: 3359 - DNA, 203 bp, Homo sapiens
  source 1..203: mol_type = other DNA
ggcgcgccagtcctgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctacccgactcggaccgatg

SEQ ID NO: 3360 - DNA, 203 bp, Homo sapiens
  source 1..203: mol_type = other DNA
ggcgcgccagtccttcattacccagggccacatccttggccaattgcaagccatcaacaaagcccgccaagagtttctgctacgaaagggacggggggtttacctggacccccagtccggcgaggagctcaacccaatccccccgccgccgcagccctatcagcagccgcgggcccttgcttcccaggcgactcggaccgatg

SEQ ID NO: 3361 - DNA, 203 bp, Homo sapiens
  source 1..203: mol_type = other DNA
ggcgcgccagtcctcccttttctggacctcccggccactacccggaccagtttattcccaactttgacgcggtgaaagactcggcggacggctacgactgaatgaccagtggagaggcagagcgactgcgcctgacacacctcgaccactgccgccgccacaagtgctttgcccgcggctccggtgagcgactcggaccgatg

SEQ ID NO: 3362 - DNA, 203 bp, Homo sapiens
  source 1..203: mol_type = other DNA
ggcgcgccagtcctagcacttctgtgccttagggttgccgcctgctgcacgcacgtttgtacctattgtcagctttttaaacgctgggggcaacatccaagatgaggtacatgattttaggcttgctcgcccttgcggcagtctgcagcgctgccaaaaaggttgagtttaaggaaccagcttgcaatcgactcggaccgatg

SEQ ID NO: 3363 - DNA, 203 bp, Homo sapiens
  source 1..203: mol_type = other DNA
ggcgcgccagtcctttccgcttgcttgtattcccctggacaatttactctatgtgggatatgctccaggcgggcaagattatacccacaaccttcaaatcaaactttcctggacgttagcgcctgatttctgccagcgcctgcactgcaaatttgatcaaacccagcttcagcttgcctgctccagagcgactcggaccgatg

SEQ ID NO: 3364 - DNA, 203 bp, Homo sapiens
  source 1..203: mol_type = other DNA
ggcgcgccagtcctcacagtttacctgctttacggatttgtcacccttatcctcatctgcagcctcgtcactgtagtcatcgccttcattcagttcattgactgggtttgtgtgcgcattgcgtacctcaggcaccatccgcaatacagagacaggactatagctgatcttctcagaattctttaattcgactcggaccgatg

SEQ ID NO: 3365 - DNA, 203 bp, Homo sapiens
  source 1..203: mol_type = other DNA
ggcgcgccagtccttagccatatatccataccttgacattggctggaatgccatagatgccatgaaccaccctactttcccagtgcccgctgtcataccactgcaacaggttattgccccaatcaatcagcctcgccccccttctcccacccccactgagattagctactttaatttgacaggtggagcgactcggaccgatg

SEQ ID NO: 3366 - DNA, 203 bp, Homo sapiens
  source 1..203: mol_type = other DNA
ggcgcgccagtccttgtgggttcttttgtcatggttcctggcggggaagtggccgcgctggtccgtgcagacctgcacgattatgttcagctggccctgcgaagggacctacgggatcgcggtatttttgttaatgttccgcttttgaatcttatacaggtctgtgaggaacctgaatttttgcaatccgactcggaccgatg

SEQ ID NO: 3367 - DNA, 203 bp, Homo sapiens
  source 1..203: mol_type = other DNA
ggcgcgccagtcctactgtcggtggtgctttttaatcacggtgaccagtttttttacggtcacgccggcatggccgtagtccgtcttatgcttataagggttgtttttcctgttgtaagacaggcttctaatgtttaaatgtttttttttgttattttattttgtgtttaatgcaggaacccgcagaccgactcggaccgatg

SEQ ID NO: 3368 - DNA, 203 bp, Homo sapiens
  source 1..203: mol_type = other DNA
ggcgcgccagtcctggccctttttacactgtgactgattgagctggtgccgtgtcgagtggtgttttttaataggtttttttactggtaaggctgactgttatggctgccgctgtggaagcgctgtatgttgttctggagcgggagggtgctattttgcctaggcaggagggtttttcaggtgtttatcgactcggaccgatg

SEQ ID NO: 3369 - DNA, 203 bp, Homo sapiens
  source 1..203: mol_type = other DNA
ggcgcgccagtcctcgctacccctcccacttagcctccttcgtgctggcctggacgcgagccttcgtctcagagtggtccgagtttctatacgaggaggaccgcggaacaccgctcgaggacaggcctctcaagtctgtatacggggacacggacagccttttcgtcaccgagcgtggacaccggctccgactcggaccgatg

SEQ ID NO: 3370 - DNA, 203 bp, Homo sapiens
  source 1..203: mol_type = other DNA
ggcgcgccagtcctcgcggaacaccgctcgaggacaggcctctcaagtctgtatacggggacacggacagccttttcgtcaccgagcgtggacaccggctcatggaaaccagaggtaagaaacgcatcaaaaagcatgggggaaacctggtttttgaccccgaacggccagagctcacctggctcgtgcgactcggaccgatg

SEQ ID NO: 3371 - DNA, 203 bp, Homo sapiens
  source 1..203: mol_type = other DNA
ggcgcgccagtcctatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctcgactcggaccgatg

SEQ ID NO: 3372 - DNA, 203 bp, Homo sapiens
  source 1..203: mol_type = other DNA
ggcgcgccagtcctaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcgactcggaccgatg

SEQ ID NO: 3373 - DNA, 203 bp, Homo sapiens
  source 1..203: mol_type = other DNA
ggcgcgccagtcctcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttcgactcggaccgatg

SEQ ID NO: 3374 - DNA, 203 bp, Homo sapiens
  source 1..203: mol_type = other DNA
ggcgcgccagtcctcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagcgactcggaccgatg

SEQ ID NO: 3375 - DNA, 203 bp, Homo sapiens
  source 1..203: mol_type = other DNA
ggcgcgccagtcctaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtcgactcggaccgatg

SEQ ID NO: 3376 - DNA, 203 bp, Homo sapiens
  source 1..203: mol_type = other DNA
ggcgcgccagtcctcctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagcgactcggaccgatg

SEQ ID NO: 3377 - DNA, 203 bp, Homo sapiens
  source 1..203: mol_type = other DNA
ggcgcgccagtcctgctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttcgactcggaccgatg

SEQ ID NO: 3378 - DNA, 203 bp, Homo sapiens
  source 1..203: mol_type = other DNA
ggcgcgccagtccttccacttggacgtgagggccgtttgccttttggaagccattgtgcaacatcttacaaatgccattatctgttctttggctgtagagtttgaccacgccaccggaggggagcgcgttcacttaatagatcttcattttgaggttttggataatcttttggaataaaaaaaaaaaccgactcggaccgatg

SEQ ID NO: 3379 - DNA, 203 bp, Homo sapiens
  source 1..203: mol_type = other DNA
ggcgcgccagtcctttgaccacgccaccggaggggagcgcgttcacttaatagatcttcattttgaggttttggataatcttttggaataaaaaaaaaaacatggttcttccagctcttcccgctcctcccgtgtgtgactcgcagaacgaatgtgtaggttggctgggtgtggcttattctgcggtgcgactcggaccgatg

SEQ ID NO: 3380 - DNA, 203 bp, Homo sapiens
  source 1..203: mol_type = other DNA
ggcgcgccagtcctcgcgtgcggttttctgggtgttttttgtggactttaaccgttacgtcattttttagtcctatatatactcgctctgcacttggcccttttttacactgtgactgattgagctggtgccgtgtcgagtggtgtttttttaataggttttcttttttactggtaaggctgactgttcgactcggaccgatg

SEQ ID NO: 3381 - DNA, 203 bp, Homo sapiens
  source 1..203: mol_type = other DNA
ggcgcgccagtccttgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgcgactcggaccgatg

SEQ ID NO: 3382 - DNA, 203 bp, Homo sapiens
  source 1..203: mol_type = other DNA
ggcgcgccagtccttactgcggctgcagccgtcagcggcgcgggacagcccgcctatgatctggaattggaagagggcgagggactcgcgcgcctgggcgcaccatcgcccgagcggcacccgcccagccgacttctccagtttacgggagcgagccctcttttttttttttgttttttgttgcccagcgactcggaccgatg

SEQ ID NO: 3383 - DNA, 203 bp, Homo sapiens
  source 1..203: mol_type = other DNA
ggcgcgccagtcctgatgatagcagcgtgttggacttgggtggaagaggagggggcaacccgttcgctcatctgcgtcccagattcgggcgcatgttgtaaaagtgaaagtaaaataaaaatgcaactcaccaaggccatggcgaccgagcgtgcgttcgttcttttttgttatctgtgtctagtacgcgactcggaccgatg

SEQ ID NO: 3384 - DNA, 203 bp, Homo sapiens
  source 1..203: mol_type = other DNA
ggcgcgccagtcctaagtgaaagtaaaataaaaatgcaactcaccaaggccatggcgaccgagcgtgcgttcgttcttttttgttatctgtgtctagtacgatgaggagacgagccgtgctaggcggagcggtggtgtatccggagggtcctcctccttcttacgagagcgtgatgcagcaacaggcgcgactcggaccgatg

SEQ ID NO: 3385 - DNA, 203 bp, Homo sapiens
  source 1..203: mol_type = other DNA
ggcgcgccagtcctagacgccgcacctgtccctacgtttacaaggccctgggcatagtcgcgccgcgcgttctttcaagccgcactttctaaaaaaaaaaaatgtccattctcatctcgcccagtaataataccggttggggactgtatgcgcccaccaagatgtatggaggcgcccgcaaacgctctcgactcggaccgatg

SEQ ID NO: 3386 - DNA, 203 bp, Homo sapiens
  source 1..203: mol_type = other DNA
ggcgcgccagtcctagtacccggaaactgccaaggcaataagtgccctgcagctgtgtttatttaatgtgacgtcatgtaataaaattatgtcagctgctgagtgttttattacttcttgggtggggacttggatatataagtaggagcagatctgtgtggttagctcacagcaacctgctgccatcccgactcggaccgatg

SEQ ID NO: 3387 - DNA, 203 bp, Homo sapiens
  source 1..203: mol_type = other DNA
ggcgcgccagtcctctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaatgactgttgacgctgcctccttgcagatcgactcggaccgatg

SEQ ID NO: 3388 - DNA, 203 bp, Homo sapiens
  source 1..203: mol_type = other DNA
ggcgcgccagtcctgcagcgccactaacattggaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaacgactcggaccgatg

SEQ ID NO: 3389 - DNA, 203 bp, Homo sapiens
  source 1..203: mol_type = other DNA
ggcgcgccagtcctgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctgagtccgggtctggtgcgactcggaccgatg

SEQ ID NO: 3390 - DNA, 203 bp, Homo sapiens
  source 1..203: mol_type = other DNA
ggcgcgccagtcctgttcctcttcgggggcagaggtggaggcgactgagatgggctgcggtctggccttggaagcggatggctggcagagcccattccgcgttcgggggtgtgctcccgttggcggtcgcttgactgatttcctccgcggctggccattgtgttctcctaggcagagaaacaacagaccgactcggaccgatg

SEQ ID NO: 3391 - DNA, 203 bp, Homo sapiens
  source 1..203: mol_type = other DNA
ggcgcgccagtccttttggagagttcgtcctcgcagccccgctcgggcggcatcggaactctccagttcgtggaggagtttactccctctgtctacttcaaccccttctccggctctcctggccagtacccagacgagttcataccgaacttcgacgcaatcagcgagtcagtggatggctatgattgcgactcggaccgatg

SEQ ID NO: 3392 - DNA, 203 bp, Homo sapiens
  source 1..203: mol_type = other DNA
ggcgcgccagtccttcgaactccccgaggagcaccctcagggtccggcccacggagtgcggattaccatcgaagggggaatagactctcgcctgcatcgaatcttctcccagcgacccgtgctgattgagcgcgaccagggaaatacaaccatctccatttactgcatctgtaaccaccccggattgccgactcggaccgatg

SEQ ID NO: 3393 - DNA, 203 bp, Homo sapiens
  source 1..203: mol_type = other DNA
ggcgcgccagtcctcttgcttatagttattcgccctagacaaagcaataaggaaaaagagaaaatgccttaacctttttactcataccttttctttacagcatggcttttgttacagctctaattattgccaacattgtcactgtcgctcacgggcaaacaattatccatattaccttaggacataatcgactcggaccgatg

SEQ ID NO: 3394 - DNA, 203 bp, Homo sapiens
  source 1..203: mol_type = other DNA
ggcgcgccagtccttctcctatgattagtcgtccccatatggctttgaatgaaatctaagatcttttttttttttctcttacagtatggtgaacaccaatcatgatccctagaaatttcttcttcaccatactcatctgtgctttcaatgtctgtgctactttcacagcagtagccactgcaagcccacgactcggaccgatg

SEQ ID NO: 3395 - DNA, 203 bp, Homo sapiens
  source 1..203: mol_type = other DNA
ggcgcgccagtcctcttcctatgcactttttgccttcgttacttgcatctgcgtgtgtagcatagtctgcctggttattaattttttccaactggtagactggatctttgtacgaattgcctacctacgtcaccatcccgaataccgcaatcaaaatgttgcggcacttcttaggcttatttaaaacccgactcggaccgatg

SEQ ID NO: 3396 - DNA, 203 bp, Homo sapiens
  source 1..203: mol_type = other DNA
ggcgcgccagtcctggatctttgtacgaattgcctacctacgtcaccatcccgaataccgcaatcaaaatgttgcggcacttcttaggcttatttaaaaccatgcaggctatgctaccagtcattttaattctgctactaccctgcattgccctagcttccaccgccactcgcgctacacctgaacaacgactcggaccgatg

SEQ ID NO: 3397 - DNA, 203 bp, Homo sapiens
  source 1..203: mol_type = other DNA
ggcgcgccagtccttgaaatcagcaataaggtctctgttgaaattttctcccagcagcacctcacttccctcttcccaactctggtattctaaaccccgttcagcggcatactttctccatactttaaaggggatgtcaaattttaactcctgtcctgtacccacaatcttcatgtctttcttcccagcgactcggaccgatg

SEQ ID NO: 3398 - DNA, 203 bp, Homo sapiens
  source 1..203: mol_type = other DNA
ggcgcgccagtccttgtagcgtcccctgctattgttcccggggggcttctggctaagcagtttggtgataatatgaaagagtatttacaactagaacttagagaagaacttagagccaagggcatgtcaattgatgatgccattcttaatttgctacaggtgacacaggagcaagatattttgacattcgactcggaccgatg

SEQ ID NO: 3399 - DNA, 203 bp, Homo sapiens
  source 1..203: mol_type = other DNA
ggcgcgccagtcctccgcgaggaactttcggtgctgttgtttaatcacgatgacaggttttacgagggtcgagctggagaccctgtggcttgtcttgtaatggaaagactgatttatccacctgttcgacaggctactatgatatgacgcttgtttcttttattttacagactaattcaaaactaatacgactcggaccgatg

SEQ ID NO: 3400 - DNA, 203 bp, Homo sapiens
  source 1..203: mol_type = other DNA
ggcgcgccagtcctctgaagacctgagacccgatcatttggtgcttgcctgcactggagcggagttcggttccagtggtgaagaaactgactaaagtgagtagtgggggcaagatgtggatggggactttcaggttggtaaggtggacagattgggtaaattttgttaatttctgtcttgcagctgcccgactcggaccgatg

SEQ ID NO: 3401 - DNA, 203 bp, Homo sapiens
  source 1..203: mol_type = other DNA
ggcgcgccagtcctgggtacgaagggaacctccagtgggggctgtatcatcgccgcctgttgctgcatcacgctctcgtaagaaggaggaggaccctccggatacaccaccgctccgcctagcacggctcgtctcctcatcgtactagacacagataacaaaaaagaacgaacgcacgctcggtcgcccgactcggaccgatg

SEQ ID NO: 3402 - DNA, 203 bp, Homo sapiens
  source 1..203: mol_type = other DNA
ggcgcgccagtcctatacaccaccgctccgcctagcacggctcgtctcctcatcgtactagacacagataacaaaaaagaacgaacgcacgctcggtcgccatggccttggtgagttgcatttttattttactttcacttttacaacatgcgcccgaatctgggacgcagatgagcgaacgggttgcccgactcggaccgatg

SEQ ID NO: 3403 - DNA, 203 bp, Homo sapiens
  source 1..203: mol_type = other DNA
ggcgcgccagtcctaccgtgtttttcacctaaatttccgcgtacggtgtcaaagtcctgtgtttttacgtaggtgtcagctgatcgctagggtatttaaacctgacgagttccgtcaagaggccactcttgagtgccagcgagaagagttttctccttcgcgccgcaagtcagttctgcgctttgaaacgactcggaccgatg

SEQ ID NO: 3404 - DNA, 203 bp, Homo sapiens
  source 1..203: mol_type = other DNA
ggcgcgccagtcctctgacgagttccgtcaagaggccactcttgagtgccagcgagaagagttttctccttcgcgccgcaagtcagttctgcgctttgaaaatgagacacctgcgtttcctgccacaggagattatcttcagtgagaccgggatcgaaatactggagtttgtggtaaataccctaatgcgactcggaccgatg

SEQ ID NO: 3405 - DNA, 203 bp, Homo sapiens
  source 1..203: mol_type = other DNA
ggcgcgccagtcctcttctataaaagcgctcggtttaaaaagcttctatgcctgaataggtgaccggaggtcggcacctttcctttacaattaatgaccctatgaatacaactgactgttttatcgctgtggtaaacgccatcaaagaggtaagagcacttttcctaccacggactgcaggaaaaatgcgactcggaccgatg

SEQ ID NO: 3406 - DNA, 203 bp, Homo sapiens
  source 1..203: mol_type = other DNA
ggcgcgccagtcctgttgggatggttggggttagccatccataccgtactgcctgatagggtccttgcgaggggatctgggagtctcgtagaccgtagcacatgcctgttatttctactcaaacaagtcctgtacctgcgcccagaacgcgcaagaacaagcagacgcaggcttcatatcctgtgtcccgactcggaccgatg

SEQ ID NO: 3407 - DNA, 203 bp, Homo sapiens
  source 1..203: mol_type = other DNA
ggcgcgccagtccttattatatatctctttgttgggtttataccacttagcttgaaagaggttaaaacattacaattcattgttaagttgaatacagcaaaatgggagctcaagtatcaacgcaaaagactggggcacatgagaccaggctgaatgctagcggcaattccatcattcactacacaaatcgactcggaccgatg

SEQ ID NO: 3408 - DNA, 203 bp, Homo sapiens
  source 1..203: mol_type = other DNA
ggcgcgccagtcctctcgcccaggagagtagagcggagagaggaagtaagaagacgcctccgggtaagggacgcccgcctttggggaaaaaccaatgcgcgtactgtaaggaggagggacattggaagaagaactgtccaaaactcgtaagcggggcaaccccagtgttggtagaagaattacaatagcgactcggaccgatg

SEQ ID NO: 3409 - DNA, 203 bp, Homo sapiens
  source 1..203: mol_type = other DNA
ggcgcgccagtccttactgtaaggaggagggacattggaagaagaactgtccaaaactcgtaagcggggcaaccccagtgttggtagaagaattacaatagggccgtcagggttcttccgccctccgtgaacccaggctaaaagttaaagtaggggggcaaataatagattttctagtagatacgggacgactcggaccgatg

SEQ ID NO: 3410 - DNA, 203 bp, Homo sapiens
  source 1..203: mol_type = other DNA
ggcgcgccagtcctcagcacccccaccgcggtaaaggtcgctgggaagaccccgtggatccaccactctcgactcaagaaagctcctgacaaccaagaagaatggactgtctcaccaacctccgatccgctgagggtaaagttgaccaggcgggcaaaaccctaattcttcttgtggtttggtgggggcgactcggaccgatg

SEQ ID NO: 3411 - DNA, 203 bp, Homo sapiens
  source 1..203: mol_type = other DNA
ggcgcgccagtcctcgcgcggcttgcgaataatactttggagagtcttttgcctccagtgtcttccgtttgtactcgtcctcctctccctctccggccgggatgggacaggcaggatcgaaggggcttttaacccctctagagtgcattctgaagaacttctctgactttaagaagagggcgggagaccgactcggaccgatg

SEQ ID NO: 3412 - DNA, 203 bp, Homo sapiens
  source 1..203: mol_type = other DNA
ggcgcgccagtccttaataataataatcttagtataaaaaagtagggagtgaccgaaagtggtgaaccgaaaacggttggtatataaagcacatagtattttgtgcaaacctacagacgccatgttcaaaaatcctgcagaaagacctcggaaattgcatgaactaagctcggcattggaaataccctcgactcggaccgatg

SEQ ID NO: 3413 - DNA, 203 bp, Homo sapiens
  source 1..203: mol_type = other DNA
ggcgcgccagtcctaatttatatacctatgtatagatggccaatgtactgttgtggaagggcaagttaattgtaagggcatttattatgtacatgaaggacatataacatattttgtaaattttacagaagaggcaaaaaaatatgggactggtaaaaaatgggaagtgcatgcgggtggtcaggtaacgactcggaccgatg

SEQ ID NO: 3414 - DNA, 203 bp, Homo sapiens
  source 1..203: mol_type = other DNA
ggcgcgccagtccttattttctgggcctgatgtacctatagagcatgcacctacacaggttttcccatttcctttggcccctacaacgccacaagtgtctatttttgttgatgggggtgatttttatttgcaccctagttattatatgttaaaacgtcgacgtaaacgtgtatcatatttttttacagcgactcggaccgatg

SEQ ID NO: 3415 - DNA, 203 bp, Homo sapiens
  source 1..203: mol_type = other DNA
ggcgcgccagtcctacaagcagaaccggacacatccaattacaatatcgttaccttttgttgtcagtgtaagtctacacttcgtttgtgtgtacagagcacacaagtagatattcgcatattgcaagagctgttaatgggctcatttggaatcgtgtgccccaactgttctactagactgtaactacacgactcggaccgatg

SEQ ID NO: 3416 - DNA, 203 bp, Homo sapiens
  source 1..203: mol_type = other DNA
ggcgcgccagtcctttactcccttgtttgttggatccactcccgaaacgttttactccttaacttattgaaattgtttgaagacaggatttcagtgtcacaatgggagctcaagtatcatcccaaaaagtaggcgctcacgagaattctaaccgagcctacggtggttctacgatcaactacaccacacgactcggaccgatg

SEQ ID NO: 3417 - DNA, 203 bp, Homo sapiens
  source 1..203: mol_type = other DNA
ggcgcgccagtcctccaatttggtctgttctgaactacaccatttactgctgtgaagaatgccctggaggcaagctggttacagccctgaccaggccctgcccgtgactctcgaccggcgcagggtcaaaaattgtctaagcagcagcaggaacgcgggagcgtttcttttccttttgtactgacatgcgactcggaccgatg

SEQ ID NO: 3418 - DNA, 203 bp, Homo sapiens
  source 1..203: mol_type = other DNA
ggcgcgccagtcctccgtgactctcgaccggcgcagggtcaaaaattgtctaagcagcagcaggaacgcgggagcgtttcttttccttttgtactgacatgatggcggcgtctaaggtgtatagagtttgcgagcagactctgctggcaggtgccgttcgcatgatggacaaattcttgcaaaagagacgactcggaccgatg

SEQ ID NO: 3419 - DNA, 203 bp, Homo sapiens
  source 1..203: mol_type = other DNA
ggcgcgccagtcctaagaggagaaatacaaatatttacatagtagagttaccacatttacatttccaaatccattcccctttgacagaaatgggaatgcagtatatgaactatcagatgcaaactggaaatgtttctttgaaagactgtcgtccagcctagacattgaggattcagaggacgaggaagcgactcggaccgatg

SEQ ID NO: 3420 - DNA, 203 bp, Homo sapiens
  source 1..203: mol_type = other DNA
ggcgcgccagtcctccctttgcaattctttttactaacactgtgtgtgtgctattttcctgccttttatatacacatatacattgtgcaaacgcaacaataatggtgatgttaacctgtcacttaaatgatggtgatacatggttgtttctgtggttgtttactgcatttgttgtagctgtacttggacgactcggaccgatg

SEQ ID NO: 3421 - DNA, 203 bp, Homo sapiens
  source 1..203: mol_type = other DNA
ggcgcgccagtccttgcagtctgggcctgacataacttttcctactgcatctatgggaacaccctttagtcctgtaactcctgctttacctacaggccctgtttttattacaggttctgacttctatttgcatcctacatggtactttgcacgcagacgccgtaaacgtattcccttattttttacagcgactcggaccgatg

SEQ ID NO: 3422 - DNA, 203 bp, Homo sapiens
  source 1..203: mol_type = other DNA
ggcgcgccagtcctagacgcacaacctttaacacaacattaccaaatactgacctgttgctgtggatgtgacagcaacgtccgactggttgtggagtgcacagacggagacatcagacaactacaagaccttttgctgggcacactaaatattgtgtgtcccatctgcgcaccaaaaccataacaaggcgactcggaccgatg

SEQ ID NO: 3423 - DNA, 203 bp, Homo sapiens
  source 1..203: mol_type = other DNA
ggcgcgccagtcctcagctggactgttctttggggccttatgtggtgtttgcctctgaggtactcaggggcatttaggtttttcctcattcttaaataataatgaacatgtctagacaaggtattttccagactgttgggagtggtcttgaccacatcctgtctttggcagacattgaggaagagcaacgactcggaccgatg

SEQ ID NO: 3424 - DNA, 203 bp, Homo sapiens
  source 1..203: mol_type = other DNA
ggcgcgccagtcctgactgttctttggggccttatgtggtgtttgcctctgaggtactcaggggcatttaggtttttcctcattcttaaataataatgaacatgtctagacaaggtattttccagactgttgggagtggtcttgaccacatcctgtctttggcagacattgaggaagagcaaatgattcgactcggaccgatg

SEQ ID NO: 3425 - DNA, 203 bp, Homo sapiens
  source 1..203: mol_type = other DNA
ggcgcgccagtcctcggcaggaacaaaccacgacggagtgctcctagaaaggcgcgggccgaggtaccaaaggcagcgtgtggagcgggaggagaagaggcctccgggtgaaggtaagtacctacaccaaaaactgtagccgaaagggcttgctatcctacctttagacaggtagaagattgtgggagcgactcggaccgatg

SEQ ID NO: 3426 - DNA, 203 bp, Homo sapiens
  source 1..203: mol_type = other DNA
ggcgcgccagtcctccttttcacgcacttcagagcaggatgtggccactcaagaattggccagacaaggggaggaaatcctctctcagctataccgacccctagaaacatgcaataactcatgctattgtaagcgatgctgctaccattgtcagatgtgttttctaaacaaggggctcgggatatgttcgactcggaccgatg

SEQ ID NO: 3427 - DNA, 203 bp, Homo sapiens
  source 1..203: mol_type = other DNA
ggcgcgccagtcctgatactggccctggccgatagcatatatacatttcctgatccgccagctgattcgcctcttgaccagactatacagcatctgcagggacttactatccaggagcttcctgaccctccaactcatctaccagaatctcagagactggctgagacttagaacagccttcttgcaatcgactcggaccgatg

SEQ ID NO: 3428 - DNA, 203 bp, Homo sapiens
  source 1..203: mol_type = other DNA
ggcgcgccagtcctccacaacagtgtaattacggccccggcactagatacgcctggaaagtactaccccaagggtttaaaaacagtcccaccctgttcgagatgcagctggcccatatcctgcagcccattcggcaagctttttcccaatgcactattcttcagtacatggatgacatcctcctagcacgactcggaccgatg

SEQ ID NO: 3429 - DNA, 203 bp, Homo sapiens
  source 1..203: mol_type = other DNA
ggcgcgccagtcctacccagagaacctctaagaccctcaaggtccttaccccgccgaccactcatacaacccccaacattccaccctccttcctccaggccatgcgcaagtactcccccttccgaaacggatacatggaacccacccttgggcaacacctcccaaccctgtcttttccagaccccggccgactcggaccgatg

SEQ ID NO: 3430 - DNA, 203 bp, Homo sapiens
  source 1..203: mol_type = other DNA
ggcgcgccagtcctccacccctttccctttcattcacgactgactgccggcttggcccacggcaagtaccgcggactctactggctcggagccagcagcagcctattctataacactctccaggagagaaatttagtacacaggtgggggctcgtccgggatacgagcgcccctttattccctaggcacgactcggaccgatg

SEQ ID NO: 3431 - DNA, 203 bp, Homo sapiens
  source 1..203: mol_type = other DNA
ggcgcgccagtcctaacagtggcttacatggtgtaatgcacaaagctgggaccactatgaaaactgggcaataaactacacttttgatttccctggaattaatgcagatgccctccacccagacctccaaaccaccccaattgtcacagacaccagtatcagcagcagtggtggtgaaagctctgaagcgactcggaccgatg

SEQ ID NO: 3432 - DNA, 203 bp, Homo sapiens
  source 1..203: mol_type = other DNA
ggcgcgccagtccttgggactttgtccccattgcattaatgtaggggcttggtataatggatggaaatttcgagaatttaccccagatttggtgcgatgtagctgccatgtgggagcttctaatcccttttctgtgctaacctgcaaaaaatgtgcttacctgtctggattgcaaagctttgtagattcgactcggaccgatg

SEQ ID NO: 3433 - DNA, 203 bp, Homo sapiens
  source 1..203: mol_type = other DNA
ggcgcgccagtcctacccatcctctctgtttgacttagttgctcgcattaaaaataaccttaaaaattctccagacttatatagtcatcattttcaaagtcatggacagttatctgaccacccccatgccttatcatccagtagcagtcatgcagaacctagaggagaagatgcagtattatctagtgcgactcggaccgatg

SEQ ID NO: 3434 - DNA, 203 bp, Homo sapiens
  source 1..203: mol_type = other DNA
ggcgcgccagtcctaatcaatgggaattactaccttagttcagtatgccgtgggaattatgacagtaaccatgacatttaaattggggccccgtaaagctacgggacggtggaatcctcaacctggagtatatcccccgcacgcagcaggtcatttaccatatgtactatatgaccctacagctacagcgactcggaccgatg

SEQ ID NO: 3435 - DNA, 203 bp, Homo sapiens
  source 1..203: mol_type = other DNA
ggcgcgccagtcctatgcggtttttacgaactcaactttcaataagattcctttgacgacgataagtcggctttttgttcagttgattataggaggacacgctaaaggaacgatttatgacagcaatgtaattcgcgtcagtcgtcggaaacgagaagacagtttactaaaaaagatgagattggagtcgactcggaccgatg

SEQ ID NO: 3436 - DNA, 203 bp, Homo sapiens
  source 1..203: mol_type = other DNA
ggcgcgccagtccttcacagaatgtatatagaggttttacctgttggttatatgaatgggcaaacccgagttctggcgtgagcattataaaacgcttcttatagaagatggcactgttggggtatttggtagatatcgtagagcagtttctttcgcctttccatatgatcgcttcatagttgttttttcgactcggaccgatg

SEQ ID NO: 3437 - DNA, 203 bp, Homo sapiens
  source 1..203: mol_type = other DNA
ggcgcgccagtccttagaagatggcactgttggggtatttggtagatatcgtagagcagtttctttcgcctttccatatgatcgcttcatagttgttttttatgtgggttatgtcgcaggtacgtagcatggagcccgaccttacgttggcggcggtctatcaggcggcggcgaatctcacagagcagcgactcggaccgatg

SEQ ID NO: 3438 - DNA, 203 bp, Homo sapiens
  source 1..203: mol_type = other DNA
ggcgcgccagtcctgagctcagcgatatttccggtatatgaccttcgtaagctgctcagtgcacttgtcatttcggaaggtagcgtcagattcgatatataatgtctttgaaggactatctgagacagtcaatttctaaagatttggaggtgagacatcgagattctttaaagattagattaggggagcgactcggaccgatg

SEQ ID NO: 3439 - DNA, 203 bp, Homo sapiens
  source 1..203: mol_type = other DNA
ggcgcgccagtcctggaagaaaggagtttgcatttggtgattgatgagacggaatatatagaagaagaaatacctttggccttgattgtgactccggtggcaccgaatccggaatttacttgtcgtgttataacagacatatgcaatctgtgggaaaataatatttgcaagcagaccagtttacaagtcgactcggaccgatg

SEQ ID NO: 3440 - DNA, 203 bp, Homo sapiens
  source 1..203: mol_type = other DNA
ggcgcgccagtcctcatcgctgcgcgaaccagttttatcggctgcctgacgttttcaaaactcaccgccgagtcggcttgagaataaacggtgacattgtccggaaatcttacatcggacaaactctggccgaaccactctgagaacagagtatcgttctgaaacctgttctccatcacagagctggtcgactcggaccgatg

SEQ ID NO: 3441 - DNA, 203 bp, Homo sapiens
  source 1..203: mol_type = other DNA
ggcgcgccagtcctaaaaaaaacgatattattgttgccgttgtcgtgtgatcatccatatcgttctttttgggtgtacattgtgacaagtttcttttgtgactatattatctttcattttttttttgcgagttgcaacttttgcttactaagttttgagtgctatttctctgtcgctgtgagcccgtacgactcggaccgatg

SEQ ID NO: 3442 - DNA, 203 bp, Homo sapiens
  source 1..203: mol_type = other DNA
ggcgcgccagtcctgcgttgtggattgtttgacctttgaaaaaatttttgtgtccgtgtagcatttcaataaaagtcattatctgctcagagggataaatcatgtctatctcttcgttgttcggaggtagatacgataataagtttttgcttaacatgtcttcggctcccaaaatagagttgattgtacgactcggaccgatg

SEQ ID NO: 3443 - DNA, 203 bp, Homo sapiens
  source 1..203: mol_type = other DNA
ggcgcgccagtcctaagctacaacaggtcaacgttcgagtagacgtaaattccatatgtcgaatgcgctgtaaactttttcacggaacatcaaaaacaccgaatttattcacgtttacataagcatgaatctgcaattttaatagtcccataaagctttcatttcgatctaactacattttagtatttcgactcggaccgatg

SEQ ID NO: 3444 - DNA, 203 bp, Homo sapiens
  source 1..203: mol_type = other DNA
ggcgcgccagtcctccgtctcctgcaatttgaattctgctcgtttgtttttttctgcgacaaaaaaataaacgctgtctcagatatatacttacttgagtgatggagttattggaccacgacatttataagggacccgttcgagaacgggtcacgtataccattcccaaccatccctatctctcgctgcgactcggaccgatg

SEQ ID NO: 3445 - DNA, 203 bp, Homo sapiens
  source 1..203: mol_type = other DNA
ggcgcgccagtcctatctattaagcttgaattttataaacatgttttccagaacaaaaatccaaacaagcaaatgctcataacgacgttgtccaccaagccatgaaattatccggactataccatgatgcggacgtcacacatagacaaccattgagtgagaatacgcatcaagatcccatatcttctcgactcggaccgatg

SEQ ID NO: 3446 - DNA, 203 bp, Homo sapiens
  source 1..203: mol_type = other DNA
ggcgcgccagtcctgtgctggtgaagctgggcgattgtctactgacttttttgcgtgtgggatttgccagactttttgcggactgcggttatgagaagattggaaaaatatccatgcgcttcggacggatgtcgacgttgggcatgtcggagacttatcaatcgtgcatgagcctcagtaagtagttccgactcggaccgatg

SEQ ID NO: 3447 - DNA, 203 bp, Homo sapiens
  source 1..203: mol_type = other DNA
ggcgcgccagtccttcgttattcgtaagtgggtacaatgaaaaaaaatcaacactgccttaatgtatgcaccctcaagagtgctgattggatagagatataatgatatataaaaaagtgcatgatgaacaaaaaagtttgtttttccataaatttaaatgtcagtgggtgccgcggttagggtctttccgactcggaccgatg

SEQ ID NO: 3448 - DNA, 203 bp, Homo sapiens
  source 1..203: mol_type = other DNA
ggcgcgccagtcctagacggtgaaatgtaagtgtcgttctatctactcggggaaaatgtcaccacgggtaaacttgaatgattaatacaccattttctcgtgtgtgcgtgtatgtggatgtatacgcgtatagtatgcgtaataacacaggacatcgccggttaatctataacttgatatttgttcagcgactcggaccgatg

SEQ ID NO: 3449 - DNA, 203 bp, Homo sapiens
  source 1..203: mol_type = other DNA
ggcgcgccagtcctgtgtgcgtgtatgtggatgtatacgcgtatagtatgcgtaataacacaggacatcgccggttaatctataacttgatatttgttcagtctgtttcaaaatgcaggccagaaattttgtcgacctttcacggacaatagaacaattgtatatactatgcaagaccaagttcaaagcgactcggaccgatg

SEQ ID NO: 3450 - DNA, 203 bp, Homo sapiens
  source 1..203: mol_type = other DNA
ggcgcgccagtccttggccctaccgctacccctctttcaacccctcaccatcacccaacccgctgccccacccacatcccccccaccgccaccgctaccgtcacctctgaacttcacctttttcctccatctcgccccacttctctctacatttctccgcccctctattcttactcctgttttctaggcgactcggaccgatg

SEQ ID NO: 3451 - DNA, 203 bp, Homo sapiens
  source 1..203: mol_type = other DNA
ggcgcgccagtcctcacctctgaacttcacctttttcctccatctcgccccacttctctctacatttctccgcccctctattcttactcctgttttctaggatgccgctgacggcgcgtgccggccacaccctgcatcgtcttccgctctcccactattggtggcttctgttgggtcgacactcccttcgactcggaccgatg

SEQ ID NO: 3452 - DNA, 203 bp, Homo sapiens
  source 1..203: mol_type = other DNA
ggcgcgccagtcctagtttagtgatgcactgccacttctcatcaaaattgtccataaatttcaagtttttcaccatgtcagcaatctgatcggctctgacgtaggtggaaggatacttgtaagtttcatactcataatctatcagtctgttccacactacgcagtccgaagagggatgtagtcctttacgactcggaccgatg

SEQ ID NO: 3453 - DNA, 203 bp, Homo sapiens
  source 1..203: mol_type = other DNA
ggcgcgccagtccttaggtggaaggatacttgtaagtttcatactcataatctatcagtctgttccacactacgcagtccgaagagggatgtagtcctttaatgccaaatctagctgctgcggttccctgcagaccgttcgtcaacctagcgcaggagacgggaacgacaaacctgctggtagcgggccgactcggaccgatg

SEQ ID NO: 3454 - DNA, 203 bp, Homo sapiens
  source 1..203: mol_type = other DNA
ggcgcgccagtcctcggatagcaggagtcggtcgatcgtctcgctccgcttggttttccgtgtcacggcgcgcgcatagactccgttaatctcggcggccgatgtctcgcgtgttctcgtgcgtgctccgcgcgtgtgtatgtgccggcctctgctgctgggtgtgtatgggggtgatatgcggtgaccgactcggaccgatg

SEQ ID NO: 3455 - DNA, 203 bp, Homo sapiens
  source 1..203: mol_type = other DNA
ggcgcgccagtccttcatgacaaggatctcgaaatataaaaccaaaaaaaaagtgaggagtgcgtaatcgcaagaaaagaaaaaacagagccgcggtggaaatgtctatccgcctgcgtgtatgtgtggggtgtgtatatgtgcgcgtgaccgtatccctccctgcctttaacccgatgagaaataaacgactcggaccgatg

SEQ ID NO: 3456 - DNA, 203 bp, Homo sapiens
  source 1..203: mol_type = other DNA
ggcgcgccagtcctaggaagattttcataattccgaggaaatgaaggtgtttgttgtccaacattcgcaggaaatcgttggtggaacggatttttctgtacatgcggaggaaagcgtgtgagtcaaaacgggggttgaaatttaataaagtttgtcacaccactctcttttttccaatttcctgtcatcgactcggaccgatg

SEQ ID NO: 3457 - DNA, 203 bp, Homo sapiens
  source 1..203: mol_type = other DNA
ggcgcgccagtcctgatctcgctgaagccgtcttgtatgtgactatttccatctgtttttagtggcgcttcgagttcgttttttctgaagtggatctgccgatggctgttagaaagttatggaagacagtcgtacagctgttttctaaatcgaaatccgaggagtgcaatacagaagccggaacgatgcgactcggaccgatg

SEQ ID NO: 3458 - DNA, 203 bp, Homo sapiens
  source 1..203: mol_type = other DNA
ggcgcgccagtcctgaaaatttgtaagacgctgaactttgtctcgatctagccacgcaaacgggatcgactgcgctttcaaatccatcttttagaaaacaaactcaaaaacaaaactgctcgtcttcgccaagactcaatgtttaatagtcctttttttacccacacagaaagctgacaagcgacgagcgactcggaccgatg

SEQ ID NO: 3459 - DNA, 203 bp, Homo sapiens
  source 1..203: mol_type = other DNA
ggcgcgccagtcctactcaaaaacaaaactgctcgtcttcgccaagactcaatgtttaatagtcctttttttacccacacagaaagctgacaagcgacgagatggacactgtcattgagctgtccaaactcctggtaagtctccagagatcattgttaccgaatattttattgtagcgtaccatgacacgactcggaccgatg

SEQ ID NO: 3460 - DNA, 203 bp, Homo sapiens
  source 1..203: mol_type = other DNA
ggcgcgccagtcctaattcttaaagcgtgtgattcagtatctgtttttataatacggagagctgccgagctgagcggaacagagctttggctgtgacgaggatggatgtgtggaagcgtcaacggcttcaagaatgccgtgaactgtgtcctttgcctgcattaatgtcactgtcgaatatcttgtcacgactcggaccgatg

SEQ ID NO: 3461 - DNA, 203 bp, Homo sapiens
  source 1..203: mol_type = other DNA
ggcgcgccagtcctagtttcaaatttgtttctattgtattccacagagatgcggcagattttttggaagaaattgcaaacgatctgtgaattctaaatatcatgaagaagttaactatggagtccttgttagtttatacctttgtaatgggagtctgctttacatcgaatctcacatgcgagcaaaaacgactcggaccgatg

SEQ ID NO: 3462 - DNA, 203 bp, Homo sapiens
  source 1..203: mol_type = other DNA
ggcgcgccagtcctgtaatgtttcctttccgagcggtgtgcagttacaattactaaatcaatcggtgatggagtcaattagaactaaaacgtatgtagtggattacgctaggaaaactacagagagaggtgattgcttcatttctgtagcattctgccgaaaagaaagaagacgctttttaccccgctcgactcggaccgatg

SEQ ID NO: 3463 - DNA, 203 bp, Homo sapiens
  source 1..203: mol_type = other DNA
ggcgcgccagtccttgggatgaagagaataaaccggatgtgcaaatcaggagggatgcaaagacttgcagatgaggctcccatagattgttactagtgattatggtgcctcagggttggagtttagcatgggtgagtgtattatacgtgtcggtgataccgtctttgcatattattaacaatgaaaatcgactcggaccgatg

SEQ ID NO: 3464 - DNA, 203 bp, Homo sapiens
  source 1..203: mol_type = other DNA
ggcgcgccagtcctactctattccccattcctagaagtgccgaggaactctgggaaggaacatacactctcgtagtcgcatttgtgctcgcatttctcgtctactccgattatcttagtaatttaagtccgtttggagaaattttgtcctcgccgtgtatttcaacgtgaatcttcgtcgggaagaggcgactcggaccgatg

SEQ ID NO: 3465 - DNA, 203 bp, Homo sapiens
  source 1..203: mol_type = other DNA
ggcgcgccagtcctgaacgaagacggaagtgcgttggcatcaaaacaggaaacgcaatataaaataaccaactacatggttcccactaaaaacgggactgcgggctctagcttatttaatgagaaagaagatagcgagagcgacgattccatgcattttgaatacagctccaatcctaagagacagagcgactcggaccgatg

SEQ ID NO: 3466 - DNA, 203 bp, Homo sapiens
  source 1..203: mol_type = other DNA
ggcgcgccagtcctctatcggctgccagggataaaatctcgatttttgccgtagcggctagtaatgattctggggacgtgctgtttttgagtgaactaagaatgaactctaaatcgagtgcacgagctgccattgtggatactgtggaagctgtgaagaagagaaaatatatatctatcgaggcgggacgactcggaccgatg

SEQ ID NO: 3467 - DNA, 203 bp, Homo sapiens
  source 1..203: mol_type = other DNA
ggcgcgccagtcctggttcccagtctggctctaggaaaatctcttttaataccgtaagcccgtgaatgttttctttgttagcgtcatagacatttccttgcatgacgcatgacaacagacaactgctgccgcaagaaactaagctcgtcacaccaaacaaagacactttgtcttccaggtacttacaccgactcggaccgatg

SEQ ID NO: 3468 - DNA, 203 bp, Homo sapiens
  source 1..203: mol_type = other DNA
ggcgcgccagtcctctgtgcatctctacaacgtgaccgtcaagaagttgttacggcttgtttcacacggttctgattttcagtgtcagcattgtcagcattcgtttagagagacttgcttagatctggaagactgtgttaatatctgtcaaggttgtcagatttcccaaaacgtgaggtgtatttgaacgactcggaccgatg

SEQ ID NO: 3469 - DNA, 203 bp, Homo sapiens
  source 1..203: mol_type = other DNA
ggcgcgccagtcctcgtttagagagacttgcttagatctggaagactgtgttaatatctgtcaaggttgtcagatttcccaaaacgtgaggtgtatttgaaatgacgaccatacgtggtgatgatttgtcgaatcagatcactcagatttcaggaagttcttcaaaaaaagaggaggaaaagaagaagcgactcggaccgatg

SEQ ID NO: 3470 - DNA, 203 bp, Homo sapiens
  source 1..203: mol_type = other DNA
ggcgcgccagtcctccggtgtgaagttttcgagactaagtgaaaggcattgtcgggttgcgattgtcagcatctgctttcttttagccttgtatttttgttatgttctacttaaaaaaactcctacgccagcttctggccccgttgtgtaaacatgggccgtacactcatttgcaattgtttgtgatgcgactcggaccgatg

SEQ ID NO: 3471 - DNA, 203 bp, Homo sapiens
  source 1..203: mol_type = other DNA
ggcgcgccagtccttaaaacacgacctcaaactcccttccctgctcacagacttgctcatacaaaagttcaagattcgtcttttcaggtgaggagtccatcatgtacaaaggatgggactcagaagcgttgtctatacaatctgagatagtaaacgagattctgttatattgctacctcactccccaacgactcggaccgatg

SEQ ID NO: 3472 - DNA, 203 bp, Homo sapiens
  source 1..203: mol_type = other DNA
ggcgcgccagtcctgtcttctgagtctcatgcctcaaaacctagtttgatagacaggatcaggtatagaggttataagagtgtaaatgtagaagaagcgtgatggattcggtgtcattttttaatccatatttggaagcgaatcgcttaaagaaaaaaagcagatcgagttacattcgtatacttcctcgactcggaccgatg

SEQ ID NO: 3473 - DNA, 203 bp, Homo sapiens
  source 1..203: mol_type = other DNA
ggcgcgccagtcctatcaagcaagcggtgtattaaaatgtgatgaaacggaaaccgaaacggatgagccgatgactaagaaaaaccgattataatcagagtatgaattcgttacaatctctgtgtgtgttgtgcgctaggcttaatgaatgtgctttggaccttgaatgtttaaagttttgtgatcctcgactcggaccgatg

SEQ ID NO: 3474 - DNA, 203 bp, Homo sapiens
  source 1..203: mol_type = other DNA
ggcgcgccagtcctaatcgtcgaaaacaatttcccataacaccccaataccctaagggcatttaaagccaaattcatctgtaatcaacagagctctacacaatgaccatcgtagtgtttgcgactgaatacgatgccgcaaacgtcatttttagtatcctatgtagaagtcccagtgaacatttaatccgactcggaccgatg

SEQ ID NO: 3475 - DNA, 203 bp, Homo sapiens
  source 1..203: mol_type = other DNA
ggcgcgccagtcctgatgtccacgtttcgaaagacgaaaaattcaatgtatcttgagctcgtttgtctctgtagggtaatcgtttcagagatcttttctgaaattacgctgtacatttttccaggtgacagagggctgtctgctgttaatcacgtcgacgcgaagactagttcaaaataacacttaagcgactcggaccgatg

SEQ ID NO: 3476 - DNA, 203 bp, Homo sapiens
  source 1..203: mol_type = other DNA
ggcgcgccagtcctccgattagcgcccgataaattactagtaagaacattaagatagccagggcattcacaatcgcagtccagcacagcatgcatttggaggtcatcgtccaaccctataaaaaaagcaaatactattttagttacacattctccttgtaaaaattcactgtggtcaactcacccgaccgactcggaccgatg

SEQ ID NO: 3477 - DNA, 203 bp, Homo sapiens
  source 1..203: mol_type = other DNA
ggcgcgccagtccttaatctatttaatatggaaagatcaaaaagtgttcaactttcaaagaatagcagaaccctttcacatttcatcgatgaagaacaactatgctcttccgactctgggtctttgttctgttgactccctgttacagttggagaccgtggaccatatcggacgagagccattgtaaacgactcggaccgatg

SEQ ID NO: 3478 - DNA, 203 bp, Homo sapiens
  source 1..203: mol_type = other DNA
ggcgcgccagtcctctatttcgttcttggatcaatatttaattgcagacgaggttttgtggaacgttgttcccgtaatttgttttttcaggcagtggggactcaagttagatttttttaaaaagttttcggggaagaccaagcggttgtcattttcgtttatatgtgatttgttcgctaggtctcaggcgactcggaccgatg

SEQ ID NO: 3479 - DNA, 203 bp, Homo sapiens
  source 1..203: mol_type = other DNA
ggcgcgccagtcctggacacgttgcgcgacggagatgcgggagttgacacttcgtgatcccgccctcgtctgttgctgtagttgatgctgttgctgttgttgtagtggtcgttttcgtggttgtctttgtcctatgttaacattgtgagaacagcgcataaataaaatggtttttttgtgtgtattttcgactcggaccgatg

SEQ ID NO: 3480 - DNA, 203 bp, Homo sapiens
  source 1..203: mol_type = other DNA
ggcgcgccagtcctgtagtggtcgttttcgtggttgtctttgtcctatgttaacattgtgagaacagcgcataaataaaatggtttttttgtgtgtattttatgtgtgtatttttttgtgtgtgtatttttttgtgtgtgtatttttttgtgtgtatttttttgtgtgtatttttttgtgtgtgtattcgactcggaccgatg

SEQ ID NO: 3481 - DNA, 203 bp, Homo sapiens
  source 1..203: mol_type = other DNA
ggcgcgccagtcctatgttttaatgtcattgaaaatatttagaggtgcttcgattttaggtaaaatttcggtcgcctgccaattttccatgtttcggcgttatgcagcacaccggtaattgtgaaactttaatagttaattcatgttttggttccacttgtgcacggtcgattccagtttttatagatcgactcggaccgatg

SEQ ID NO: 3482 - DNA, 203 bp, Homo sapiens
  source 1..203: mol_type = other DNA
ggcgcgccagtcctaaatacacacaaaaaaatacacacacaaaaaaatacacacacaaaaaaatacacacataaaatacacacaaaaaaaccattttatttatgcgctgttctcacaatgttaacataggacaaagacaaccacgaaaacgaccactacaacaacagcaacagcatcaactacagcaacgactcggaccgatg

SEQ ID NO: 3483 - DNA, 203 bp, Homo sapiens
  source 1..203: mol_type = other DNA
ggcgcgccagtccttatacccacgttttagtgggtgggacttaaaagaaatgggtggagggatataggggtgtgtcttcgttggtaccaattataaaaatgtactcgccacaactcacaatttagaacgcatggcagttctgctacgtgtttggatgcccggacattagaatacagccagttgttacccgactcggaccgatg

SEQ ID NO: 3484 - DNA, 203 bp, Homo sapiens
  source 1..203: mol_type = other DNA
ggcgcgccagtcctttatcattaagaatatttacacggtgacgacacggggaggaaatatgcggtcgaggggggggcacaacacgttttaagtactgttggaactccctcaccaaccgcaatcgcaatcctttgaaggctgcgagagcgtttggaaaactcgggtacgtctaaattcaccccagtgcgcgactcggaccgatg

SEQ ID NO: 3485 - DNA, 203 bp, Homo sapiens
  source 1..203: mol_type = other DNA
ggcgcgccagtcctaactccctcaccaaccgcaatcgcaatcctttgaaggctgcgagagcgtttggaaaactcgggtacgtctaaattcaccccagtgcgatggatacgccgccgatgcagcgctctacaccccaacgcgcggggtcgcctgatactttggagttaatggacctgttggacgcggcccgactcggaccgatg

SEQ ID NO: 3486 - DNA, 203 bp, Homo sapiens
  source 1..203: mol_type = other DNA
ggcgcgccagtcctaaggggcaggcgtgtataagagggcccctgtttaatacgcggtctgccgtgtttggatatttcacgaccctatcgtttatttacgtaatggcatcttccgacggtgacagactttgtcgctctaatgcagtgcgtcgtaaaacaacgcctagttattccggacaatatcgaacccgactcggaccgatg

SEQ ID NO: 3487 - DNA, 203 bp, Homo sapiens
  source 1..203: mol_type = other DNA
ggcgcgccagtcctcaacccaatcgaaggtctcccgccccggaatcccccattgccattttacccaagtagccttattcatagatgtaaacgtttgggtgtgtgttttgttgtgcagggttcgtccgattcataacgcgacagcgtcgagtcggttttaagggaaaaggttactacggccccaaggaccgactcggaccgatg

SEQ ID NO: 3488 - DNA, 203 bp, Homo sapiens
  source 1..203: mol_type = other DNA
ggcgcgccagtcctgtgttttgttgtgcagggttcgtccgattcataacgcgacagcgtcgagtcggttttaagggaaaaggttactacggccccaaggacatgttttgcacctcaccggctacgcggggcgactcgtccgagtcaaaacccggggcatcggttgatgttaacggaaagatggaatatcgactcggaccgatg

SEQ ID NO: 3489 - DNA, 203 bp, Homo sapiens
  source 1..203: mol_type = other DNA
ggcgcgccagtcctgatataccgcccccccatggcgtgtagtctttataaataaatacaatggtttggctcgtgtctttttttgatgtctgtctgtgggggagtggggtgttgtggatattagagggtagagggtgctggtttgaacgtctccattaacccacggggtccccacacgggccgtgtggtcgactcggaccgatg

SEQ ID NO: 3490 - DNA, 203 bp, Homo sapiens
  source 1..203: mol_type = other DNA
ggcgcgccagtcctataaataacataaccaatagaaacttaatacagagtcacgccccattacaacaaggataaaacacgggatcattttcttaacattgtagtagcgctgaaaagcgtcccctcccccggctcacagagctgctcttcggtgtagttgggtatactggtgcgcctcatttaatcgcgcgactcggaccgatg

SEQ ID NO: 3491 - DNA, 203 bp, Homo sapiens
  source 1..203: mol_type = other DNA
ggcgcgccagtcctctggtatacacgagagcagtccatggttttagacctcgggcgaattgcgtggttttaagtgactatattccgagggtcgcctgtaatatggggacagttaataaacctgtggtgggggtattgatggggttcggaattatcacgggaacgttgcgtataacgaatccggtcagacgactcggaccgatg

SEQ ID NO: 3492 - DNA, 203 bp, Homo sapiens
  source 1..203: mol_type = other DNA
ggcgcgccagtcctaaaatattaagggttgtgatttttttcattaggatgaaaagaacgtttcctagccacacccacaaaggagtttgtaaaataaaatctctgtttagaccttaaaatttgttgtgtgtgttgtgtggggggtccgtgaggatcgacctttacaagatataatttgtccatatcgcacgactcggaccgatg

SEQ ID NO: 3493 - DNA, 203 bp, Homo sapiens
  source 1..203: mol_type = other DNA
ggcgcgccagtcctggatgggattttttgccgggaaacccccccccgccagcctttaacaaaacccgcgccttttgcgtccacccctcgtttactgctcggatggcgaccgtgcactactcccgccgacctgggaccccgccggtcaccctcacgtcgtcccccagcatggatgacgttgcgaccccccgactcggaccgatg

SEQ ID NO: 3494 - DNA, 203 bp, Homo sapiens
  source 1..203: mol_type = other DNA
ggcgcgccagtcctcggatcgggttaaacaaacatattaacgaaactcgtgtgtttacatatgattactttttctatagtaaacattttaagtagtaaattatggatttgaggtcgcgtacagacgatgctttggacatggaattgcatgcgggttttgacgccccagaaatcgccagagctgttttacgactcggaccgatg

SEQ ID NO: 3495 - DNA, 203 bp, Homo sapiens
  source 1..203: mol_type = other DNA
ggcgcgccagtccttgtaattaacacaagatcacatcgaagaattactgaagccgctgtgaaacctttcacaagacgatataaacttggttaagtgtattgatggggctctttggactgacacgctttatccatgaacataaactggttaaacccagcatcatttcaacgccacccggagttttaacccgactcggaccgatg

SEQ ID NO: 3496 - DNA, 203 bp, Homo sapiens
  source 1..203: mol_type = other DNA
ggcgcgccagtcctgcggggttgggtgagcctataaattctacaacattggcggaagatacaggcaactgcaaacacgcaattgtcagatattttgcagccatggcctctgcttcaattccaaccgacccagacgtgtctactatttgtgaagactttatgaatttgctaccagacgaaccttcggatcgactcggaccgatg

SEQ ID NO: 3497 - DNA, 203 bp, Homo sapiens
  source 1..203: mol_type = other DNA
ggcgcgccagtccttttgtggtttttattgactgggcgtttcgtttgtataacgctgttgttgctagtattttcataacctcctaggtttttggagctacacgtgcttattcaacgctctttgggatttgaatcatcgtaaacgtagcgtccctaccagttgagcgcgtaattttcgtaagcaataaacgactcggaccgatg

SEQ ID NO: 3498 - DNA, 203 bp, Homo sapiens
  source 1..203: mol_type = other DNA
ggcgcgccagtcctgaagtacctaattatccaaatttaacttcgagttaacaccaaccgtgtgatactacatcgtgcttgaattgccatcttccacgggtcatgcaggctttaggaatcaagacagaacattttataattatgtgtctacttagcggacatgctgtttttaccctatggtataccgctcgactcggaccgatg

SEQ ID NO: 3499 - DNA, 203 bp, Homo sapiens
  source 1..203: mol_type = other DNA
ggcgcgccagtcctgtcatggccaaatttctagatttgcatgaaatattgaaggatgcttaatacatggggaaaataaacgcattaataagtcgtcagggggtggatcactccaaactcctcctatatcccacgataaatggtctaaatacttcacgcgtgtgccttggtttgcaaccttagatcaatcgactcggaccgatg

SEQ ID NO: 3500 - DNA, 203 bp, Homo sapiens
  source 1..203: mol_type = other DNA
ggcgcgccagtcctataatccattcacagcggttaaagcctcttggaggcggagcagggcggctccttgggggtgcgtgtttacacgcacctcttcataagatggctcttcagttggtattcgagcatatccacataagctggcacacaccgtctgcatgattgactggctttccaacgtattgaactcgactcggaccgatg

SEQ ID NO: 3501 - DNA, 203 bp, Homo sapiens
  source 1..203: mol_type = other DNA
ggcgcgccagtcctccgagaatgtaacgggggtgtaaatagccagggggtttgttttaatttattaataaaaatgtgtattacgttactcatgtgtctccattacgcatcacagggggtatttatacccgataatatacaaaacgcgttttgtacctctaccgcacccgatatcttaacggggttattcgactcggaccgatg

SEQ ID NO: 3502 - DNA, 203 bp, Homo sapiens
  source 1..203: mol_type = other DNA
ggcgcgccagtcctgcgttgggtgttggggaatcaaatgaagattgtgaaaagactgttccgcatttaaaggttacgcagttgtgtaggaacgacagcgatatggcttctgtagcaggtaacgctagtaatatctcaccacagcccccgtcgggcgttccaaccggaggggaatttgtactgatacctcgactcggaccgatg

SEQ ID NO: 3503 - DNA, 203 bp, Homo sapiens
  source 1..203: mol_type = other DNA
ggcgcgccagtccttcttctatattttgtctgtttgggtgtcattcctcagtttgcctccacaccgtgagtattcactatcgggtccgtggggtgtttataatggctgctgaagctgacgaagagaactgtgaagcgttatacgtggctgggtatttagccttatattcaaaggacgaaggggaattacgactcggaccgatg

SEQ ID NO: 3504 - DNA, 203 bp, Homo sapiens
  source 1..203: mol_type = other DNA
ggcgcgccagtcctgggatgttttcccatgggtaagaaaacagcttttaaagcagtaccggtttatattcacgccagttgactttgtttgctgcagacaccatgacggcgagatatgggttcggatctatctcgtttccgaataaatgtgggatatttttgtctaccactaagaactttatagccccccgactcggaccgatg

SEQ ID NO: 3505 - DNA, 203 bp, Homo sapiens
  source 1..203: mol_type = other DNA
ggcgcgccagtcctttggtgttattgcaaagtggtgtaaaaattcttcggcggcggttgtttttccaattccatacgccccgtccaaataaatacgcaaaacgcccatttttacatcggttttatccgttgacatgtttattgtagacaaacgcgtcttaggttatcttctgggacggaacttcaaatcgactcggaccgatg

SEQ ID NO: 3506 - DNA, 203 bp, Homo sapiens
  source 1..203: mol_type = other DNA
ggcgcgccagtccttgaacgcgtccgcgaaacctcgacgtacgttatcaatatcctttttgagtacatcgtaaaaacgagtgtggcaacgttgtcccaaacgaaaacacttggcccgaattcgactagcggacatatttgaagttccgtcccagaagataacctaagacgcgtttgtctacaataaaccgactcggaccgatg

SEQ ID NO: 3507 - DNA, 203 bp, Homo sapiens
  source 1..203: mol_type = other DNA
ggcgcgccagtcctgaaaacacttggcccgaattcgactagcggacatatttgaagttccgtcccagaagataacctaagacgcgtttgtctacaataaacatgtcaacggataaaaccgatgtaaaaatgggcgttttgcgtatttatttggacggggcgtatggaattggaaaaacaaccgccgcccgactcggaccgatg

SEQ ID NO: 3508 - DNA, 203 bp, Homo sapiens
  source 1..203: mol_type = other DNA
ggcgcgccagtccttctcatattcggtgtggacctaaggttggcgatcacacgatcacgggacggcaagttcgaggttaatgttccgataaacgctttaatatggaatttccatatcattcaaccgtatcttataacggcgtaacgttttattttaacgagcgtgctaccagggcgtattttatatgccgactcggaccgatg

SEQ ID NO: 3509 - DNA, 203 bp, Homo sapiens
  source 1..203: mol_type = other DNA
ggcgcgccagtccttttactttggactataaactgcgactgaacgttatgaacccaccccaagcccgcgtctcggaacagacaaaggacttgcttagcgttatggttaaccagcaccccgaagaggacgcaaaagtgtgtaaatccagtgataattcaccgctttataacaccatggttatgttatcgcgactcggaccgatg

SEQ ID NO: 3510 - DNA, 203 bp, Homo sapiens
  source 1..203: mol_type = other DNA
ggcgcgccagtccttaaatgtactataattgttcagtctaaaaataatgttgggtatttataattaccgcccccgtgttacttggaaacacccatacatatgttccactctacatcaaacttctcgcagttttcttgttcccgcacacgtttacacgtccggattcaagtcgcaacgctgctgacaaacgactcggaccgatg

SEQ ID NO: 3511 - DNA, 203 bp, Homo sapiens
  source 1..203: mol_type = other DNA
ggcgcgccagtcctccaatatctgattcgagacgcgtcgccccttaggggatgtcttcctcttccgcgataatttcaccacgcccacatacccactcccaataaaagccctgtagagcgcattggcatcttacttgagatttggatacgctcggccgacttggtctgtttcacgcttccttaaacaaccgactcggaccgatg

SEQ ID NO: 3512 - DNA, 203 bp, Homo sapiens
  source 1..203: mol_type = other DNA
ggcgcgccagtccttgacacggttacgcctatgagaagcgtaggttggagtgtggcctgacatgaccaaagtgaatgaatgcggccctgaaaatgtttatgatatatacgtaacgagtacgtaagatgacgcggcttcctgttttactgcttacaagagatgaggcggattccgtgaattgatgttaacgactcggaccgatg

SEQ ID NO: 3513 - DNA, 203 bp, Homo sapiens
  source 1..203: mol_type = other DNA
ggcgcgccagtccttgtatccttaaataccacgtacgtaaaaaatgtttgaatacgtacatatttcttttttttttccagtacaaccatatccggtgtataatggaagcccatttggcaaatgaaaccaaacatgcactttggcataatgatcacacaaaaggattactacacgttgtgatacctaaccgactcggaccgatg

SEQ ID NO: 3514 - DNA, 203 bp, Homo sapiens
  source 1..203: mol_type = other DNA
ggcgcgccagtcctaacccccataaataaattagtgtcactataaaaacataacaccagaatctcttcatatgtaattttacgtcatttctcccgtttccaccccctcttaaaatataaaataaccgggtgggtggcattaaacccacaagtacccgggcggcaatccgctagactgtttttctgctccgactcggaccgatg

SEQ ID NO: 3515 - DNA, 203 bp, Homo sapiens
  source 1..203: mol_type = other DNA
ggcgcgccagtcctatcttacagattcttcaccaagcgtacgaccaaacattatcaatgacatttaacatcaattcacggaatccgcctcatctcttgtaagcagtaaaacaggaagccgcgtcatcttacgtactcgttacgtatatatcataaacattttcagggccgcattcattcactttggtccgactcggaccgatg

SEQ ID NO: 3516 - DNA, 203 bp, Homo sapiens
  source 1..203: mol_type = other DNA
ggcgcgccagtcctgcctatcgaagttgatgtgcctagagtgacacaaatacttaaagacacaggaaacaacgcgattacatcagcattgcggtcattgcgatgggacaatcttcatccagcggtcgaggaggaatctgtggattgtgcaaacggtacaacgagcttgttacgtgcaacggagaaacccgactcggaccgatg

SEQ ID NO: 3517 - DNA, 203 bp, Homo sapiens
  source 1..203: mol_type = other DNA
ggcgcgccagtcctgtttgtgacataccaggttttattagttttactggaacatccaattgcagttccaggctaattcccgggtgggtgtgtttaatccacgaaaccagatcccctccatataacgcccgcgcgagctgtgtactggacgcatagacggcggcgttgctctccccggtgttgggagaccgactcggaccgatg

SEQ ID NO: 3518 - DNA, 203 bp, Homo sapiens
  source 1..203: mol_type = other DNA
ggcgcgccagtcctgaaaccagatcccctccatataacgcccgcgcgagctgtgtactggacgcatagacggcggcgttgctctccccggtgttgggagacatgggaactcaaaagaaggggccgcgttctgaaaaagtctcgccgtacgacaccacgacacccgaggtggaagcgttagatcatcaacgactcggaccgatg

SEQ ID NO: 3519 - DNA, 203 bp, Homo sapiens
  source 1..203: mol_type = other DNA
ggcgcgccagtcctatttgatgatctaacgcttccacctcgggtgtcgtggtgtcgtacggcgagactttttcagaacgcggccccttcttttgagttcccatgtctcccaacaccggggagagcaacgccgccgtctatgcgtccagtacacagctcgcgcgggcgttatatggaggggatctggttcgactcggaccgatg

SEQ ID NO: 3520 - DNA, 203 bp, Homo sapiens
  source 1..203: mol_type = other DNA
ggcgcgccagtcctagcgctatcggaactgtccccgggatcgtggccgcggataaacggggcggtaaattttgaaagtttataacccgttaataccatatatggacatccatagggggggttacataaatactaagcctctgtacaacacaaagggcctctaacaatgcactgaaccacaaccaagctcgactcggaccgatg

SEQ ID NO: 3521 - DNA, 203 bp, Homo sapiens
  source 1..203: mol_type = other DNA
ggcgcgccagtcctaaatgaatctaaaccctctacgggaacgatatgaaaaatccgcagaaattagcgatcacattcttgccgctctacgtgatcccaacgtacacgttgtgtattaaagcattgtataaaaacacgcatgcgggcttgctgttctcatttctaggttttgtcttaaatacacccgcccgactcggaccgatg

SEQ ID NO: 3522 - DNA, 203 bp, Homo sapiens
  source 1..203: mol_type = other DNA
ggcgcgccagtcctgaattcaagatgtcatctggtgctaacacacgcgcatccgtcgccattgtcccgtgttccatttcggaattgtcgacatttcgttcaagccaatgagtattttacgcgtaaaggcgaacccgagatcgattggagtgttatataacactccaatcgaccctcttgcgtaccatacgactcggaccgatg

SEQ ID NO: 3523 - DNA, 203 bp, Homo sapiens
  source 1..203: mol_type = other DNA
ggcgcgccagtcctcagggcaggtggacgaactgggattatattatgtgcacgatggtgtacgtgttaactatgtggactttggaacagagtccttgacctatggggtcaccgggacgtgggaggtgcacgtggctgggactgttattcaccatacatccgcatctgtgtctagcacccaggccagcgcgactcggaccgatg

SEQ ID NO: 3524 - DNA, 203 bp, Homo sapiens
  source 1..203: mol_type = other DNA
ggcgcgccagtcctataaccatcaactgacagaaccagatgtgcaggcctacggggtggtaactacctgctgtaagtgtggcagaaccgtccggctggtggttgagtgcggacaagcagacctaagagagctggaacagctgttcttgaagacgctgactctagtgtgccctcactgcgcctagcgttcgactcggaccgatg

SEQ ID NO: 3525 - DNA, 203 bp, Homo sapiens
  source 1..203: mol_type = other DNA
ggcgcgccagtcctcgccctttcgtgttatttcttgtaacgaattcgttacaaaacacacacacagtatataagatagaggaacggattggtacaccacagatggcatcaacaagcggtgtgggatccgtcgggcctgcaagctgttgcgagacgcagaagccacataccatacgggagttgtgtttgcgactcggaccgatg

SEQ ID NO: 3526 - DNA, 203 bp, Homo sapiens
  source 1..203: mol_type = other DNA
ggcgcgccagtcctattgatggttatacatggaactctttttttaggaaattttggcgtcacctaaatctaaaagaccctgaggatgagtcagatggagagactcctggaacgattagactatatacaagagcagatactgacactatatgagaaagatagtgttgacctagaggatcatataaggctcgactcggaccgatg

SEQ ID NO: 3527 - DNA, 203 bp, Homo sapiens
  source 1..203: mol_type = other DNA
ggcgcgccagtcctactttcacatggacggagtctgacgggacagaacggtgtgggtcggggcgctttttttgtgctttctctaatgaaacaaaaagagaaaagttcctcaaatctgtcaagattcctaaaaacattgggctgtttcgcgcacacgcagaaaagctgtgacctgtgtatcattaaacacgactcggaccgatg

SEQ ID NO: 3528 - DNA, 203 bp, Homo sapiens
  source 1..203: mol_type = other DNA
ggcgcgccagtcctaagttcctcaaatctgtcaagattcctaaaaacattgggctgtttcgcgcacacgcagaaaagctgtgacctgtgtatcattaaacaatgcttgctaggcaaagggttaaacgcgctaatcctgaacaactgtataagacatgcaaagcaacggggggcgattgtccacccgatcgactcggaccgatg

SEQ ID NO: 3529 - DNA, 203 bp, Homo sapiens
  source 1..203: mol_type = other DNA
ggcgcgccagtcctaagacataggactaaccgctttgggggacaacattgaaaatgaattgcaggaaatagatttattaactgcggatggtgaagaagaccaggagggcagagacctgcagttggtattttccactggcaatgatgaggtggttgatattatgactatacctatacgtgcaggcggggcgactcggaccgatg

SEQ ID NO: 3530 - DNA, 203 bp, Homo sapiens
  source 1..203: mol_type = other DNA
ggcgcgccagtcctggattatgatatacatcctagcctgttgcgcaggaaacgtaaaaaacgcaaacgtgtttatttttcagatggccgtgtggcttccaggcccaaatagattttacttaccccctcaacctatacaacggacattgaacacagaggaatacgtgagacgcaccagtactttcctcccgactcggaccgatg

SEQ ID NO: 3531 - DNA, 203 bp, Homo sapiens
  source 1..203: mol_type = other DNA
ggcgcgccagtcctatctgtggaaaaggattacatattgcgggaagacttgtctgtgcatagaattggcgggatctggaggggaacttgtgttcgatgtatggtaggactgtattagctgtgagactaatatactgtttgctgtattgtattgctgtaatcgtgcgtaaattgctataccctgtaatacgactcggaccgatg

SEQ ID NO: 3532 - DNA, 203 bp, Homo sapiens
  source 1..203: mol_type = other DNA
ggcgcgccagtccttgcagcaagtccccacacccaggagaacattatacctggtagagagtcagtgtccattttgccaggctatcatacgatttgtatgcgtagcaagcaacactgggatacggaatctacaggcactcctggtcaacagtcaccttgacctcgcttgtcacgcctgtgtcgagcagacgactcggaccgatg

SEQ ID NO: 3533 - DNA, 203 bp, Homo sapiens
  source 1..203: mol_type = other DNA
ggcgcgccagtccttagcaagcaacactgggatacggaatctacaggcactcctggtcaacagtcaccttgacctcgcttgtcacgcctgtgtcgagcagaatggcgtccagggtctcagacaccggcaatggcaatgaaaacaaagagaatgaaggtacagtggcatctgatcattctgaggcgcgtcgactcggaccgatg

SEQ ID NO: 3534 - DNA, 203 bp, Homo sapiens
  source 1..203: mol_type = other DNA
ggcgcgccagtcctattatacctggtagagagtcagtgtccattttgccaggctatcatacgatttgtatgcgtagcaagcaacactgggatacggaatctacaggcactcctggtcaacagtcaccttgacctcgcttgtcacgcctgtgtcgagcagaatggcgtccagggtctcagacaccggcacgactcggaccgatg

SEQ ID NO: 3535 - DNA, 203 bp, Homo sapiens
  source 1..203: mol_type = other DNA
ggcgcgccagtcctacaggcactcctggtcaacagtcaccttgacctcgcttgtcacgcctgtgtcgagcagaatggcgtccagggtctcagacaccggcaatggcaatgaaaacaaagagaatgaaggtacagtggcatctgatcattctgaggcgcgttgtagctatatattatttgaggctgaatcgactcggaccgatg

SEQ ID NO: 3536 - DNA, 203 bp, Homo sapiens
  source 1..203: mol_type = other DNA
ggcgcgccagtcctgttaataacaatcttggtttaaaaaataggagggaccgaaaacggttcaaccgaaaacggttgtatataaaccagccctaaaatttagcaaacgaggcattatggaaagtgcaaatgcctccacgtctgcaacgaccatagaccagttgtgcaagacgtttaatctatctatgccgactcggaccgatg

SEQ ID NO: 3537 - DNA, 203 bp, Homo sapiens
  source 1..203: mol_type = other DNA
ggcgcgccagtcctgccattgtaactgtaacatatgatagtgaggaacaaaggcaacagtttttagatgttgtaaaaataccccctaccattagccacaaactgggatttatgtcactgcacctattgtaatttgtatatatgtaaatgtgtaaatatatggtattggtgtaatacaactgtacatgtcgactcggaccgatg

SEQ ID NO: 3538 - DNA, 203 bp, Homo sapiens
  source 1..203: mol_type = other DNA
ggcgcgccagtcctaacccccttgcaatttttcctactaactctacttgtgtgttactgtcccgcattgtatatacactactatattgttaccacacagcaatgatgctaacatgtcaatttaatgatggagatacctggctgggtttgtggttgttatgtgcctttattgtagggatgttggggttacgactcggaccgatg

SEQ ID NO: 3539 - DNA, 203 bp, Homo sapiens
  source 1..203: mol_type = other DNA
ggcgcgccagtcctatgcattatactactgatggtgattatatatatatgaattagagtaaaccgttttttatatttgtaacagtgtatgctttgtataccatggcacatagtagggcccgacgacgcaagcgtgcgtcagctacacagctatatcaaacatgtaaactcactggaacatgccccccacgactcggaccgatg

SEQ ID NO: 3540 - DNA, 203 bp, Homo sapiens
  source 1..203: mol_type = other DNA
ggcgcgccagtcctagaaaaggtaaaacatatactaaccaaggcgcggttcataaagctaaattgtacgtggaagggtcgctgcctacactgctggacaacatgcatggaagacatgttaccctaaaggatattgtattagacctgcaacctccagaccctgtagggttacattgctatgagcaattacgactcggaccgatg

SEQ ID NO: 3541 - DNA, 203 bp, Homo sapiens
  source 1..203: mol_type = other DNA
ggcgcgccagtcctttttcattacaggttctggattttatttgcatcctgcatggtattttgcacgtaaacgccgtaaacgtattcccttatttttttcagatgtggcggcctagcgacagcacagtatatgtgcctcctcctaaccctgtatccaaagttgttgccacggatgcttatgttactcgccgactcggaccgatg

SEQ ID NO: 3542 - DNA, 203 bp, Homo sapiens
  source 1..203: mol_type = other DNA
ggcgcgccagtcctagaaacagacatcagagaagtgcaacagcttctgttgggaacactaaacatagtgtgtcccatctgcgcaccgaagacctaacaacgatggcggacgattcaggtacagaaaatgaggggtctgggtgtacaggatggtttatggtagaagctatagtgcaacacccaacaggtcgactcggaccgatg

SEQ ID NO: 3543 - DNA, 203 bp, Homo sapiens
  source 1..203: mol_type = other DNA
ggcgcgccagtcctcattattctagttacaacaagaacctaggagttatatgccagaagtaagcctataaaatacacaggtaagactctgcacaggaccagatggcgacaccaatcgggaccgtcagacagctttccgaaagcctctgtatcccatatattgatgttttattgccttgtaatttttgtcgactcggaccgatg

SEQ ID NO: 3544 - DNA, 203 bp, Homo sapiens
  source 1..203: mol_type = other DNA
ggcgcgccagtcctttgattttgcttggacgtgtgtacatagtccctgtatatattcccctcctacccccacataccttgaagcttgcaacattgtaacaaatgtatcgcctacgtagaaaacgcgctgcccccaaagatatatacccctcatgcaaaatatcaaacacctgcccacctgacattcaacgactcggaccgatg

SEQ ID NO: 3545 - DNA, 203 bp, Homo sapiens
  source 1..203: mol_type = other DNA
ggcgcgccagtcctttacacctttggttattatagctcttaacaactcaacaggggattttgagttacatcctagtcttagaaagcgtcgtaaaagagcttatgtataatgtttttcagatggctgtctggttaccagcgcagaataagttctatcttcctccccagcccatcactagaatcctgtcccgactcggaccgatg

SEQ ID NO: 3546 - DNA, 203 bp, Homo sapiens
  source 1..203: mol_type = other DNA
ggcgcgccagtcctaggagttagtgtcgcctcagcaaccttatgctgtcgttgcttcctgtgcctattgcgagaaactggttcgattgaccgtcctcgcggatcacagcgccattagacagctggaggaactccttctgcgatctttgaacatcgtgtgcccactgtgcaccctacagcgacagtaaacgactcggaccgatg

SEQ ID NO: 3547 - DNA, 203 bp, Homo sapiens
  source 1..203: mol_type = other DNA
ggcgcgccagtcctatcacagcgccattagacagctggaggaactccttctgcgatctttgaacatcgtgtgcccactgtgcaccctacagcgacagtaaaatggcagataataaaggtactgaaaacgattggtttttggtggaggcgacagattgtgaggaaacgttagaggaaacctcacttggtcgactcggaccgatg

SEQ ID NO: 3548 - DNA, 203 bp, Homo sapiens
  source 1..203: mol_type = other DNA
ggcgcgccagtcctttgctggctactgtcgttagcgggcagagacaggatagacagggaggagagcgaaggaggccccaactcgaccacgaccagtgtgcctactgcaaagaaaagggacattgggctagagattgccccaagaagccaagaggaccccggggaccacgaccccaggcctccctcctgcgactcggaccgatg

SEQ ID NO: 3549 - DNA, 203 bp, Homo sapiens
  source 1..203: mol_type = other DNA
ggcgcgccagtcctaaaccccaagaccaattcaggcaggttctggagtgcgtggcaatcagtcacaaacttacaagccagctgctggtcgcggaggaagaggcaatcaaaaccgaaaccaacgatcatccggtgctggtgactcacgcgcagttaatactgtaacacaaagtgccacgtcctccacagcgactcggaccgatg

SEQ ID NO: 3550 - DNA, 203 bp, Homo sapiens
  source 1..203: mol_type = other DNA
ggcgcgccagtcctgcttgtgtttaaaaattgtcgcagcttccccaaaccaagtggtcttggttttctctttttattatattgtcaatatggcttgcaaacacggatacccagacgtgtgccctatttgcacagccgttgacgctactcccgactttgaatatttgctcatggcagacggagaatggtcgactcggaccgatg

SEQ ID NO: 3551 - DNA, 203 bp, Homo sapiens
  source 1..203: mol_type = other DNA
ggcgcgccagtcctgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagcgactcggaccgatg

SEQ ID NO: 3552 - DNA, 203 bp, Homo sapiens
  source 1..203: mol_type = other DNA
ggcgcgccagtccttcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagacgactcggaccgatg

SEQ ID NO: 3553 - DNA, 203 bp, Homo sapiens
  source 1..203: mol_type = other DNA
ggcgcgccagtcctccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgcgactcggaccgatg

SEQ ID NO: 3554 - DNA, 203 bp, Homo sapiens
  source 1..203: mol_type = other DNA
ggcgcgccagtcctacaccatgtggtcacgctgggtatttaagcccgagtgagcacgcagggtctccattttgaagcgggaggtttgaacgcgcagccgccatgccggggttttacgagattgtgattaaggtccccagcgaccttgacgagcatctgcccggcatttctgacagctttgtgaactggcgactcggaccgatg

SEQ ID NO: 3555 - DNA, 203 bp, Homo sapiens
  source 1..203: mol_type = other DNA
ggcgcgccagtcctgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttccgactcggaccgatg

SEQ ID NO: 3556 - DNA, 203 bp, Homo sapiens
  source 1..203: mol_type = other DNA
ggcgcgccagtcctctcagagagtcgttggaagacgggaaggaagcccaacgactgagcagtccaccccaggcgtgattctggtcgcccggtggatcaagcatggaagccgtcataaaggtgatttcgtccgcgtgtaaaacctattgcgggaaaacctctccttctaagaaggaaataggggccatgcgactcggaccgatg

SEQ ID NO: 3557 - DNA, 203 bp, Homo sapiens
  source 1..203: mol_type = other DNA
ggcgcgccagtcctcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgcgactcggaccgatg

SEQ ID NO: 3558 - DNA, 203 bp, Homo sapiens
  source 1..203: mol_type = other DNA
ggcgcgccagtcctctcggttgtaacgcgcttaggaagtcccctcgaggtatggcagatatgctcttgcatagggggaaaaaatgtagtcttaatattgtctgtgtgctgcaggagctaagctgactctgctggtggcctcgcgtaccactgtggccaggcggtagctgggacgtgcagccgaccacccgactcggaccgatg

SEQ ID NO: 3559 - DNA, 203 bp, Homo sapiens
  source 1..203: mol_type = other DNA
ggcgcgccagtccttgtgtgctgcaggagctaagctgactctgctggtggcctcgcgtaccactgtggccaggcggtagctgggacgtgcagccgaccaccatggggagcagcaagagcaagcctaaggaccccagccagcgccggcacagcctggagccacccgacagcacccaccacgggggattccgactcggaccgatg

SEQ ID NO: 3560 - DNA, 203 bp, Homo sapiens
  source 1..203: mol_type = other DNA
ggcgcgccagtcctgcgaaaatcccgggatatgatagaggtgggggttattaaccgagacgggtctttggagcgacccctgctcctcttccccgcagtagctatggttagagggagtatcctaggaagagattgtctgcagggcctagggctccgcttgacaaatttatagggagggccactgttcttcgactcggaccgatg

SEQ ID NO: 3561 - DNA, 203 bp, Homo sapiens
  source 1..203: mol_type = other DNA
ggcgcgccagtccttgccgagaactcagagggtcgtcggaagacggagagtgagcccgacgaccaccccaggcacgtctttggtcggcctgcggatcaagcatggaagccgtcattaaggtgatttcgtccgcgtgtaaaacctattgcgggaaaatctctccttctaagaaggaaataggggccatgcgactcggaccgatg

SEQ ID NO: 3562 - DNA, 203 bp, Homo sapiens
  source 1..203: mol_type = other DNA
ggcgcgccagtcctacataccaaataccaagaccaactagaacaacaattttcaaaacaaaaaattgaaaagtggtgttacgtaaggaacagaagaaaggaatggaaaggaccctacaaagtgttgtgggacggagacggggcagcagtaatagaggaagagggaaaaacagccttatatccacaccgcgactcggaccgatg

SEQ ID NO: 3563 - DNA, 203 bp, Homo sapiens
  source 1..203: mol_type = other DNA
ggcgcgccagtcctcaacgcttagctgcacttcagctgtgcactaacgcatgtctctgttggtacccgttaggacgcatcaacgacaccaccccgttgtggttgaacttttcgtctgggaaggaaccaacgatccaacaactgagtggccacccctaactcgtcgtaacattcatagattgtggcaatcgactcggaccgatg

SEQ ID NO: 3564 - DNA, 203 bp, Homo sapiens
  source 1..203: mol_type = other DNA
ggcgcgccagtcctgggtggcgatgataatgttgccacagcccaaagaaagctttggaggaaagccaattggctggcttttctggaacacgtgcaaaggacctaggcgggactgtccacattgttgttgtcccatatgtagttggcattgtcagctttgctttttgcagaaaaatctaggaatcaactcgactcggaccgatg

SEQ ID NO: 3565 - DNA, 203 bp, Homo sapiens
  source 1..203: mol_type = other DNA
ggcgcgccagtcctctgtcttactttctgtttctcgcggcccgcgctctctccctcggcgccctctagcggccaggagagaccggcaaacaattgggggctcgtccgggattgatcaccccggaaccctaacgatcctctggacccaccccctcggcggcgttttgggtctttcctttaaattatatccgactcggaccgatg

SEQ ID NO: 3566 - DNA, 203 bp, Homo sapiens
  source 1..203: mol_type = other DNA
ggcgcgccagtcctcgtccgggattgatcaccccggaaccctaacgatcctctggacccaccccctcggcggcgttttgggtctttcctttaaattatatcatgggaaattccccctcctataacccccccgctggtatctccccctcagactggctcaaccttcgtcaaagcgcgcaaaggctcaatcgactcggaccgatg

SEQ ID NO: 3567 - DNA, 203 bp, Homo sapiens
  source 1..203: mol_type = other DNA
ggcgcgccagtcctagctccccgggcaaaacaatcgtcggtggctaggacctctcccggccctagtcgaagcctcgggaggcgccctcctggctactaacccccccgtgtgggttccctggcgtttgctaaaagccttcaaatgcccaaagaacgacggtcccgaagacgcccacaaccgatcatcagcgactcggaccgatg

SEQ ID NO: 3568 - DNA, 203 bp, Homo sapiens
  source 1..203: mol_type = other DNA
ggcgcgccagtcctcccccgtgtgggttccctggcgtttgctaaaagccttcaaatgcccaaagaacgacggtcccgaagacgcccacaaccgatcatcagatgggtaagtctcactcttactctcctcgctctctgtcagcccatccagacttggagatgctccctgtccctaggaaatcaacaatgcgactcggaccgatg

SEQ ID NO: 3569 - DNA, 203 bp, Homo sapiens
  source 1..203: mol_type = other DNA
ggcgcgccagtcctgccatggaggcccatcagtttattaaggctcctggcatcactactgctattgagcaggctgctctagcagcggccaactctgcccttgcgaatgctgtggtagttaggccttttctctctcaccagcagattgagatccttattaacctaatgcaacctcgccagcttgttttccgactcggaccgatg

SEQ ID NO: 3570 - DNA, 203 bp, Homo sapiens
  source 1..203: mol_type = other DNA
ggcgcgccagtccttttcactgagtcagtgaagccagtgctcgacctgacaaattcaatcctgtgtcgggtggaatgaataacatgtcttctgctgcgcccatgggttcgcgaccatgcgccctcggcctattttgctgttgctcctcatgtttctgcctatgctgcccgcgccaccgcccggtcagccgactcggaccgatg

SEQ ID NO: 3571 - DNA, 203 bp, Homo sapiens
  source 1..203: mol_type = other DNA
ggcgcgccagtccttgaagccagtgctcgacctgacaaattcaatcctgtgtcgggtggaatgaataacatgtcttctgctgcgcccatgggttcgcgaccatgcgccctcggcctattttgctgttgctcctcatgtttctgcctatgctgcccgcgccaccgcccggtcagccgtctggccgccgccgactcggaccgatg

SEQ ID NO: 3572 - DNA, 203 bp, Homo sapiens
  source 1..203: mol_type = other DNA
ggcgcgccagtccttgtctctagtttgtctgttcgagatcctacagttggcgcccgaacagggacctgagaggggcgcagaccctacctgttgaacctggctgatcgtaggatccccgggacagcagaggagaacttacagaagtcttctggaggtgttcctggccagaacacaggaggacaggtaagcgactcggaccgatg

SEQ ID NO: 3573 - DNA, 203 bp, Homo sapiens
  source 1..203: mol_type = other DNA
ggcgcgccagtccttgatcgtaggatccccgggacagcagaggagaacttacagaagtcttctggaggtgttcctggccagaacacaggaggacaggtaagatgggagaccctttgacatggagcaaggcgctcaagaagttagagaaggtgacggtacaagggtctcagaaattaactactggtaaccgactcggaccgatg

SEQ ID NO: 3574 - DNA, 203 bp, Homo sapiens
  source 1..203: mol_type = other DNA
ggcgcgccagtcctatggctagctatgcttactaataatcagcttagaagacaagtaattagggaagcacagatctggatgtggaaacataagggagctgcagttagaagaaattgtggttgcaggctatgtaaccccggctggggaagccaagtaagaaatgttgaactgtgataagcctgtctaggcgactcggaccgatg

SEQ ID NO: 3575 - DNA, 203 bp, Homo sapiens
  source 1..203: mol_type = other DNA
ggcgcgccagtcctgcgtccacgacggaaaccccgccgagacctagccgcggtccctggatctccagatacggaggggagtctttttgttgttttttgtagatgcatccggtgttgcgacagatgcgtccgacggcgcctccaacacagccgccgctcccgccccccactagcgcccctgcagccgttcgactcggaccgatg

SEQ ID NO: 3576 - DNA, 203 bp, Homo sapiens
  source 1..203: mol_type = other DNA
ggcgcgccagtcctaagccgtccccctcggagttagaagacgcgttcacaaaatggacgaagactgagtttccctgtcgttgccagccggtccccgtcagcatgagcaagcgcaagttcaaagaagagctgctggaggcccttgtgcctgaaatctatggccctgccgcggacgtcaagcccgacattcgactcggaccgatg

SEQ ID NO: 3577 - DNA, 203 bp, Homo sapiens
  source 1..203: mol_type = other DNA
ggcgcgccagtcctcaaacccagccgcactcgctccacccgccgtcgtcgctctgtccgccgccgctcaaggcgcacggcccccatctctgtgcgtcgcgtaacccgccgtggacgcacgctgacccttcccaacgcgcgttaccaccctagcattctcgtttaatccgtgcgctgccgttttttcagcgactcggaccgatg

SEQ ID NO: 3578 - DNA, 203 bp, Homo sapiens
  source 1..203: mol_type = other DNA
ggcgcgccagtcctaacccgccgtggacgcacgctgacccttcccaacgcgcgttaccaccctagcattctcgtttaatccgtgcgctgccgttttttcagatggctttgacttgccggtttcgcattcccgttccgtcctaccgaggaagatctcgccgtaggagaggcatggcgggcagtggccgccgactcggaccgatg

SEQ ID NO: 3579 - DNA, 203 bp, Homo sapiens
  source 1..203: mol_type = other DNA
ggcgcgccagtcctgcgctttgcgcaggcgaataaaaggcggatttttgcccgcgttgattcccatcatcgccgccgccataggcgcaatcccaggcgtggcctccgtggccttgcaagcagctcgcaaacaataaaagaaggcttaacactgacttcctggtcctgactattttatgcagacaagaccgactcggaccgatg

SEQ ID NO: 3580 - DNA, 203 bp, Homo sapiens
  source 1..203: mol_type = other DNA
ggcgcgccagtcctccaccagccgcaccgcggcgtcatcgaggccgtctacctgcgtacgccgttctcggccggtaacgccaccacataagaagccagccaatgggctccagcgagcaggagttggtcgccatcgtgcgcgaactgggctgcggaccttactttctgggcacgtttgacaaacgctttcgactcggaccgatg

SEQ ID NO: 3581 - DNA, 203 bp, Homo sapiens
  source 1..203: mol_type = other DNA
ggcgcgccagtcctccttgccgtcctcggggggcgttacatagcccggatcttgctccacttgctcattttcctcctcatgtttcactagctcgacggcgccgacctcagagttgggggtggttaaggtttcggagtctggctgcagcttaagatcctcctccatattttctcgcctaggagtaaagccgactcggaccgatg

SEQ ID NO: 3582 - DNA, 203 bp, Homo sapiens
  source 1..203: mol_type = other DNA
ggcgcgccagtcctaggcactgttcaataaatattgctcggtgtctcttaaggactaaacacccgcgctttttttaggcgccaaattacgtcattgacattatgagcaaagacattcccacgccttacatgtggagctatcagccgcaaatgggcctggcagctggagcttctcaggattactccagtcgactcggaccgatg

SEQ ID NO: 3583 - DNA, 203 bp, Homo sapiens
  source 1..203: mol_type = other DNA
ggcgcgccagtcctcagacgacttcatcccgaactacgacgcggtgagcgaatctgtggacggctacgactgaagaccgatagtacggccgtgactgcgcggctgtaacatctgcatcggtgccgtaaccttcgctgctttacttaaaaagcctgtgatttcatttaccaccccagcacttggattaccgactcggaccgatg

SEQ ID NO: 3584 - DNA, 203 bp, Homo sapiens
  source 1..203: mol_type = other DNA
ggcgcgccagtccttcgctggactttacaaaaagagaatctaaccactaccaccctccttccccttactacttatactttttcccaaaaaaagaattactttttgcccattattgcacttttggcctttgtctgtgttattaccgctaattatattttaattttcaatcttgataatttttactaatccgactcggaccgatg

SEQ ID NO: 3585 - DNA, 203 bp, Homo sapiens
  source 1..203: mol_type = other DNA
ggcgcgccagtcctcgccttgctgacttatctcatcttcacctctgtttgctgcactgccatctgcagcattgccactttttttgtggccattttccaaactgcggactacctatacgttagagtggcatactatcgtcatcatccccaatataggaaccacgaggtggctacccttctgtgcctgtccgactcggaccgatg

SEQ ID NO: 3586 - DNA, 203 bp, Homo sapiens
  source 1..203: mol_type = other DNA
ggcgcgccagtcctgtttcctattacagcccccaccgcccccaccggctcctgtgcagcgcgctccatcagttattagctactttcatcttaactctgaagatgtctgaccaactagaaatcgacgggcagtgcactgagcagcttatccttgctcggcgaaaactcaaacaacaaaatcaggaactgcgactcggaccgatg

SEQ ID NO: 3587 - DNA, 203 bp, Homo sapiens
  source 1..203: mol_type = other DNA
ggcgcgccagtcctacatagggaatgctgggagttgaggaggtgtcataggggtagacggggttgaagtcgtcttcaattctggttcttttcatctgcaagatgaagattgtgggtcagggtaaaaaggtgaacaccgatataccctttaggacgtggagaaagtttgccgcccgttggcacatcccgcgactcggaccgatg

SEQ ID NO: 3588 - DNA, 203 bp, Homo sapiens
  source 1..203: mol_type = other DNA
ggcgcgccagtccttcgcctaacatcaccttcagtgtcgtctacaacgagataaacagtgggtatgcttttacgtttaaatggtcagccgaaccgggaaaaccttttcacccacccaccgctgtattttgctacataactgaacaataaaatcattgcaggcgcaatcttcgcatttcttttttccagcgactcggaccgatg

SEQ ID NO: 3589 - DNA, 203 bp, Homo sapiens
  source 1..203: mol_type = other DNA
ggcgcgccagtccttgtaatttttcaccaacgcagcggtggggagaggtgtgatcttcgtgacttgcactttggctcgctttacaaccgtctggaataattatgcctcttccgtctctccctccacctccagtgagtcgggatcaaggcctttgtatttcttggttggagttggctttaacctgctgtcgactcggaccgatg

SEQ ID NO: 3590 - DNA, 203 bp, Homo sapiens
  source 1..203: mol_type = other DNA
ggcgcgccagtcctggagggacgtggagcgcctgcagcgttgccggcaaatccgctgtttccatcacgctttcgtaagaaggaggaggaccctcggcgtacgccatcaccggcggcactcccaccgcacgtctcattttgactaccgggaagagggaaaaaacagacaaagggacggacgctgttgctcgactcggaccgatg

SEQ ID NO: 3591 - DNA, 203 bp, Homo sapiens
  source 1..203: mol_type = other DNA
ggcgcgccagtcctggcgattctctagttctaacacgaacgtttacggtcgttgccagctttttccttataaaactctggtgggaatttctcttgggacagatggacctgacatctgtacattcggttcgggatctgagttctgctctccgtatcccatttattgatttggttgttccttgcaattttcgactcggaccgatg

SEQ ID NO: 3592 - DNA, 203 bp, Homo sapiens
  source 1..203: mol_type = other DNA
ggcgcgccagtcctcaccaccagatcatacattcaaaaagggagggcaaacaattgaggtaatctatgatgaggatcccaataatagcaccagacatactgtatggcgccatatatattatcaaaacggtgataacagatggagaaaagcagctagtgatgtagatgttcatggtgtgttttatttagcgactcggaccgatg

SEQ ID NO: 3593 - DNA, 203 bp, Homo sapiens
  source 1..203: mol_type = other DNA
ggcgcgccagtcctgtaagcgactcccttccgtggtttggtggaaaagtcacaagggtaccatagcgaggaaccccggttcgaaaccggcaggatccgctatgagcacaagtgaggcgcttgcgcgttgaacccggccaaggacccccagacacggagaggagtctttttttatttattttttcttagcgactcggaccgatg

SEQ ID NO: 3594 - DNA, 203 bp, Homo sapiens
  source 1..203: mol_type = other DNA
ggcgcgccagtccttgagcacaagtgaggcgcttgcgcgttgaacccggccaaggacccccagacacggagaggagtctttttttatttattttttcttagatgcatcctgtcctgcgacaaatgcgacctcagcccagggcaaccacggcctcagcagcggtggcgctttcgggctctggcgaacagcgactcggaccgatg

SEQ ID NO: 3595 - DNA, 203 bp, Homo sapiens
  source 1..203: mol_type = other DNA
ggcgcgccagtcctggcagctggagtggcgtctgctgacgtcactggcgatgacgatgacgaagaccagtacgaggactgatcggccgtaccttttgttagatgcagcgaccggcgatcatcgcggagagggctcctaacctggatcccgcggttttggcggccatgcaaagccagccttctggcgttcgactcggaccgatg

SEQ ID NO: 3596 - DNA, 203 bp, Homo sapiens
  source 1..203: mol_type = other DNA
ggcgcgccagtccttatgcgcagacgcatgaagggtggggtgctgcccttcctaattccacttattgctgcggccattggagccgttcccggaattgcctcagtagccttgcaggcttctcgaaaaaattaaaataaaataaaacttccaacttattactggtactatgactgttttatgcagactaacgactcggaccgatg

SEQ ID NO: 3597 - DNA, 203 bp, Homo sapiens
  source 1..203: mol_type = other DNA
ggcgcgccagtcctgcggcgtcattgaagcggtctacctgcgcacgcccttctcggcgggtaacgctaccacctaagaaggcaccctcccagactgctgtaatgggttcaagcgaacaggagctgacggccattgttcgagatctaggctgtggaccctattttttgggaacctttgacaaacgttttcgactcggaccgatg

SEQ ID NO: 3598 - DNA, 203 bp, Homo sapiens
  source 1..203: mol_type = other DNA
ggcgcgccagtccttcctcggggggagtctcgtagcccaagttctgctcaaccggtgcgtcttggggtatgagtagacttttgtccttctccatgacagccgtagcgccaatggcgggagcggtgggggcggttaagctttcctgtggctccagatccatcatgtgtttctttgcctaggattaaatacgactcggaccgatg

SEQ ID NO: 3599 - DNA, 203 bp, Homo sapiens
  source 1..203: mol_type = other DNA
ggcgcgccagtcctgtagcgccaatggcgggagcggtgggggcggttaagctttcctgtggctccagatccatcatgtgtttctttgcctaggattaaataatggccagcaatcagcactcacagagggagcgcaccccagaccgcagcgctcagccgccgccgccaaaaatgggcagatactttctgcgactcggaccgatg

SEQ ID NO: 3600 - DNA, 203 bp, Homo sapiens
  source 1..203: mol_type = other DNA
ggcgcgccagtcctttcttgacttttttctttggaggtaaaggcacagcttccagttcttcttcgctttcggaatccagaaagtatctgcccatttttggcggcggcggctgagcgctgcggtctggggtgcgctccctctgtgagtgctgattgctggccattatttaatcctaggcaaagaaacaccgactcggaccgatg

SEQ ID NO: 3601 - DNA, 203 bp, Homo sapiens
  source 1..203: mol_type = other DNA
ggcgcgccagtccttcctttttcgggctcgcctggacactatcctgacgccttcatacccaactttgacgcagtgagtgaatctgtggatggctatgattaatgtctaatggagcggctgacagagcgcggctgcgacatttagaccactgtcgccaacctcactgctttgctcgagacatctgtgtccgactcggaccgatg

SEQ ID NO: 3602 - DNA, 203 bp, Homo sapiens
  source 1..203: mol_type = other DNA
ggcgcgccagtcctttgagcttccagaggagcacccccaggggccagctcacggtgtcagaataacagttgaaaaaggaattgatacacacctcattaaatttttcaccaaacgcccgctattggtggaaaaagatcaaggaaatactatattaactttatattgcatttgtcctgttcccggattaccgactcggaccgatg

SEQ ID NO: 3603 - DNA, 203 bp, Homo sapiens
  source 1..203: mol_type = other DNA
ggcgcgccagtcctaacacagtttaacacatacagtaagcacagtaatctttttaggaataattggcttcagcattttgattattatagcagcctttatttatctgtgctggcatagaaaatctttgtgtgtttctaaaacagaacctcttatgccgattccttactagttttcttttttcttacagtcgactcggaccgatg

SEQ ID NO: 3604 - DNA, 203 bp, Homo sapiens
  source 1..203: mol_type = other DNA
ggcgcgccagtcctaagtgctaatacacctggtggtttttcttgaagaccattggaagaagtaaaagggggtgtaacaaagggtacgtctgatgtgtcaaatgggtcaaaagggtaaacggggttgaagtcatcattttcttctgtttcttcagcatactgggttctgctgcgcttcatctagaaaagcgactcggaccgatg

SEQ ID NO: 3605 - DNA, 203 bp, Homo sapiens
  source 1..203: mol_type = other DNA
ggcgcgccagtccttgggtcaaaagggtaaacggggttgaagtcatcattttcttctgtttcttcagcatactgggttctgctgcgcttcatctagaaaagatgaagatggtgggtagggattgggaagaagaatctgaccttccatttaagatttggagaaagtttgctgtttgcaagtctgtcaggcgactcggaccgatg

SEQ ID NO: 3606 - DNA, 203 bp, Homo sapiens
  source 1..203: mol_type = other DNA
ggcgcgccagtccttgaagataacacctgaagctgaatacattttagcaagcctgcgagagtggttgtactttgcttttttgacggaacgccaacgctgcaaacaaaaaggacgaggtgcgataaccagtggtcgtacgtggttttgtttttttaagtacgaagacgctcgcaagtctgttgtttacgcgactcggaccgatg

SEQ ID NO: 3607 - DNA, 203 bp, Homo sapiens
  source 1..203: mol_type = other DNA
ggcgcgccagtcctcttttgtttatcgaaatcagagctgtggctcttttagaagctgttgttgaacatttggaaaatcgcttacaatttgatctggctgtgatctttcaccagcacagcggaggcgatcgctgccacctgcgagatttacgcattcaaatccttgctgaccgtcttgattaagtttttcgactcggaccgatg

SEQ ID NO: 3608 - DNA, 203 bp, Homo sapiens
  source 1..203: mol_type = other DNA
ggcgcgccagtcctatccaggctcaagaatggagctcagtgttttgttgtttaatcattccgacgtgttttgcgatgttcgcgcaaagcagccagtcgcgcgcttgcttttaagtagagttgtttttccacccgtttgccaggcatctttaatttaacatatttttatttttcaggctaacctaaagccgactcggaccgatg

SEQ ID NO: 3609 - DNA, 203 bp, Homo sapiens
  source 1..203: mol_type = other DNA
ggcgcgccagtcctattgtgctaaatgtaactgaggagctgagaagtgaccaccttaccctgtcttgcctgcggactgactatgagtcaagtgatgaagacgacaactgaggtaagtgggtggagctaggtgggattataaaaggctggaagtcaactaaaaattgtttttgttcttttaacagcacgcgactcggaccgatg

SEQ ID NO: 3610 - DNA, 203 bp, Homo sapiens
  source 1..203: mol_type = other DNA
ggcgcgccagtcctgtgtcctcactgcgggagcacctccaaaggaaaaatacgggctaaaggccacgctacagaggctttgtcttatgatcttatgttaaaatgctaccttgccgaagcacagggagaagacacgcgcttcagcaccagccgcctcagtttaaagcgcacactggccagcgctcaacccgactcggaccgatg

SEQ ID NO: 3611 - DNA, 203 bp, Homo sapiens
  source 1..203: mol_type = other DNA
ggcgcgccagtcctgtttcttccctccgtaggacccaaatagcggggaggcacgtagggtggcgccgctgccatcacggtttcgtaagagggaggtggtgtctcaggaaaagccactgtctgcagttccaccgcgcgcctcatttcacagctaacggaagaaggaaaataagacgaacactggtcgcccgactcggaccgatg

SEQ ID NO: 3612 - DNA, 203 bp, Homo sapiens
  source 1..203: mol_type = other DNA
ggcgcgccagtcctttttaaccgactgttacgaatacagcctgatagggtgctgcagaggcccactgtattgctactaaaaatctctgctgtacatggcacatggagttgatcacaaatgaacttttatacaaaacatacaaacaaaaacccgtcggggtggaggaacctgtttatgatcaggcaggtcgactcggaccgatg

SEQ ID NO: 3613 - DNA, 203 bp, Homo sapiens
  source 1..203: mol_type = other DNA
ggcgcgccagtcctgtctggaaagactagtactgctacagatggtagaacagcatgtgtttcaagtattgccattgtggagagccaggagaagtagtacaacagatttcccatggtgcagggacacaacgggatacacgcatgcgtggtctgtccaggagtgctggttgatggaatatctcttagaggcgactcggaccgatg

SEQ ID NO: 3614 - DNA, 203 bp, Homo sapiens
  source 1..203: mol_type = other DNA
ggcgcgccagtccttattaaaggatgaagagaagggatattttcttatacctaggagacacataaggagagttccagaaccctgcgctcttcctgaaggggatgagtgaagaagattggcaggtaagtagaagactctttgcagtgctccaaggaggagtaaatagcgctatgctatacatatctaggcgactcggaccgatg

SEQ ID NO: 3615 - DNA, 203 bp, Homo sapiens
  source 1..203: mol_type = other DNA
ggcgcgccagtcctatccctccaggaagcggccggggcagccttgctctccatagacggctccccccggtggatcccgtggcgattcctgaaaaaagctgcatgcccaagaccagacgccagcgaactcgccgagcacgccgcaacagaccaccaacaccatgggtaatgttttcttcctacttttatcgactcggaccgatg

SEQ ID NO: 3616 - DNA, 203 bp, Homo sapiens
  source 1..203: mol_type = other DNA
ggcgcgccagtcctctccggcccctgaatgcggctaaccttaaccctagagccttatgccacgatccagtggttgtaaggtcgtaatgagcaattccgggacgggaccgactactttgggtgtccgtgtttctcatttttcttcatattgtcttatggtcacagcatatatatacatatactgtgatccgactcggaccgatg

SEQ ID NO: 3617 - DNA, 203 bp, Homo sapiens
  source 1..203: mol_type = other DNA
ggcgcgccagtccttgcagtatgccctcaaaaacatcaaacctctgttaatacccctaatttgtgcccacgctgtaaaaaaggaaagcattgggcacgagactgccgttccaagacagatgttcaaggcaatcctttgcccccggtttcgggaaactgggtgaggggccagcccctggccccgaaacacgactcggaccgatg

SEQ ID NO: 3618 - DNA, 203 bp, Homo sapiens
  source 1..203: mol_type = other DNA
ggcgcgccagtcctctgccgttccaagacagatgttcaaggcaatcctttgcccccggtttcgggaaactgggtgaggggccagcccctggccccgaaacaatgttatggggcaacactgcaggttccaaaagaaccattgcagacctctgtcgagccacaagaggcagcgcgggattggacctctgtcgactcggaccgatg

SEQ ID NO: 3619 - DNA, 203 bp, Homo sapiens
  source 1..203: mol_type = other DNA
ggcgcgccagtcctgtgcaggtgcgactcttgtttgtgctggtcgcggcaggtggcgcccaacgtggggctcgagctcgacagttttcttccgccactactctcattaattgaactaagtaagtatatggataaacaagtagcctaaattaaggaggagtagtaaggtatatagttgagagtataaatcgactcggaccgatg

SEQ ID NO: 3620 - DNA, 203 bp, Homo sapiens
  source 1..203: mol_type = other DNA
ggcgcgccagtccttaaattttttaactttagacacagaaggcaattcagcagcccagcgtttttggggagaacgatcctcatgcaaaaaaccacttgtgcgatggaaggatccacttaccaatctgtggtatgggccagaccctgtattaatatggggacgagggcatgtttgtgtttttccacaggcgactcggaccgatg

SEQ ID NO: 3621 - DNA, 203 bp, Homo sapiens
  source 1..203: mol_type = other DNA
ggcgcgccagtccttaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtccgactcggaccgatg

SEQ ID NO: 3622 - DNA, 203 bp, Homo sapiens
  source 1..203: mol_type = other DNA
ggcgcgccagtcctggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgcccgactcggaccgatg

SEQ ID NO: 3623 - DNA, 203 bp, Homo sapiens
  source 1..203: mol_type = other DNA
ggcgcgccagtccttcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcgactcggaccgatg

SEQ ID NO: 3624 - DNA, 203 bp, Homo sapiens
  source 1..203: mol_type = other DNA
ggcgcgccagtccttgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctgcgactcggaccgatg

SEQ ID NO: 3625 - DNA, 203 bp, Homo sapiens
  source 1..203: mol_type = other DNA
ggcgcgccagtccttaggcctccaagggctccccaaaatctgaatttctgagtagtcttcatcccctctcctgctctaaggtcaggtccatcctctctggtccttaccttgatgacaaggatccagccttctggtgtttttgagcatttcaaaggtctgcatagaaaggaacagccactaggtccattcgactcggaccgatg

SEQ ID NO: 3626 - DNA, 203 bp, Homo sapiens
  source 1..203: mol_type = other DNA
ggcgcgccagtcctccttaccttgatgacaaggatccagccttctggtgtttttgagcatttcaaaggtctgcatagaaaggaacagccactaggtccattatgggacccctcattgtactcctaatgattttgctcttcggaccctgcattcttaatcgattagtccaatttgttaaagacaggatacgactcggaccgatg

SEQ ID NO: 3627 - DNA, 203 bp, Homo sapiens
  source 1..203: mol_type = other DNA
ggcgcgccagtccttcagcctttttagagagactcaaggaggcctatcgcagatacactccttatgaccctgaggacccagggcaagaaaccaatgtgtccatgtcattcatctggcagtccgccccggatatcgggcgaaagttagagcggttagaagatttaaagagcaagaccttaggagacttacgactcggaccgatg

SEQ ID NO: 3628 - DNA, 203 bp, Homo sapiens
  source 1..203: mol_type = other DNA
ggcgcgccagtcctcaaagtagacggcatctctgcggggatacacgccgctcacgtaaaagcggcgacaacccctccggccggaacggcatcaggaccgacatgaaaggtccagcattctcaaaaccccttaaagataagattaacccgtggggccccctgatagtcctggggatcttaataagggcacgactcggaccgatg

SEQ ID NO: 3629 - DNA, 203 bp, Homo sapiens
  source 1..203: mol_type = other DNA
ggcgcgccagtcctgaccgaagccgcgccgcgcgtcttgtctgctgcagcatcgttctgtgttgtctctgtctgactgtgtttctgtatttgtctgagaatatgggccagactgttaccactcccttaagtttgaccttaggtcactggaaagatgtcgagcggatcgctcacaaccagtcggtagatcgactcggaccgatg

SEQ ID NO: 3630 - DNA, 203 bp, Homo sapiens
  source 1..203: mol_type = other DNA
ggcgcgccagtcctcctcaaagtagacggcatcgcagcttggatacacgccgcccacgtgaaggctgccgaccccgggggtggaccatcctctagactgacatggcgcgttcaacgctctcaaaaccccttaaaaataaggttaacccgcgaggccccctaatccccttaattcttctgatgctcagacgactcggaccgatg

SEQ ID NO: 3631 - DNA, 203 bp, Homo sapiens
  source 1..203: mol_type = other DNA
ggcgcgccagtccttacaggctctctacttagtccagcacgaagtctggagacctctggcggcagcctaccaagaacaactggaccatcctctagactgacatggcgcattcaacgccatgctcccaaacttccctggctgttcctaatcatttctccctagtgtctcatgtgactgtcccatctgagcgactcggaccgatg

SEQ ID NO: 3632 - DNA, 203 bp, Homo sapiens
  source 1..203: mol_type = other DNA
ggcgcgccagtcctcaaagggacctcaaggctttccgagggacactaggctgactccatcgagccagtgtagagataagcttttgtttctgtttattttttatgggaccccttattgtactcctaatgattttgctcttcggaccctgcattcttaatcgattagtccaatttgttaaagacaggatacgactcggaccgatg

SEQ ID NO: 3633 - DNA, 203 bp, Homo sapiens
  source 1..203: mol_type = other DNA
ggcgcgccagtcctcgcccgaacagggaccctcggataagtgacccttgtctctatttctactattttgtgttcgtcttgttttgtctctatcttatctggctattatcacaagagcggaacggactcaccacagggaactgcagtctcgcctacagagaagaggtaggttacggtgagccattggaacgactcggaccgatg

SEQ ID NO: 3634 - DNA, 203 bp, Homo sapiens
  source 1..203: mol_type = other DNA
ggcgcgccagtcctctattatcacaagagcggaacggactcaccacagggaactgcagtctcgcctacagagaagaggtaggttacggtgagccattggaaatgggggtctcgggatcaaaagggcagaaactctttgtttctgttctacaaagactcctctcagagaggggtcttcatgtgaaagagcgactcggaccgatg

SEQ ID NO: 3635 - DNA, 203 bp, Homo sapiens
  source 1..203: mol_type = other DNA
ggcgcgccagtcctaggctttaaatccattagattggacacaatatttcatttttataggtgttggagccctgcttttagtcattgtacttatgattttccccattgttttccagtgccttgcgaagagccttgaccaagtgcagtcagatcttaacgtgcttcttttaaaaaagaaaaaagggggaacgactcggaccgatg

SEQ ID NO: 3636 - DNA, 203 bp, Homo sapiens
  source 1..203: mol_type = other DNA
ggcgcgccagtcctttgtttttctgagaacatcagctctggtattttcccatgccttgcaaaatggcgttactgcagttagctggctaagccttatgaaggggtctttcattcccccctctttctgtaaactgaataaaatcttttattcacgtgatttttaatcttttactgtcttaagtagccaaccgactcggaccgatg

SEQ ID NO: 3637 - DNA, 203 bp, Homo sapiens
  source 1..203: mol_type = other DNA
ggcgcgccagtcctgccgaaaccgcgccgcgcgtcttatctgtctcagtgttattttgtcatttgtctggttcgttattgttttggaccgtttctaaaaatatgggacagaccgtaaccactcctttgagtctgaccctagaacactggggagacgtccagcgcattgcgtccaaccagtccgtggaccgactcggaccgatg

SEQ ID NO: 3638 - DNA, 203 bp, Homo sapiens
  source 1..203: mol_type = other DNA
ggcgcgccagtcctcctactgggaaaagtagggaaatacccttcacaggacgaaaaggcgctgctgggggacaggaggagggttcgcagccctgagacttaaagaaggggacgagccctccgcctgaacctgaggagtgcaaaggcagcgctagtaagaaaaccgccgtggtgaatctagatagagaccgactcggaccgatg

SEQ ID NO: 3639 - DNA, 203 bp, Homo sapiens
  source 1..203: mol_type = other DNA
ggcgcgccagtcctaagaaggggacgagccctccgcctgaacctgaggagtgcaaaggcagcgctagtaagaaaaccgccgtggtgaatctagatagagacatggcgacgcaaggctcaaaggagaagaagggataccctgagctcaaagaggtcattaagacaacatgtaaaataaaggtggggccccgactcggaccgatg

SEQ ID NO: 3640 - DNA, 203 bp, Homo sapiens
  source 1..203: mol_type = other DNA
ggcgcgccagtcctcaaaggttcccatggtccgggaccgaagggttatacgataccttggtctatacaggattgctgggacatggaatcaatatataattaatggaggaagcaccaagaagaaggccaggaggcagcagagaagctgaagggatatttcggtattatgaggattgggaatgctgggaccgactcggaccgatg

SEQ ID NO: 3641 - DNA, 203 bp, Homo sapiens
  source 1..203: mol_type = other DNA
ggcgcgccagtccttctccatggaatactcctatattcatcattaagaaaaaatcaggtagctggcgtcttttacaggatctaagagccgttaataaggtaatggtccccatgggagcccttcagcctggtcttccctctcctgtagccatccccctaaactatcacaaaattgttattgaccttaagcgactcggaccgatg

SEQ ID NO: 3642 - DNA, 203 bp, Homo sapiens
  source 1..203: mol_type = other DNA
ggcgcgccagtcctctcagcctgcatatacgatcaaaaggaggatggcccccgctggctccctgagcgactaattagacacatcaataatcagacagcccccttgtgtgacaggccaagtaacccaaatacagccccagggccaaaaggctcgccctgaggagctccttttctcttcttccaggaagacgactcggaccgatg

SEQ ID NO: 3643 - DNA, 203 bp, Homo sapiens
  source 1..203: mol_type = other DNA
ggcgcgccagtcctcttgtgtgacaggccaagtaacccaaatacagccccagggccaaaaggctcgccctgaggagctccttttctcttcttccaggaagaatgctctgcatcctcatcctcctactgcacccacgcctctgcccagtcacaaagggaggacttggaaagccatccggagacatttaccgactcggaccgatg

SEQ ID NO: 3644 - DNA, 203 bp, Homo sapiens
  source 1..203: mol_type = other DNA
ggcgcgccagtcctcgtggggctcgatgccggcctccgtggaccgccgtcccctgtaaccggttccctgcacggccgtcccgattaaccgattccccgcacggagcaccgcggaccacccgaccgcgagccgactcctggagttcgttcctcatttcgacggcggcattactcaagtaagacccaatccgactcggaccgatg

SEQ ID NO: 3645 - DNA, 203 bp, Homo sapiens
  source 1..203: mol_type = other DNA
ggcgcgccagtcctggagcaccgcggaccacccgaccgcgagccgactcctggagttcgttcctcatttcgacggcggcattactcaagtaagacccaatcatgggacaagcatcttcacacagtgaaaatgatctctttataagtcacttaaaggaatctctcaaggtgcgtagaattcgggttcgccgactcggaccgatg

SEQ ID NO: 3646 - DNA, 203 bp, Homo sapiens
  source 1..203: mol_type = other DNA
ggcgcgccagtcctatgagcttaatgataagaactggaaatcctttttctcaaggacgtggtccagattaagtttgcacgaggacgaggacaaggaaaacgatggagactctttgccaacgtttaaatgtgtgtcaggacaaaatactaacacattatgaaaatgatagtacagacctacgtgaccatcgactcggaccgatg

SEQ ID NO: 3647 - DNA, 203 bp, Homo sapiens
  source 1..203: mol_type = other DNA
ggcgcgccagtccttacgaacatattttgtgcagtttaaagatgatgcagaaaaatatagtaaaaataaagtatgggaagttcatgcgggtggtcaggtaatattatgtcctacatctgtgtttagcagcaacgaagtatcctctcctgaaattattaggcagcacttggccaaccaccccgccgcgacgactcggaccgatg

SEQ ID NO: 3648 - DNA, 203 bp, Homo sapiens
  source 1..203: mol_type = other DNA
ggcgcgccagtcctcaagcagaaccggacagagcccattacaatattgtaaccttttgttgcaagtgtgactctacgcttcggttgtgcgtacaaagcacacacgtagacattcgtactttggaagacctgttaatgggcacactaggaattgtgtgccccatctgttctcagaaaccataatctacccgactcggaccgatg

SEQ ID NO: 3649 - DNA, 203 bp, Homo sapiens
  source 1..203: mol_type = other DNA
ggcgcgccagtcctattatttacaaggaacttttaaaaactattatgtactgtttgctgacgatgcgaaaagatatggtacaactggagaatgggaagtaaaagttaataaggaaactgtgtttgctcctgtcaccagctccacgcctccagggtcgccaggaggacaagcagacacaaacaccaccccgactcggaccgatg

SEQ ID NO: 3650 - DNA, 203 bp, Homo sapiens
  source 1..203: mol_type = other DNA
ggcgcgccagtcctcagctccacgcctccagggtcgccaggaggacaagcagacacaaacaccacccccgcgacccccaccacctccacaaccgccgttgactccacgtccagacagctcaccacatcaaaacagccacaacaaaccgaaaccagaggaagaaggtacggacggaggccctccagcaacgactcggaccgatg

SEQ ID NO: 3651 - DNA, 203 bp, Homo sapiens
  source 1..203: mol_type = other DNA
ggcgcgccagtcctagttagattgctgtggcagaggccttccctttcataaggtgaggaacgcctggaagggaatctgtaggcagtgtaagcatttttatcatgattggtaaagaggtcaccgtgcaagatattattctggagctcagtgaggtgcagcccgaagtgctaccagttgacctgttttgtcgactcggaccgatg

SEQ ID NO: 3652 - DNA, 203 bp, Homo sapiens
  source 1..203: mol_type = other DNA
ggcgcgccagtcctccacagaatttggtattagagctttccaacagctactgaccggagatctgcagctcctgtgccctgactgtcgcggaaactgcaaacatgacggatcctaattctaaaggtagtacatctaaagaagggtttggtgattggtgtttattggaagctgactgtagtgatgtagaacgactcggaccgatg

SEQ ID NO: 3653 - DNA, 203 bp, Homo sapiens
  source 1..203: mol_type = other DNA
ggcgcgccagtcctaggggaatgcagccaaaccatgacctcaggaaggaaagtgcatgactcacagggaggagctgcttacccatggaatgcagccaaaccatgacctcaggaaggaaagtgcatgacagacatgttttgcgagcctaggaatcttggccttgtccccagttaaactggacaaaggcccgactcggaccgatg

SEQ ID NO: 3654 - DNA, 203 bp, Homo sapiens
  source 1..203: mol_type = other DNA
ggcgcgccagtcctcaaaagtaccactgctttacctgctgtaaaagactctgtaaaagactcctaggtaagtaatccctttttttttgtatttccaggttcatgggtgctgctctagcacttttgggggacctagttgccagtgtatctgaggctgctgctgccacaggattttcagtggctgaaattcgactcggaccgatg

SEQ ID NO: 3655 - DNA, 203 bp, Homo sapiens
  source 1..203: mol_type = other DNA
ggcgcgccagtcctggcctaactcctcaaacatatgctgtaattgctggtgctcctggggctattgctgggtttgctgctttaattcaaactgttagtggtattagttccttagctcaagtagggtataagttctttgatgattgggatcacaaagtttccactgtaggcctctatcagcaatcaggccgactcggaccgatg

SEQ ID NO: 3656 - DNA, 203 bp, Homo sapiens
  source 1..203: mol_type = other DNA
ggcgcgccagtcctcgaacctctccactcagtccctctagacaataaagtccgagatgtcctaaagtcaacatgaaaaaaacaggcaacaccactgataaaatgaactttctacgtaagatagtgaaaaattgcagggacgaggacactcaaaaaccctctcccgtgtcagcccctctggatgacgatcgactcggaccgatg

SEQ ID NO: 3657 - DNA, 203 bp, Homo sapiens
  source 1..203: mol_type = other DNA
ggcgcgccagtcctgagaggcaatcttcctcccgtgaaggacacaagcagtagctcacaatcatctcgtgtttcagcaaagtgtgcataattataaagtgctgggtcatctaagcttttcagtcgagaaaaaaacagtagatcagaagaacaactggcaacacttctcatcctgagacctacttcaagcgactcggaccgatg

SEQ ID NO: 3658 - DNA, 203 bp, Homo sapiens
  source 1..203: mol_type = other DNA
ggcgcgccagtccttgggtcatctaagcttttcagtcgagaaaaaaacagtagatcagaagaacaactggcaacacttctcatcctgagacctacttcaagatgctcgatcctggagaggtctatgatgaccctattgacccaatcgagttagaggctgaacccagaggaacccccactgtccccaaccgactcggaccgatg

SEQ ID NO: 3659 - DNA, 203 bp, Homo sapiens
  source 1..203: mol_type = other DNA
ggcgcgccagtcctggacttgcataggccattacaaccatgtactaataaatgctattgcaaaaaatgctgttatcactgtgagctttgcttcctgcagaagggcttaggagtgcgttatcatgtctctaggaaaagaagaaaaacaagcactcaagataatcaagaccctatacggcagcagtaagtcgactcggaccgatg

SEQ ID NO: 3660 - DNA, 203 bp, Homo sapiens
  source 1..203: mol_type = other DNA
ggcgcgccagtcctgctgcagcttgagaataaggacttggtgttacaacatctgcctgaccctcctcatattcatcaggacagcagtgggatacctgcagtatgggctccagcaactccaagaggcagcaacagggcttgctcaagctctggcgagggctgcgagggaagcctggggcagactgggtgcgactcggaccgatg

SEQ ID NO: 3661 - DNA, 203 bp, Homo sapiens
  source 1..203: mol_type = other DNA
ggcgcgccagtcctgcaccgaccgctgagttgctgagcgtcggagagggacgactcaggtagggtgagagcctacgagttttttgctacctagtcagcgagaaaggctaggccgcgacaggggcgcgggtcccattagtggcaaccaacccagttggacgaagggttggtaggggacgggtcggagcacgactcggaccgatg

SEQ ID NO: 3662 - DNA, 203 bp, Homo sapiens
  source 1..203: mol_type = other DNA
ggcgcgccagtccttgtttgtgttatatagacatcttggtgtattgtaacataatatgtggtagcctgtacggatcccacatagggggttgtatatcatatgttgttgttgtgtgtaccctagtgtgctattgtggcaccattctttttctatttttgtttttttttttacagttaaataaagcaacccgactcggaccgatg

SEQ ID NO: 3663 - DNA, 203 bp, Homo sapiens
  source 1..203: mol_type = other DNA
ggcgcgccagtcctgttgttgttgtgtgtaccctagtgtgctattgtggcaccattctttttctatttttgtttttttttttacagttaaataaagcaaccatggtggcacaacgtgcaaggcgtcgcaagcgtgcatccgccacacagctttataggacctgcaaggcctcaggcacatgccccccacgactcggaccgatg

SEQ ID NO: 3664 - DNA, 203 bp, Homo sapiens
  source 1..203: mol_type = other DNA
ggcgcgccagtcctagaaaaagacagacatcgtaacgaacggcgacgactgcacaaaatatcagggtactggagaggtagttgtgagtattgctggtcacgatgcagggtccgcatcccacagtaaaagatatcgaattgagtcttgcaccagaggatatccctgtatgcaatgtgcaattagatgaacgactcggaccgatg

SEQ ID NO: 3665 - DNA, 203 bp, Homo sapiens
  source 1..203: mol_type = other DNA
ggcgcgccagtcctccacttcccctttgtcttctacactttccactaagtatggaaatgtaacaattccctttgtgtctcctgttgatgtaactttacatactgggcctgatattgtactacctacttcagcacagtggccatatgtgcccctgtcacctgctgacaccacccattatgtgtacatagcgactcggaccgatg

SEQ ID NO: 3666 - DNA, 203 bp, Homo sapiens
  source 1..203: mol_type = other DNA
ggcgcgccagtcctctgggcctgatattgtactacctacttcagcacagtggccatatgtgcccctgtcacctgctgacaccacccattatgtgtacatagatggcggggatttctatctttggcctgttacctttcacttctcccgacatcgtcgccgtaaacgtgtctcatatttttttgcagatgcgactcggaccgatg

SEQ ID NO: 3667 - DNA, 203 bp, Homo sapiens
  source 1..203: mol_type = other DNA
ggcgcgccagtccttagatggcggggatttctatctttggcctgttacctttcacttctcccgacatcgtcgccgtaaacgtgtctcatatttttttgcagatggcactctggcgctctagtgacaacttggtgtacctgcctcccactcccgtgtctaaagttctcagcacggacgactatgtgacacgactcggaccgatg

SEQ ID NO: 3668 - DNA, 203 bp, Homo sapiens
  source 1..203: mol_type = other DNA
ggcgcgccagtcctgagtgcagccacgcagatataagggcactggaacagctgctactaggcacattgaagctcgtgtgtcctcgctgcgtgtaacaggacatggacgataatacaggtacagaggggggcgcatgttccgaatcggaacgggcgggtggatggtttatagtggaagccattgtagatcgactcggaccgatg

SEQ ID NO: 3669 - DNA, 203 bp, Homo sapiens
  source 1..203: mol_type = other DNA
ggcgcgccagtccttttgcttattttttatacctgcttgttttttacatttttatactgtaatggtaattgctacttagtccctttaataaacgtgttacaatggtagctgtccgtgcccctcgacgcaaacgagcatcagctacagacttatacaaaacatgtaaggccgctggtacgtgccctcctcgactcggaccgatg

SEQ ID NO: 3670 - DNA, 203 bp, Homo sapiens
  source 1..203: mol_type = other DNA
ggcgcgccagtcctccagacaagctggacaagaagtgtgttacagaattgaagcacaatgttgtatgtgtaatagtatagtgcagctagctgtgcagagcagtcgacagaacgttcgagtgctggagcagatgttaatggaagacgtgtccttggtgtgccatcagtgtgctgcacagtaaacctgcacgactcggaccgatg

SEQ ID NO: 3671 - DNA, 203 bp, Homo sapiens
  source 1..203: mol_type = other DNA
ggcgcgccagtcctctacaaatattaatgtaggccctgacctttcacctcctgagtctccgccctttattagtacacgtcctgtatcaccttcttttgactctgttatggtattaggatgggattttatattgcatcccagttatatgtggcgtaagcgccgtaaacctgtaccatatttttttgcagcgactcggaccgatg

SEQ ID NO: 3672 - DNA, 203 bp, Homo sapiens
  source 1..203: mol_type = other DNA
ggcgcgccagtcctacctataaaacaggacatacaacgttacagaatagtgtgtggttgtacacagtgtggacggtcagttaaacttgttgtcagtagtacaggcgcggacatacaacagctgcatcagatgcttctggacacactgggcattgtgtgtccattgtgtgcctgcgtggagtgactgcacgactcggaccgatg

SEQ ID NO: 3673 - DNA, 203 bp, Homo sapiens
  source 1..203: mol_type = other DNA
ggcgcgccagtcctaggcgcggacatacaacagctgcatcagatgcttctggacacactgggcattgtgtgtccattgtgtgcctgcgtggagtgactgcaatggcggatgatacaggtacagaggaggggctagggtgttctggttggttttctgtagaagcaatagtagaaaggactacagaaaatcgactcggaccgatg

SEQ ID NO: 3674 - DNA, 203 bp, Homo sapiens
  source 1..203: mol_type = other DNA
ggcgcgccagtcctgccctgatattgctttacctgtacctactgcagaaaccatttttaccccaactgtacctgtacagccttctggtcctatatatatatatgggtccgattttatattgcatcctagcttgtatgtcattccacgcaaacgtaaacgtttgtcatatttttttgcagatgtggcgacgactcggaccgatg

SEQ ID NO: 3675 - DNA, 203 bp, Homo sapiens
  source 1..203: mol_type = other DNA
ggcgcgccagtcctgaaagtaacaatcctacttttatagacagggagtaaccgaaataggtttaggaccgaaaacggtacatataaaagcactgtgtacaacacccaggacatccatggatcgtcagttatttgaaaatacagaagagcgaccacgtacattgcaccagctatgtgaagttgtgaatacgactcggaccgatg

SEQ ID NO: 3676 - DNA, 203 bp, Homo sapiens
  source 1..203: mol_type = other DNA
ggcgcgccagtccttacttttatagacagggagtaaccgaaataggtttaggaccgaaaacggtacatataaaagcactgtgtacaacacccaggacatccatggatcgtcagttatttgaaaatacagaagagcgaccacgtacattgcaccagctatgtgaagttgtgaataaaccattgctggagcgactcggaccgatg

SEQ ID NO: 3677 - DNA, 203 bp, Homo sapiens
  source 1..203: mol_type = other DNA
ggcgcgccagtcctagggaggcaagtggcgggaaagagcaaaatggaggctcacaacatagtgtgtgtagcagagatgggagcatagggtcaggaagtgatatggatgtggatagacaggatataatgccactgcaacaaatacaagatatattaaaatgtagtaatgtgcaggccaagctatattgtcgactcggaccgatg

SEQ ID NO: 3678 - DNA, 203 bp, Homo sapiens
  source 1..203: mol_type = other DNA
ggcgcgccagtcctaccaattaaataatgcaaactggaaatgtttttttgaaaggacatggtccagattagatttggataacgacgaagacaaggaaaacgatggagacgctatgccaacgtttagatgcgtgccaggagaaaattctagactgttttgaaagagatagcaaaaatattacagaccatcgactcggaccgatg

SEQ ID NO: 3679 - DNA, 203 bp, Homo sapiens
  source 1..203: mol_type = other DNA
ggcgcgccagtccttacttatacttttattttggtttgttgtggcatcatcctacataaccacatttacactatatatactttttttttacttccctttattatgtttctatagccatgctgtgtggttaattaacacacaataaatcacagtttttttgtattgtatgtatttgtgtgttatatatacgactcggaccgatg

SEQ ID NO: 3680 - DNA, 203 bp, Homo sapiens
  source 1..203: mol_type = other DNA
ggcgcgccagtccttatgtttctatagccatgctgtgtggttaattaacacacaataaatcacagtttttttgtattgtatgtatttgtgtgttatatataatggttgcccaccgggcacgcagacgtaagcgggcatcagcaacgcagctatatcaaacatgtaaacaatctggcacatgtcctgagcgactcggaccgatg

SEQ ID NO: 3681 - DNA, 203 bp, Homo sapiens
  source 1..203: mol_type = other DNA
ggcgcgccagtccttagttatacagggctccacatttgcgttatggcctgtttattttttgaaacgtaggcgtcgtaaacgtattccctattttcttgcagatggcggtgtggcggcctagtgacagcaaggtttatctgcctcctacccctgtatcaaaggtcattacaacggatgcctatgtaaaacgactcggaccgatg

SEQ ID NO: 3682 - DNA, 203 bp, Homo sapiens
  source 1..203: mol_type = other DNA
ggcgcgccagtcctacggtttcacaaaatttcacatatgtggaccgggtcgtgcctgacatgctggagacacacaacagcaactgaatcagcagtataatcatgcacggtaacgtaccaacacttccacaatatattatagaacttataccacaaactgagattgacctgcaatgccatgagcaattgcgactcggaccgatg

SEQ ID NO: 3683 - DNA, 203 bp, Homo sapiens
  source 1..203: mol_type = other DNA
ggcgcgccagtccttagacgggacgaacaacatccttgttacctaattgaaacacagtgttgtaggtgtgagtcgttggtgcagttggctgttcagagttcaacaaaagagctgcgtattttacaacaaatgcttatgggcacagtggagcttgtgtgccccctctgcgcaacaaggcgataactgcacgactcggaccgatg

SEQ ID NO: 3684 - DNA, 203 bp, Homo sapiens
  source 1..203: mol_type = other DNA
ggcgcgccagtccttgtttaataattgtacagttactaaagggcgtaaccgaaaagggtccgaccgaaaacggtacatataaaaaccaacccaaaaaacctgatctggggccactatgtctgcacgttgcggctccacagctagaactttatttgaattatgtgaccagtgcaatataacattgcctacgactcggaccgatg

SEQ ID NO: 3685 - DNA, 203 bp, Homo sapiens
  source 1..203: mol_type = other DNA
ggcgcgccagtcctcattcttaacatctggtcctgacatagtgtttccttctgttcctgcaggtacaccatatttgcctgtgtcaccttctatacctgccatatctgtactgattcgcggtactgattattatttgaatcctgcatactatttcagaaaacgccgaaagcgcatattagcatattaggcgactcggaccgatg

SEQ ID NO: 3686 - DNA, 203 bp, Homo sapiens
  source 1..203: mol_type = other DNA
ggcgcgccagtccttatctgtactgattcgcggtactgattattatttgaatcctgcatactatttcagaaaacgccgaaagcgcatattagcatattaggatgtggcaacttaatgaaaaccaagtgtatttaccaccgcccacgcctgttgctacaattgttagcacagatgagtacgtgcaacgccgactcggaccgatg

SEQ ID NO: 3687 - DNA, 203 bp, Homo sapiens
  source 1..203: mol_type = other DNA
ggcgcgccagtcctggacttgcaagtaaatttgcaatcatttaaaatagtaacacattgtgtattttgtcactgtttagttcgcctagtagtccattgtactgctactgatataaggcaggttcatcagttgctgatgggcacactaaatatagtgtgccccaactgtgcagctacagcgtgacaacacgactcggaccgatg

SEQ ID NO: 3688 - DNA, 203 bp, Homo sapiens
  source 1..203: mol_type = other DNA
ggcgcgccagtcctgaaatgttgatgatctgtaagctttactaacgctaacgctggcattgctactaacccatactaactaacaaacccatactaactaacatggttcgtgcaaaacgtactaaacgtgcctctgttacagatatatacagaggctgcaaagctgctggtacatgtccaccagatgtacgactcggaccgatg

SEQ ID NO: 3689 - DNA, 203 bp, Homo sapiens
  source 1..203: mol_type = other DNA
ggcgcgccagtcctaacctgcagaggaggagcagtgtctcactccctacaagatcgtagctggctgtggttgcggtgcaagacttcgtttatacgtgcttgctacaaatttaggaattcgagcgcaacaggaacttttgctgggtgatatacaactggtgtgtccggagtgccgaggcagacttcgcccgactcggaccgatg

SEQ ID NO: 3690 - DNA, 203 bp, Homo sapiens
  source 1..203: mol_type = other DNA
ggcgcgccagtcctcctaaattttcaatcatacacataataaccattttagtagcgttgcctttcagtacagtctaggtgattgttgaaagacttccaagcatggcagaattatcaacgcgttacaacttgcctgcaaatgttacggaaaatagtataaatcttgaccttaattccacagcacgatggcgactcggaccgatg

SEQ ID NO: 3691 - DNA, 203 bp, Homo sapiens
  source 1..203: mol_type = other DNA
ggcgcgccagtcctttaatttctttaaatttgaccagaataatattttgtcagtgaatatattctcatatcacttgattaaaaacagaaaattaccctaacatgaagaccacatgtttccttatcagtcttatcttaattcaagggacaaaaaatctccccattttagagatagctagtaataatcaacgactcggaccgatg

SEQ ID NO: 3692 - DNA, 203 bp, Homo sapiens
  source 1..203: mol_type = other DNA
ggcgcgccagtccttccggcccctgaatgtggctaaccttaaccctgcagccgttgcccataatccaatgggtttgcggtcgtaatgcgtaagtgcgggatgggaccaactactttgggtgtccgtgtttcctgtttttcttttgattgcattttatggtgacaatttatagtgtatagattgtcatccgactcggaccgatg

SEQ ID NO: 3693 - DNA, 203 bp, Homo sapiens
  source 1..203: mol_type = other DNA
ggcgcgccagtcctggaacacccacctgctagccccgctgctctctttgctttcctcctcgcttcggtctcccccaactcctagcatcccctcctatcgctatggtctactccctctcgcgatgcgctctctgttcgctgaaggggtcctctggaggtgatttctctgttctactccgtgtggcttcccgactcggaccgatg

SEQ ID NO: 3694 - DNA, 203 bp, Homo sapiens
  source 1..203: mol_type = other DNA
ggcgcgccagtcctttctgtgactatattatctttcatttttttgcaacttttgcttagtctgtaagttttgggtgctatttctgttactgcgagcccgtaatggaaacgacaaagaaccggcgtgtgcgatttactggaggccttcatgagccagcgcaagattctacgatgtgtgggaatgctgagcgactcggaccgatg

SEQ ID NO: 3695 - DNA, 203 bp, Homo sapiens
  source 1..203: mol_type = other DNA
ggcgcgccagtcctgaatgacaaggctgcacagattatagagaccagccagatccgtaaattaatggtgtctacacgactggaggccataccagctctgtgatggagaacaggtttcagaacgatactctgttctcagagtggttcggtcagagtttgtccgatgtaagatttccggacaatgtcacccgactcggaccgatg

SEQ ID NO: 3696 - DNA, 203 bp, Homo sapiens
  source 1..203: mol_type = other DNA
ggcgcgccagtccttatcagaagtgtttaatttaacccaaacgcaccccgaaaacagcgaaccgattttcgattcgaacattttctccccaaacccggagaatgaaatccttgaaaaaattaaaagaattagaaacctcagacgtattcaacatcttacacgtccgaactatcctaaaggtgatcaagcgactcggaccgatg

SEQ ID NO: 3697 - DNA, 203 bp, Homo sapiens
  source 1..203: mol_type = other DNA
ggcgcgccagtcctggcaaaaaaggcagaggttgagcgaattcatcaatacctatgcacagagcatcagcaaattcgctgttgaactcggtttcgggatccatgatgtggcgaaaccaatcttccggcagacgcccctccaagcgtctttctgataacgaagccaccttatctacaatcaactctattcgactcggaccgatg

SEQ ID NO: 3698 - DNA, 203 bp, Homo sapiens
  source 1..203: mol_type = other DNA
ggcgcgccagtccttcatttgtgttagatgagcggcaaatgactcatctttctgggatttatatgggaatattctggtaaaagtgcatgtatcaattttagtcgtttttggatttctgtaatgttacgatttgctatgtgtattttcatgatgtcgagcatgtttattttattttttacacagataagcgactcggaccgatg

SEQ ID NO: 3699 - DNA, 203 bp, Homo sapiens
  source 1..203: mol_type = other DNA
ggcgcgccagtcctcgaatggacatttcgacaagtctttttccctactatatataagatgttgttcccgtcgtgttaacttttccaaataaaaaaataaccatggaacttttactatttgtaatgtcactcatattactaaccttctcaaaagcaatacctcttttcaaccataattctttctattttcgactcggaccgatg

SEQ ID NO: 3700 - DNA, 203 bp, Homo sapiens
  source 1..203: mol_type = other DNA
ggcgcgccagtcctactgtctattaagcttcaattttataaacatgttttccagaacaaaaatgcaaacaaggaaatgataacgacgtcattcaaagcgccatgaaattatccggactatactgtgatgcggacatcacacacacacaaccgttgagtgataatacgcatcaagatcctatatattctcgactcggaccgatg

SEQ ID NO: 3701 - DNA, 203 bp, Homo sapiens
  source 1..203: mol_type = other DNA
ggcgcgccagtcctgatgtgcagacatctagaggtgacaagccaggggaattaccttattttccgtatacaactataaaaaacttgggaggcgcaaacggtatgttttccataataaatccgagtgatgatttctggactaaggacaaatatatcatgttgactatcaaaggccccatggagtgggagcgactcggaccgatg

SEQ ID NO: 3702 - DNA, 203 bp, Homo sapiens
  source 1..203: mol_type = other DNA
ggcgcgccagtcctaaccctagccataaccgcataactctgttcacaaccctaacactaatcctcgcatccgcacctaacgctgcccctctttcacaccatcaccccctgccgcttcaacttcaccttcttcctccatctcgccccgcttgtttctacacttgtccgcccctctattcttactctaggcgactcggaccgatg

SEQ ID NO: 3703 - DNA, 203 bp, Homo sapiens
  source 1..203: mol_type = other DNA
ggcgcgccagtcctcaccccctgccgcttcaacttcaccttcttcctccatctcgccccgcttgtttctacacttgtccgcccctctattcttactctaggatgccgctaacggtgcgtgccgggcacgcgccatatcgtcttccgctctccaattattggtggctactcttgggtcgacattcccttcgactcggaccgatg

SEQ ID NO: 3704 - DNA, 203 bp, Homo sapiens
  source 1..203: mol_type = other DNA
ggcgcgccagtcctccacccctccccgtcacagaccagcaaacaccttgccacatcgacatcgcgggcggcaaattaaaaaaaaaaataacataaatatagtgaaagagaggcccccgtcccacataaggacagaagaacaggcaaaaaaaaaaacccgtccgttattcacacagcattcggaaagcccgactcggaccgatg

SEQ ID NO: 3705 - DNA, 203 bp, Homo sapiens
  source 1..203: mol_type = other DNA
ggcgcgccagtcctcaaacctcgcactccgtactttaagaaggaaacctccatcgttccggcttctgtattgcactcctcggatttcgatttagaaaacagctgtacgactgtcttccataactttctaacagccatatcggcagatccacttcagagaaaacgaactcgaaacaccactaaaaacagcgactcggaccgatg

SEQ ID NO: 3706 - DNA, 203 bp, Homo sapiens
  source 1..203: mol_type = other DNA
ggcgcgccagtcctcggtttacctttttgctgttgtggttctttgttcttgctggtttgctttggatccgttgtttaatatgtgggcgtaacccttcgacgttgtggtatgacggcgatcttatattaaagatcgcctcgctggacttagtggacgctagtgatcacaaaagagaaggaaaacccagccgactcggaccgatg

SEQ ID NO: 3707 - DNA, 203 bp, Homo sapiens
  source 1..203: mol_type = other DNA
ggcgcgccagtcctggcgggattagttttatcggggcgttcgtaattctgatagtcattttgtgtaattggtataagaaagacaagcagaggtctttgttttgggatgaagagaaaaaaccggatgtacaaatgaggagggatgtaaagacttgcagatgaggttctcatagattgttattagtgattcgactcggaccgatg

SEQ ID NO: 3708 - DNA, 203 bp, Homo sapiens
  source 1..203: mol_type = other DNA
ggcgcgccagtcctcgacggaagtgcgttggcatcaaaacaggaaatgcaatataaaataaccaactacatggtccccgctaaaaacggaactgcgggctctagcttatttaacgagaaggaagatagcgaaagtgacgattccatgcattttgactacagctctaatcccaatcccaagaggcagagcgactcggaccgatg

SEQ ID NO: 3709 - DNA, 203 bp, Homo sapiens
  source 1..203: mol_type = other DNA
ggcgcgccagtcctaataccgcatactgtctgatgaggtcaaagtgatattttttcggggttagtcgattaataaaagctattactctgttgtgtgttacgctatcggctgccagggataaaagttcgatttttgccgtagcggctagtaatgattctggagacgtgctgtttttgagtgaactaaggcgactcggaccgatg

SEQ ID NO: 3710 - DNA, 203 bp, Homo sapiens
  source 1..203: mol_type = other DNA
ggcgcgccagtcctttcctttctttttctacaacattatttaaggttccctcatcgatagatatatattttctcttcttcacagcttccacagtatccacaatggcagctcgtgcactcgatttagagttcatccttagttcactcaaaaacagcacgtctccagaatcattactagccgctacggcacgactcggaccgatg

SEQ ID NO: 3711 - DNA, 203 bp, Homo sapiens
  source 1..203: mol_type = other DNA
ggcgcgccagtcctgcgggaaagttgtaaataaagcttctgcggttgtgacatcacaggagagtataaagcagttctatgaaaaagagaagtcattactgtccggtgtgaagttttggagactaagtgaaagacattgtcggtttgcgcttgtcggcatctgttttcttttagccttgtatttttgttcgactcggaccgatg

SEQ ID NO: 3712 - DNA, 203 bp, Homo sapiens
  source 1..203: mol_type = other DNA
ggcgcgccagtccttaactaatctgcagtcggtattcgagacggtgtcttcaaacgatgctccggtctatgacttttctgaaattctagcggaggaggacgatcaaggaaacggtgtattaaaatgtgatgaaacggaaaccgaaacagatgagccgatgactaagaaaaaccgattataatcggagtcgactcggaccgatg

SEQ ID NO: 3713 - DNA, 203 bp, Homo sapiens
  source 1..203: mol_type = other DNA
ggcgcgccagtcctttatatttaacaataatcggaaagattaaatgttcactgggacttctacataggatactaaaaattacgttggcggcatcgtattcagtcgcaaacactacgatggtcattgtgtagagctctgttgattacagatgaatttagctttaaatgtccttggggtattggggtgttcgactcggaccgatg

SEQ ID NO: 3714 - DNA, 203 bp, Homo sapiens
  source 1..203: mol_type = other DNA
ggcgcgccagtccttggagaataaaagtccacttccgtagcggccgcaaaaacaagaatgtaaaagaggcagagactgacatataagctttgccttgcgcttttcttacaactcatcttaagcgttattttcaactagtcttcgcgtcgacgtgattaacagcagacagctctctgtcacctggaaaacgactcggaccgatg

SEQ ID NO: 3715 - DNA, 203 bp, Homo sapiens
  source 1..203: mol_type = other DNA
ggcgcgccagtcctagcatgtcgggtgagttgaccacaatgaatttgtacaagtagaatgtgtgactaaaatagtatttgctttttttataggattggacgatgacctccaaatgcatgctgtgttggaccgcgattacgaatgccctggctattttaatgttattactagtaatttaccgggcgatacgactcggaccgatg

SEQ ID NO: 3716 - DNA, 203 bp, Homo sapiens
  source 1..203: mol_type = other DNA
ggcgcgccagtcctataacgtcgggaatgtgtcagttcaacgctgtcttttttccctaacagtcgtagtatccttaacgcgatcgtagacgtttatgcgagactgccggtaacgctgtcgttatcgttatattttttatttttgttttccatttttaattttatctcggattccgcacagaaaataaacgactcggaccgatg

SEQ ID NO: 3717 - DNA, 203 bp, Homo sapiens
  source 1..203: mol_type = other DNA
ggcgcgccagtcctactgccggtaacgctgtcgttatcgttatattttttatttttgttttccatttttaattttatctcggattccgcacagaaaataaaatgttttgtggctctccgtttctcggcatatcttcttggagtctggcatctgcggctctgtgtcctccttcgtgctctttctctgcgcgactcggaccgatg

SEQ ID NO: 3718 - DNA, 203 bp, Homo sapiens
  source 1..203: mol_type = other DNA
ggcgcgccagtcctccatccgtcatacaaaatgacctcatcccttaaaaaaacacagtatttaaaaagggagatgaaacataaaatgttttttgtaccagcatgttttctcctcaactaaaccatgtcttgcaactcgtttttgattgcaatcacatagtttcgaattcttaccaagaaatcattttgcgactcggaccgatg

SEQ ID NO: 3719 - DNA, 203 bp, Homo sapiens
  source 1..203: mol_type = other DNA
ggcgcgccagtcctttcagcaagtaactgagaggtgggaagctcaaagccaaagtcctaatgtgcagtcaggtgaatttattgaaaaatttgaggctcctggtggtgcaaatcaaagaactgctcctcagtggatgttgcctttacttctaggcctgtacggaagtgttacttctgctctaaaagcttcgactcggaccgatg

SEQ ID NO: 3720 - DNA, 203 bp, Homo sapiens
  source 1..203: mol_type = other DNA
ggcgcgccagtcctaccctaactgacacacattccacagctggttctttccgcctcagaaggtacctaaccaagttcctctttcagaggttatttcaggccatggtgctgcgccggctgtcacgccaggcctccgttaaggttcgtaggtcatggactgaaagtaaaaaaacagctcaacgcctttttcgactcggaccgatg

SEQ ID NO: 3721 - DNA, 203 bp, Homo sapiens
  source 1..203: mol_type = other DNA
ggcgcgccagtcctcgggaaacgcaaaaaaccagaaaggttaactgaaaaaccagaaagttaactggtaagtttagtctttttgtcttttatttcaggtccatgggtgctgctttaacactgttgggggacctaattgctactgtgtctgaagctgctgctgctactggattttcagtagctgaaattcgactcggaccgatg

SEQ ID NO: 3722 - DNA, 203 bp, Homo sapiens
  source 1..203: mol_type = other DNA
ggcgcgccagtcctagattttcttgcacgtgcatgcgtttgcttcggacagcattagcagcggttggtttgaaagagatattcttttgtttctaccagtcgtgaacgtgttgagaaaaagacagcttaggagaacaagagctggggatggtcaagaaggccatcctgaaaggtaaggggggcggtccccgactcggaccgatg

SEQ ID NO: 3723 - DNA, 203 bp, Homo sapiens
  source 1..203: mol_type = other DNA
ggcgcgccagtcctctgaatttggaatacgttgttttgagcaactgttactgaaagagctttgtttattttgtcctgcgtgctccagacaacttccccgcaatggcagatcataaaggtactgataatattgatcataatgatgttttagatgggtcttggtgtttaataactgaagctgaatgtgagcgactcggaccgatg

SEQ ID NO: 3724 - DNA, 203 bp, Homo sapiens
  source 1..203: mol_type = other DNA
ggcgcgccagtcctaagcttacttgctatctgatttgattggtagacctttgagtgaaatcgcaattcgctgtgaaaattgtatgtgtttgttggattatattgaaaagtacgattgtatttgtcacggtggttattttcatttagttagaggtaattggaggggctgttgtagaaattgttacgaaccgactcggaccgatg

SEQ ID NO: 3725 - DNA, 203 bp, Homo sapiens
  source 1..203: mol_type = other DNA
ggcgcgccagtcctacatagcagaatctgaaaggtcaccattcaagattgattctacgtgtaagcattgtcattgtcgcgttagactgtgttgtgtcgccaccgacgcagctatccgtgtgtttgagtgccttcttcaatcagaattttcttttctgtgtcttaagtgctccaaagaattgctacgaacgactcggaccgatg

SEQ ID NO: 3726 - DNA, 203 bp, Homo sapiens
  source 1..203: mol_type = other DNA
ggcgcgccagtcctcagctttgcaagtatcagagtacaaagccaagcaggcaatcgaaatgggattgttattaaccagtttaagcaaatcccaatatgcttcagaactatggggtttaacagatacaagtgcagaattgttattaacccctccaagaaatacatttaaaaagaagggatatactgtaacgactcggaccgatg

SEQ ID NO: 3727 - DNA, 203 bp, Homo sapiens
  source 1..203: mol_type = other DNA
ggcgcgccagtcctttttatgaaattagtaactttgccaagaggttgtacatatacatttggaacattaaactctttgtaatatttgtaaaacaaaacaaaatgtatgctagagtaaagcgtgttaaaagagactctgttgaaaacttatataaacaatgtcaacttggtgctgactgccctcctgatcgactcggaccgatg

SEQ ID NO: 3728 - DNA, 203 bp, Homo sapiens
  source 1..203: mol_type = other DNA
ggcgcgccagtcctaggagaagtattagaagttctaactcgtattcctttgagttctctttctgtacgctgttttgattgccttacattgttatcttttgcagaaaaaatagattgtataattagtggtcaaaacttttatcttgtaaggggtcgctggagatcatattgtagaaattgcattgagaacgactcggaccgatg

SEQ ID NO: 3729 - DNA, 203 bp, Homo sapiens
  source 1..203: mol_type = other DNA
ggcgcgccagtccttagatgtttatgatgacttttatttacatcctcatcttcttaggcgacgcaaacgaaaacggttggattttttttaatgttttacagatggctctttggttgcagacagctggacaattgtatcttccaccaagcaagcctgttgctcgtgtactcagtacggatgaatatgtacgactcggaccgatg

SEQ ID NO: 3730 - DNA, 203 bp, Homo sapiens
  source 1..203: mol_type = other DNA
ggcgcgccagtcctctccttctgctgtaataactcttcgtcaactattgcttcaagaagtgttcctgacctgtttgaggtgctccagatccctttttcgacatggcagatcctaataaaggtattaattctcttgaattaaatgaggggcatagcgaatggtatgttgtgacagaagctgagtgtattcgactcggaccgatg

SEQ ID NO: 3731 - DNA, 203 bp, Homo sapiens
  source 1..203: mol_type = other DNA
ggcgcgccagtcctttcaagaagttacccaaaggctagatttaaaaaccccaaatgtgcaatctggtgaatttatagaaagaagtattgcaccaggaggtgcaaatcaaagatctgctcctcaatggatgttgcctttacttttagggttgtacgggactgtaacacctgctcttgaagcatatgaagcgactcggaccgatg

SEQ ID NO: 3732 - DNA, 203 bp, Homo sapiens
  source 1..203: mol_type = other DNA
ggcgcgccagtcctcacaaggctgtatatataaaaaaaagggaagggatggctgccagccaagcatgagctcatacctagggagccaaccagctaacagccagtaaacaaagcacaaggggaagtggaaagcagccaagggaacatgttttgcgagccagagctgttttggcttgtcaccagctggcccgactcggaccgatg

SEQ ID NO: 3733 - DNA, 203 bp, Homo sapiens
  source 1..203: mol_type = other DNA
ggcgcgccagtcctggtagtgctattgctcagttgggatatagattttttgctgactgggatcataaagtttcaacagttgggctttttcagcagccagctatggctttacaattatttaatccagaagactactatgatattttatttcctggagtgaatgcctttgttaacaatattcactatttacgactcggaccgatg

SEQ ID NO: 3734 - DNA, 203 bp, Homo sapiens
  source 1..203: mol_type = other DNA
ggcgcgccagtcctccccaccgctctcaaagttgacggcatctctgcgtggatacacgccgctcacgtaaaggcggcgacaactcctccggccggagcagcatggaaggtccagcgttctcaaaaccccttaaagataagattaacccgtggggccccctaatagttatagggatcttggtgagggcacgactcggaccgatg

SEQ ID NO: 3735 - DNA, 203 bp, Homo sapiens
  source 1..203: mol_type = other DNA
ggcgcgccagtccttagccggcgagttgacaaggaccagtgggggccgggggcttggagagggactccaagtcccgcccttcccggtgggccgggaaatgcatggggccacccagctccgcggcggcctgcagccggggtagcccaagaatccttcgggtgagggcgggtggcatttcctttttctatcgactcggaccgatg

SEQ ID NO: 3736 - DNA, 203 bp, Homo sapiens
  source 1..203: mol_type = other DNA
ggcgcgccagtcctttctttgacaaaaatgttaaaggatcaaaagctgcagctgaaagcgcaaaggaaaaatgctgctcagctagaatgtgtagatttggatgacattttggatacggcagcggaagtgaaatccgtcaccgacaatataaaagaaactttactggccggattagaatcagactaaatcgactcggaccgatg

SEQ ID NO: 3737 - DNA, 203 bp, Homo sapiens
  source 1..203: mol_type = other DNA
ggcgcgccagtcctaagtggcaatccaacaaattttgtccaaaccattccaaaaataattgatcattttgaagctgagtttccatttgacagatccccacaatggcattgagcagagtagatgtgattaatatgagaatttgggtcttaagtataatctgtgcttgtttaacgtatgtcaacgtcacacgactcggaccgatg

SEQ ID NO: 3738 - DNA, 203 bp, Homo sapiens
  source 1..203: mol_type = other DNA
ggcgcgccagtcctaaatagaaactttacttgacatgtggcacgtatcaagaaccaatctgaaaacctacaaagagttacgtaaggctctgacagaagcttcaaaaaaaagacaaagaaaaaaaatttataaattactaggtcacaatataagttcttatatcagtgaaactggttgtctcttccagccgactcggaccgatg

SEQ ID NO: 3739 - DNA, 203 bp, Homo sapiens
  source 1..203: mol_type = other DNA
ggcgcgccagtcctcccgttaattcaagaaatggaaaaatataatgaagtgcttccattccgaagcgagttttcgaatttgctcattagaacttactgacgcatgctttatagatcgctcaacttatgtgtcacgtgttcaggcaacattaataaaaagcccatgaacactgcttctcccattcaatacgactcggaccgatg

SEQ ID NO: 3740 - DNA, 203 bp, Homo sapiens
  source 1..203: mol_type = other DNA
ggcgcgccagtcctcatgctttatagatcgctcaacttatgtgtcacgtgttcaggcaacattaataaaaagcccatgaacactgcttctcccattcaataatggcattactacagtggatgctggaaaacatttcagatgacaactcaataaaaatgtctcttgaagaacaacatgaaacgtttcaacgactcggaccgatg

SEQ ID NO: 3741 - DNA, 203 bp, Homo sapiens
  source 1..203: mol_type = other DNA
ggcgcgccagtcctctgcttttcgttataatagcttcaacccttctgtgtaaactaggaactcatcaacattgaaaattttgaaagcttcagtacttgaatatgaggggcaaaaaacgtaaaactgtttgtaaggccaaaggtaaactcacttctaaaagctgcatgtgtactaaagccaatgctcgacgactcggaccgatg

SEQ ID NO: 3742 - DNA, 203 bp, Homo sapiens
  source 1..203: mol_type = other DNA
ggcgcgccagtccttgacgacggaaacatgtgagtttttactgtatgggacaatacttttcgtcttagaaacaaactcatttcttaatttctcgttcgcagcatatatcaggccggaggtattacatactgcactcctatatatacgagtacaacaatcatacatgaaattaaacctacgcctaacaacgactcggaccgatg

SEQ ID NO: 3743 - DNA, 203 bp, Homo sapiens
  source 1..203: mol_type = other DNA
ggcgcgccagtccttgacctactgggagcgccgccaaatctgttttgccccgcccctgcgcgcgcgggaactgtcggcgccgcgctgctgctagcccgccttccagagctccctccctccgtctgcctcctcacccttgccactcacccttccatctcttctatcacagactctgtgttacaccacctcgactcggaccgatg

SEQ ID NO: 3744 - DNA, 203 bp, Homo sapiens
  source 1..203: mol_type = other DNA
ggcgcgccagtccttccagagctccctccctccgtctgcctcctcacccttgccactcacccttccatctcttctatcacagactctgtgttacaccacctatgactgctgcaaccacagaacattttgctctccgcgcggcactcaatcgttactggtggctgcttctgggacgacacaagctcagtcgactcggaccgatg

SEQ ID NO: 3745 - DNA, 203 bp, Homo sapiens
  source 1..203: mol_type = other DNA
ggcgcgccagtcctctgtagagacacttcctttaagtagaccttagagacacaccaaatacaaccacaaccaaaaaaaaaacagaaaacaacacaaagccaatgagtgcagaaatgctccgcgctgttcagctccagccaagacgccggggacattcctcatctcccacttcccctccactcgaaggacgactcggaccgatg

SEQ ID NO: 3746 - DNA, 203 bp, Homo sapiens
  source 1..203: mol_type = other DNA
ggcgcgccagtcctcatttttagcaaagctgtagcaaatcataacattagattatcataccaggattttttggaaatcaattagagtgtccatgtcggcagcgcatgtatctaatcaaagagaaaatagagactattaaactaattttttaagaagtgttcaataatgctcaacagaaaaaacgagtccgactcggaccgatg

SEQ ID NO: 3747 - DNA, 203 bp, Homo sapiens
  source 1..203: mol_type = other DNA
ggcgcgccagtcctcttaagcataaagcgacgtcatgcttcagtaatatataaaaacctagtcacaactgctgttttcataagcttagagtgtgcttcaacatggccgaaagtgaacaaaaagttcgatttaggcatgcactcgcaaatttaagccttgttaaacaagccttttatcgcgattctcttcgactcggaccgatg

SEQ ID NO: 3748 - DNA, 203 bp, Homo sapiens
  source 1..203: mol_type = other DNA
ggcgcgccagtcctcaacacaattttcacatctagagtatcttttcaaaggaaaaatttcttcggggtatgtatggcaatgcattggaaaaatgctgcaatgttcatcaatagttaattgtgttttttttgttttatagaagtaccgtggactttcttgaagaaattgtgaagtctttataaaggacccgactcggaccgatg

SEQ ID NO: 3749 - DNA, 203 bp, Homo sapiens
  source 1..203: mol_type = other DNA
ggcgcgccagtccttcggttatcttatgtctgattcttattctacacatcttcaatgttcgatatgggggtacgaagccctgaattttacaccgattccagcacttttttgcgttgcttaaaaacagtaatttagtcggcacacgtacaatattaaactaggcttcttctaattgcgcagtgtttaaacgactcggaccgatg

SEQ ID NO: 3750 - DNA, 203 bp, Homo sapiens
  source 1..203: mol_type = other DNA
ggcgcgccagtcctatgttttataagtacaaccattttttcccagagacctatgaagattgttggaaagggatttattatttgtttgttctgtttattttggcttgcattgcatatcatgattatataagtccttcaatagcagagaatatgttatcatttatcaggtgctctaaatatccctagaagcgactcggaccgatg

SEQ ID NO: 3751 - DNA, 203 bp, Homo sapiens
  source 1..203: mol_type = other DNA
ggcgcgccagtcctttgatttgctgagtggtttttctgatggtgtggtgatgagtactatgcatgtatttcagtgatgtaataaaaatttggcgccaaaaaaacacagtatataatggtttgaatatctctgtgattttttagtattctcatacaactcttcctgttaatatctatttttggtgcagccgactcggaccgatg

SEQ ID NO: 3752 - DNA, 203 bp, Homo sapiens
  source 1..203: mol_type = other DNA
ggcgcgccagtcctcagtattcccagttactgttcctatttttgcacggagaaataatattctttgtggttttttggttgccgccttactaattgtatgctatgtcatctttaaggaatttgctttgtcggctgatttctccgctgtgtaaacatggttcgtacagtcatttgcagttatttcttattcgactcggaccgatg

SEQ ID NO: 3753 - DNA, 203 bp, Homo sapiens
  source 1..203: mol_type = other DNA
ggcgcgccagtcctcttgaatctaagtgtgcatataaaagaatttcattaaaaagttctgagttcatagaaaaggaatcggagttccatcccttataagccatgtctaacgacaatgccaaaacagatatagaaattctttatgaacaattatcttcccgagttgaaattgaaatagcttttctccctcgactcggaccgatg

SEQ ID NO: 3754 - DNA, 203 bp, Homo sapiens
  source 1..203: mol_type = other DNA
ggcgcgccagtcctttgaaaaacatgtttggttagccattcatttttttaaagcatttcaggtttcaaaattaaaccacaaaaataaaacgcttatatctgatttcttaaaggatttcacacagctcttagcagatcaaaactttgaaattgtcgatcctacatttaccattcattattacgtttagccgactcggaccgatg

SEQ ID NO: 3755 - DNA, 203 bp, Homo sapiens
  source 1..203: mol_type = other DNA
ggcgcgccagtccttaaaaaccacagaggcgtcaccgctacacgagacaaaaataatataaaaggccgtttatgaacaaggttctcattttcgacagaaacatgtatccacgcggggttaaaaagaatgtattagggcggcaacgatatggtttgaaaaccattaaacgaactcttgttcataaacctcgactcggaccgatg

SEQ ID NO: 3756 - DNA, 203 bp, Homo sapiens
  source 1..203: mol_type = other DNA
ggcgcgccagtcctttgatggtttatatttaacgattattggaaaaattaaatgttcactagggttcttacataagatatttactatcacgtgcgcggggtcatattccgttgcaaacacagtaatagtcattgtgaatgtctttcagtttatcttccaacagcttttaatataagacaataggaatccgactcggaccgatg

SEQ ID NO: 3757 - DNA, 203 bp, Homo sapiens
  source 1..203: mol_type = other DNA
ggcgcgccagtcctactgtgcctataacggcattttcattgtggtttatattcaatggaatattcaaaccatttccggaattgatttcttcttgtatcgtcctccttggcagataaaagttatcatttatatcattatcatcatacacacataggaagcctgccactagcacagtttccattattacgcgactcggaccgatg

SEQ ID NO: 3758 - DNA, 203 bp, Homo sapiens
  source 1..203: mol_type = other DNA
ggcgcgccagtccttcacaagatgattgcgcagtccatgcaccagatttgataagtacgatttgctcgacaacgcacacaacgcatcacgacctagtcagaatgaatggctcagctactggcaactcagctagtcttcccgctcctcagttttccgaatgtgtttttttaccgaaagatacattttgccgactcggaccgatg

SEQ ID NO: 3759 - DNA, 203 bp, Homo sapiens
  source 1..203: mol_type = other DNA
ggcgcgccagtcctagactctctcccaattttgacagttcatcccatgacagactttccctacgaacaaatacaagagacagaaaacattagacataactctatgaacataacaccccgcttcaaacgtatgcaattgtaatatcaactatttaagtattttacaacaataaaagatttaaagtaagacgactcggaccgatg

SEQ ID NO: 3760 - DNA, 203 bp, Homo sapiens
  source 1..203: mol_type = other DNA
ggcgcgccagtcctaaattaaaacggttttcaccatgattaaccaaatcaattcccttacacaagaaaaaacgtttttcattgtggctgatgtttctgctgacaataggctggcaacttgtatatttaaagagtgaataaaaagttctttgaaatagtgtctgttgtaacagattttatttcagctcccgactcggaccgatg

SEQ ID NO: 3761 - DNA, 203 bp, Homo sapiens
  source 1..203: mol_type = other DNA
ggcgcgccagtcctaactggatcatttgggtcgaaacgcaaacgctttaaccgttttacgttttattgtagaaaatggttattataaaaggaagacaatttttcgcaaacttttgaagtatttagctactacatcttttaatgctcatgttcaaactgaaagtaatcgtttactcaacttgatgcacacgactcggaccgatg

SEQ ID NO: 3762 - DNA, 203 bp, Homo sapiens
  source 1..203: mol_type = other DNA
ggcgcgccagtcctaaactctgagggaaataaaggaagaagccttaagacattttgatccccgcttgctaattgctcttggctactatatccataatagacatggagacacccttgaaggcgccagagagctcattaaaaccctacaacgagccctcttcgtgcacttcagagcgggatgtaaccgctcgactcggaccgatg

SEQ ID NO: 3763 - DNA, 203 bp, Homo sapiens
  source 1..203: mol_type = other DNA
ggcgcgccagtcctcttggccaataaactatgtgcagttcctgatccacctactgactcgcctcttgatcgggctatacaacatctgcagagacttactatccaagaactccccgacccgccgactgatctcccagagtctaacagcaatcagggactggctgagacttaaggcggcccaactgcaatcgactcggaccgatg

SEQ ID NO: 3764 - DNA, 203 bp, Homo sapiens
  source 1..203: mol_type = other DNA
ggcgcgccagtcctcagccaggagccttttcttcataaagagattcgagaaacgaagcgtcaaccccggggagaaacgacaggaggaagcgcgcctggaacatgaagctggttcttctgttcagcctcagcgttctacttgggtgagttcgttctaatctatttatcggaaagaatacaaggctacaacgactcggaccgatg

SEQ ID NO: 3765 - DNA, 203 bp, Homo sapiens
  source 1..203: mol_type = other DNA
ggcgcgccagtcctgtgcaaaatataaagttctcagagcaggaccaccaatgggcgtaggacgatcggctgaagggccctgccaaaaactacaggtagaccatgtgggacctttgggacctggtacccatggatacaggtacctcacaaccatggttgatgtgtacacaggttggttctgggccaaaccgactcggaccgatg

SEQ ID NO: 3766 - DNA, 203 bp, Homo sapiens
  source 1..203: mol_type = other DNA
ggcgcgccagtcctatggggtaaatagacattagttagagttcaatcaatctcaacaaccatttataccgccaattcaatacatatactataaatcttaaaatgggaaatacatccatcacaatagaattcacaagcaaattttggccctattttacactaatacatatgatcttaactctaatctctcgactcggaccgatg

SEQ ID NO: 3767 - DNA, 203 bp, Homo sapiens
  source 1..203: mol_type = other DNA
ggcgcgccagtcctttaactcatagttacataaaaacctcaagtatcacaatcaaacactaaatcaacacatcattcacaaaattaacagctggggcaaatatgtcgcgaagaaatccttgtaaatttgagattagaggtcattgcttgaatggtagaagatgtcactacagtcataattactttgaacgactcggaccgatg

SEQ ID NO: 3768 - DNA, 203 bp, Homo sapiens
  source 1..203: mol_type = other DNA
ggcgcgccagtccttaatacaagtatatgataagtaatcagcaatcagacaatggacaaaaggaaaatataaaaaacttaggagcaaagcgtgctcggaaaatggacactgaatctaacaatggcactgtatctgacatactctatcctgagtgtcaccttaactctcctatcgttaaaggtaaaatacgactcggaccgatg

SEQ ID NO: 3769 - DNA, 203 bp, Homo sapiens
  source 1..203: mol_type = other DNA
ggcgcgccagtcctcccttgttggagcggtcgcgttttctctgttcccgtcgtgccggttcctaccccccgctccctgggaccgccccctaccccccacctccccgtttgggcctcccccctcgcaccacccctttcctcgtccgtctgcggggagggcgtgtgtaaaaaatcgggcctccggccacccgactcggaccgatg

SEQ ID NO: 3770 - DNA, 203 bp, Homo sapiens
  source 1..203: mol_type = other DNA
ggcgcgccagtcctccccgtttgggcctcccccctcgcaccacccctttcctcgtccgtctgcggggagggcgtgtgtaaaaaatcgggcctccggccaccatgtccgtgcgcgggcatgccgtacgccggacgcgcgcctccacccggtcccatgccccgtccgcgcatcgcgccgactcgcccgtgcgactcggaccgatg

SEQ ID NO: 3771 - DNA, 203 bp, Homo sapiens
  source 1..203: mol_type = other DNA
ggcgcgccagtcctggacgcgagatgtcagtcctcggggacgcacggcacccccggcgattcccttcgcgagggccccggcctttttctgtcgcgggtcccggatccctccccccctctccgccgccgggcgctcgggcacgtctcattcgcctctcgagatcgttattcccggacccaaccgccccccgactcggaccgatg

SEQ ID NO: 3772 - DNA, 203 bp, Homo sapiens
  source 1..203: mol_type = other DNA
ggcgcgccagtcctaacccgcagggagccactcccgcggcccccgtgggttacgcaggccctcgctgctctcccgtaccccgccggtctccctctttccctccctcgccgccttccgacgctctctgcctccttcgccgacgccttccctgtgatccgcacgggcgtccccggtgtctccgatagacccgactcggaccgatg

SEQ ID NO: 3773 - DNA, 203 bp, Homo sapiens
  source 1..203: mol_type = other DNA
ggcgcgccagtcctggctccccgggcacgcccgcgacgagcgcgacgaacaacagcaccacccagcggcccagtcttgcgggtttccccgtcatcgcggcgatgagtcagtgggggcccagggcgatccttgtccagacggacagcaccaaccggaatgccgatggggactggcaagcggccgtagctcgactcggaccgatg

SEQ ID NO: 3774 - DNA, 203 bp, Homo sapiens
  source 1..203: mol_type = other DNA
ggcgcgccagtccttcgcagtcttccgtccccatcgcccctgcgaacccggagggggtggggtgggggaaagccggcgcagagccgcgcgcgtgttccgggatggcgtccctgctcggggtgctgtgcggttggggaacgcgccccgaggaacaacaatatgagatgattcgggccgcggctccgccccgactcggaccgatg

SEQ ID NO: 3775 - DNA, 203 bp, Homo sapiens
  source 1..203: mol_type = other DNA
ggcgcgccagtcctaccccgagcagggacgccatcccggaacacgcgcgcggctctgcgccggctttcccccaccccaccccctccgggttcgcaggggcgatggggacggaagactgcgatcacgaagggcggtcggttgcggctcccgtggaggttacggcgctgtatgcgaccgacgggtgcgttcgactcggaccgatg

SEQ ID NO: 3776 - DNA, 203 bp, Homo sapiens
  source 1..203: mol_type = other DNA
ggcgcgccagtcctctcaagttttctcacccgtcgcccctctccaaggtcccgtttgggacgtgccagcatttcctcgccgcgaatcgctacctcgaaacccgggacattatgccgatcgactggtcggtataagatgccgacatccggggtcttgatttacgagggggcaattaataaagactgttgcgactcggaccgatg

SEQ ID NO: 3777 - DNA, 203 bp, Homo sapiens
  source 1..203: mol_type = other DNA
ggcgcgccagtcctataaatgtggggccccggcccggcccgcttcatagcgcgtccaggaactcacggcagacgcgtattcaccgacccccccctcgcaacatgacaacgacgcccctctcgaacctgtttttacgggccccggacatcacccacgtcgcccccccgtactgtctgaatgccacgtggcgactcggaccgatg

SEQ ID NO: 3778 - DNA, 203 bp, Homo sapiens
  source 1..203: mol_type = other DNA
ggcgcgccagtccttaattagcaacccctggggctataaaaggcgcggtctgtgcacggggacctcggttgggcgacgtctgcggtctagtggtcggcgtggggaccggctgtgtggtgggtgggggaggcacgttggactacgaccgaccacacgacatgcaggcttctgagccgcgaatccccacccgactcggaccgatg

SEQ ID NO: 3779 - DNA, 203 bp, Homo sapiens
  source 1..203: mol_type = other DNA
ggcgcgccagtcctctgcacatgaatctaaacccgctccgggagcgccacgaacgcgatgacgtcattagcgagcacatactatctgctctacgcgatccgaatgtggtcattgtctattaaccctccattccctcgcgttcccaccgcacccgggccgggtgacattcacccccacccccccgagaccgactcggaccgatg

SEQ ID NO: 3780 - DNA, 203 bp, Homo sapiens
  source 1..203: mol_type = other DNA
ggcgcgccagtccttgccgccgccccttaagagggcccgcaacacggcccgggctgcgcacgccagccgggacgggtgagttcgctaggcaagcacggactggcggttacacgtgcatgcgtgccgagtgaactctcccgccccgacgcgctccggctccgggcctacgccgagcccagccgcccgcccgactcggaccgatg

SEQ ID NO: 3781 - DNA, 203 bp, Homo sapiens
  source 1..203: mol_type = other DNA
ggcgcgccagtccttcccaacatccgcgctttctcgcaggccgggcgccgccttcgtggacgggacaccggtgtggtaactggcgacaaggcgttgccactatggcagacatccccccggacccgcccgcgctcaacacgacgcctgcgaatcatgctcccccatccccacccccgggttcacggaagcgactcggaccgatg

SEQ ID NO: 3782 - DNA, 203 bp, Homo sapiens
  source 1..203: mol_type = other DNA
ggcgcgccagtcctggggggtgtgtcgacaaactgccgcttcttaaaacaccggggcccgtcgctcggggtgctcgttggttggcacgcgcgacgcggcaaatggcctgtcgtaagttctgtggggtctaccgtagacccgacaagagacaggaggcgtccgtcccgccggagacaaacacggccccgcgactcggaccgatg

SEQ ID NO: 3783 - DNA, 203 bp, Homo sapiens
  source 1..203: mol_type = other DNA
ggcgcgccagtccttaaaacccggggtcggtgtggtgttcggtcataagctgcattgcgaacgactagtcgccgtttttcgtgtgcatcgcgtatcacggcatggggcgtttgacctccggcgtcgggacggcggccctgctagttgtcgcggtgggactccgcgtcgtctgcgccaaatacgccttacgactcggaccgatg

SEQ ID NO: 3784 - DNA, 203 bp, Homo sapiens
  source 1..203: mol_type = other DNA
ggcgcgccagtcctctggccccttgatacgatctcgtcgaccggggactcccctctacccccacccaaccagcgcgccggcgcttagggtgtgacccccccatggcatccggggtttccccggcccacccccaaaccccggttggggcgggcagccgagacctttccttaaaaggcaccccatccgaccgactcggaccgatg

SEQ ID NO: 3785 - DNA, 203 bp, Homo sapiens
  source 1..203: mol_type = other DNA
ggcgcgccagtcctagctgctgctgcgagagctctcggatgcgtgcgatgattggttggaccccgtgcatggacgtaaaatttaaaaacgcctcgtccctgaaccgcacggcgggtctggccccgggctgctgtgggggcggacctggtgcccggacgtcccgcgagccctccccgccggacgccgcccgactcggaccgatg

SEQ ID NO: 3786 - DNA, 203 bp, Homo sapiens
  source 1..203: mol_type = other DNA
ggcgcgccagtcctgcttgcgcacgcacgcctccggcgcccagcccaacactgacatcattctcgaggcggctctgtcggagcttcccaccgaggcctggcccatgatgcagggggcggtgaactttagcaccctataagtctggggccgcgctcgttcgatacacggcaacccccgggcgtcgtggccgactcggaccgatg

SEQ ID NO: 3787 - DNA, 203 bp, Homo sapiens
  source 1..203: mol_type = other DNA
ggcgcgccagtcctccatgatgcagggggcggtgaactttagcaccctataagtctggggccgcgctcgttcgatacacggcaacccccgggcgtcgtggcatggaagcccccggcatcgtttgggtggaggagagcgtcagcgccattaccctatacgcggtatggctgcccccgcgcacgcgcgaccgactcggaccgatg

SEQ ID NO: 3788 - DNA, 203 bp, Homo sapiens
  source 1..203: mol_type = other DNA
ggcgcgccagtccttacgtggccagcaggctctgcgtgtccaaccggagggggacggctacacccccgcgcacctcgaccgtggcgttcgccttcgcataagaggtcgcgggggcgtaaaggcagggaaacctgtcccggaacacagaggccagcaccaggagccccacgacgcagatggccgagacgcgactcggaccgatg

SEQ ID NO: 3789 - DNA, 203 bp, Homo sapiens
  source 1..203: mol_type = other DNA
ggcgcgccagtcctgaggtcgcgggggcgtaaaggcagggaaacctgtcccggaacacagaggccagcaccaggagccccacgacgcagatggccgagacgatgaacgtcgccacctgcacacaccagacccaccacgccgcccgcgccccgggcgcgacgtcggcgcccggcgcggcctcgggggatcgactcggaccgatg

SEQ ID NO: 3790 - DNA, 203 bp, Homo sapiens
  source 1..203: mol_type = other DNA
ggcgcgccagtcctataggcgccgggtataaggcagccccgtgtgacggtcgggccgcattcgcaccccggcactgcgagcgacggagcggcggcccggcgggaggaggagacccggagagacagagactaaaacccggcaagagagagaccgcgggccgccgtctcgagtctaccctaccccggctccgactcggaccgatg

SEQ ID NO: 3791 - DNA, 203 bp, Homo sapiens
  source 1..203: mol_type = other DNA
ggcgcgccagtcctagtgtataaattaccagcgcacgcacaaggccgtcctgtcgtcggtgtcgctgccgcccgagctgaggccgctgctggtgctggtctcccgcctctgtcacgccaacccggccgcgcgccactctctgtcgtgaggatcccttccgccctcgagctcttcggctgctcgtaaaacgactcggaccgatg

SEQ ID NO: 3792 - DNA, 203 bp, Homo sapiens
  source 1..203: mol_type = other DNA
ggcgcgccagtcctgcgcccgcgggccccgaggacgcgcacacgcaccccccacccacgccccttccggcaccgggaagggctcgcaccgccggccgggccatgaacgcgcactttgccaacgaggtccaatacgatctcacccgggacccgagcagccccgcctcgctgattcacgtcatcatctcccgactcggaccgatg

SEQ ID NO: 3793 - DNA, 203 bp, Homo sapiens
  source 1..203: mol_type = other DNA
ggcgcgccagtcctctcacctggggctcctgcgcacgacagacctccccgtgcgtgctgctgagccctgccccgccccctctcccacacggtcggtgccccccatctctgtttcatcatcgtcccggttgcgttgcgctttccggccctcccgcacccccgcgttccggtgtctcgcggcccggcgcccgactcggaccgatg

SEQ ID NO: 3794 - DNA, 203 bp, Homo sapiens
  source 1..203: mol_type = other DNA
ggcgcgccagtcctaacgccccctttacgcctttcctcccctcgcctgttgttggtcgggttgccccttggggttttggcggcccgtgggttgttagtcgcgtccgccggcggtgaggcgttgtgcgggaggggcttggccttcccgagctcggcttgatggagcctgcgaatcccccaaggaacccacgactcggaccgatg

SEQ ID NO: 3795 - DNA, 203 bp, Homo sapiens
  source 1..203: mol_type = other DNA
ggcgcgccagtcctgtccgccggcggtgaggcgttgtgcgggaggggcttggccttcccgagctcggcttgatggagcctgcgaatcccccaaggaacccaatggccgctcctgcccgcgaccccccgggttaccggtacgccgcggccatcctgcccaccggctccatcctgagtacgatcgaggtgcgactcggaccgatg

SEQ ID NO: 3796 - DNA, 203 bp, Homo sapiens
  source 1..203: mol_type = other DNA
ggcgcgccagtcctgccaggcactcgcatccgcggatactacccgggtgggggttgtgtgtagaacccgcgcggtgcttgtttgattttggcctccgccccccatccctgaagcttgggtccggacccgggcccgcgccgccagcactactttcggttttgctgcctcgccggctccccgcaccgacccgactcggaccgatg

SEQ ID NO: 3797 - DNA, 203 bp, Homo sapiens
  source 1..203: mol_type = other DNA
ggcgcgccagtcctccatccctgaagcttgggtccggacccgggcccgcgccgccagcactactttcggttttgctgcctcgccggctccccgcaccgaccatgacaatgcgggatgatgttcctttgttggatcgcgagctggtagacgaggccgcgtgtggcggggaggacggagaactgccgctccgactcggaccgatg

SEQ ID NO: 3798 - DNA, 203 bp, Homo sapiens
  source 1..203: mol_type = other DNA
ggcgcgccagtcctcgcgccaccgccagcccttgctcccaccaccctcctcccaccaccccactattcccccccccaagtccgccccgtggctcgccggccatggagctcagctatgccaccaccctgcaccaccgggacgttgtgttttacgtcacggcagacagaaaccgcgcctactttgtgtgccgactcggaccgatg

SEQ ID NO: 3799 - DNA, 203 bp, Homo sapiens
  source 1..203: mol_type = other DNA
ggcgcgccagtccttccttgttttcggtctggtactccctttgtgcttttaccctcaccccaccccatcctttggcccgcgcttacggcaacaaagggcctccgatagcctccgaggtgcggagcctctttgggccgtgggtacggacacccccccccatctgcggactggcagccgggacgacgacccgactcggaccgatg

SEQ ID NO: 3800 - DNA, 203 bp, Homo sapiens
  source 1..203: mol_type = other DNA
ggcgcgccagtcctcttccccaccccgtggggtccgtctatataaacccgcagcagcgtgggcagctccggatccccgcgggctccggaggccccctggcgatggctaggacgggacgccgcgcggccgtcggtaggcccgctcgcacgagcagcctgaccgaacgcaggcgcgtgctgttggccggccgactcggaccgatg

SEQ ID NO: 3801 - DNA, 203 bp, Homo sapiens
  source 1..203: mol_type = other DNA
ggcgcgccagtcctgcgcggggactcatttgtcgccggcgacacccacccgacaacagcccctgggtgtcgaccgctgtcgcccccgtctgtcgcctctcccttttttccccccctcaaagaacgtggtgttgggcgccggccaattcttcccggagcgccgtcgtcgcccgcccgccgccctcgaaccgactcggaccgatg

SEQ ID NO: 3802 - DNA, 203 bp, Homo sapiens
  source 1..203: mol_type = other DNA
ggcgcgccagtcctgccgccgcatcagtccgcgcggcgcgcgcctctgacccacccccccccaaaccttaactaaaccacagcacggccgggtgactcgccatggcggccgcgcccccggccgcggtttccgagcccactgcggcccgacagaaactgttggccctgctcgggcaggtacagacgtaccgactcggaccgatg

SEQ ID NO: 3803 - DNA, 203 bp, Homo sapiens
  source 1..203: mol_type = other DNA
ggcgcgccagtcctacgagttcgaggggcgggtctgtatagccctgcgggccctcatctacaccttcaagacgtaccaggtatttgtgccgaagcccaccgcgctggccacatttgtccgcgaggccggcgcgctgctcagacgacactcgatctctctcctgtccctggagcacaccctctgtacctcgactcggaccgatg

SEQ ID NO: 3804 - DNA, 203 bp, Homo sapiens
  source 1..203: mol_type = other DNA
ggcgcgccagtcctcgcgcttcggcggggcaccggcaccgggaccgacttgttttacataacagtagggggtgggggaacgcgcacccttgcccggtcgcgatggcggggatggggaagccctacggcggccgcccgggggacgcgttcgagggtctcgttcagcgcatcaggctcattgttcccgcccgactcggaccgatg

SEQ ID NO: 3805 - DNA, 203 bp, Homo sapiens
  source 1..203: mol_type = other DNA
ggcgcgccagtcctcttcatggggtgggatgtgtcttcccgggaaaccacacacacgcgataccgggtgtgtggttagggggacgaacaggcggttgatgggcgggggggttcgggcggcggaaacaacagtactcatcgggacgcccggcccataaacaggccccgctcgtggcgggcgcggcacaccgactcggaccgatg

SEQ ID NO: 3806 - DNA, 203 bp, Homo sapiens
  source 1..203: mol_type = other DNA
ggcgcgccagtcctaccgattcctgttgcgttcctgtcggccggtgctgtcctgtcgacagattgttggcgactgcccgggtgattcgtcggccggtgcgtcctttcggtcgtaccgcccaccccgcctcccacgggcccgccgctgtttccgttcatcgcgtccgagccaccgtcaccttggttccacgactcggaccgatg

SEQ ID NO: 3807 - DNA, 203 bp, Homo sapiens
  source 1..203: mol_type = other DNA
ggcgcgccagtcctcctttcggtcgtaccgcccaccccgcctcccacgggcccgccgctgtttccgttcatcgcgtccgagccaccgtcaccttggttccaatggccaaccgccctgccgcatccgccctcgccggagcgcggtctccgtccgaacgacaggaaccccgggagcccgaggtcgccccccgactcggaccgatg

SEQ ID NO: 3808 - DNA, 203 bp, Homo sapiens
  source 1..203: mol_type = other DNA
ggcgcgccagtcctacgacaacatcgtctgcacaagctgcgcgctgtaagcaacagcgctccgatcggggtcaggcgtcgctctcggtcccgcatatcgccatggatcccgccgtctcccccgcgagcaccgaccccctagatacccacgcgtcgggggccggggcggccccgattccggtgtgcccccgactcggaccgatg

SEQ ID NO: 3809 - DNA, 203 bp, Homo sapiens
  source 1..203: mol_type = other DNA
ggcgcgccagtcctcacaggggcggcgggcttgggtgtccgggaccgtcacacctatacagctctgtagagagacctatccgcacctacaatcgtgccggaatgggtctgtttggcatgatgaagtttgcccagactcaccatctggtgaagcgccggggcctccgggccccggagggctactttacccgactcggaccgatg

SEQ ID NO: 3810 - DNA, 203 bp, Homo sapiens
  source 1..203: mol_type = other DNA
ggcgcgccagtcctccgtagtccttggctcgggtagccactgctctgtggctcgggtcccccggcccccctaacccccatcgggtccgcgtcatccgccccctccgcctgcgacacaaacggccgcgcctccgggcccggtgacacgacgcgcctcgtctctgcggattgtcccgggagcgtcgcggccgactcggaccgatg

SEQ ID NO: 3811 - DNA, 203 bp, Homo sapiens
  source 1..203: mol_type = other DNA
ggcgcgccagtcctcgcgtgattcggttgctcgcggttgtcttgtttggacgttttttatgcgggaacaagggggcttaccggttacactgtccgctcgctatggggttcgtctgtctgtttgggcttgtcgttatgggagcctggggggcgtggggtgggtcacaggcaaccgaatatgttcttcgtcgactcggaccgatg

SEQ ID NO: 3812 - DNA, 203 bp, Homo sapiens
  source 1..203: mol_type = other DNA
ggcgcgccagtcctaaggccaggggggcaggcgggcccatcactgttagggtgttaggttgggaggtggcacaaaaagcgacactcccgtgttgtagttgtccgcgggaggcggtggtttccggcaaccctcctcgctgcgccgcgcgcgcccaccggtccttcgcgggggccggggctcttctggtccgactcggaccgatg

SEQ ID NO: 3813 - DNA, 203 bp, Homo sapiens
  source 1..203: mol_type = other DNA
ggcgcgccagtcctcccgatccgaacggcgcacgccgcgtgggctccaaacgcctccggaagagagcgccccgccccgatattcaagcccgcggtggtgctatggctttccgtgcttcgggacccgcctaccagcccctcgcccccgcggcctccccggcgcgggctcgtgttccggccgtggcctggcgactcggaccgatg

SEQ ID NO: 3814 - DNA, 203 bp, Homo sapiens
  source 1..203: mol_type = other DNA
ggcgcgccagtcctactcacgcactcgccgctgcgtcgggcgacgcgatttacggcctgccaacaccacgtcaacgtgggaaccgcctgtgtcgtcggacgatgaagcgagctcgcagtcgaagcccctcgccacccagccgcccgtcctcgccctttcgaacgcccccccacggcgggtctccccgacgactcggaccgatg

SEQ ID NO: 3815 - DNA, 203 bp, Homo sapiens
  source 1..203: mol_type = other DNA
ggcgcgccagtcctttgctgaagcgcgcacggcaagaggcgaggggcggcgactggtgagtacgccaaaaattttgactagcggaggctagaaggagagagatgggtgcgagagcgtcagtattaagcgggggagaattagatcgatgggaaaaaattcggttaaggccagggggaaagaaaaaatatcgactcggaccgatg

SEQ ID NO: 3816 - DNA, 203 bp, Homo sapiens
  source 1..203: mol_type = other DNA
ggcgcgccagtccttctggaaaggtgaaggggcagtagtaatacaagataatagtgacataaaagtagtgccaagaagaaaagcaaagatcattagggattatggaaaacagatggcaggtgatgattgtgtggcaagtagacaggatgaggattagaacatggaaaagtttagtaaaacaccatatgcgactcggaccgatg

SEQ ID NO: 3817 - DNA, 203 bp, Homo sapiens
  source 1..203: mol_type = other DNA
ggcgcgccagtcctttcagactctgctataagaaaggccttattaggacacatagttagccctaggtgtgaatatcaagcaggacataacaaggtaggatctctacaatacttggcactagcagcattaataacaccaaaaaagataaagccacctttgcctagtgttacgaaactgacagaggatagcgactcggaccgatg

SEQ ID NO: 3818 - DNA, 203 bp, Homo sapiens
  source 1..203: mol_type = other DNA
ggcgcgccagtccttctacaatacttggcactagcagcattaataacaccaaaaaagataaagccacctttgcctagtgttacgaaactgacagaggatagatggaacaagccccagaagaccaagggccacagagggagccacacaatgaatggacactagagcttttagaggagcttaagaatgaacgactcggaccgatg

SEQ ID NO: 3819 - DNA, 203 bp, Homo sapiens
  source 1..203: mol_type = other DNA
ggcgcgccagtcctcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcataacaaaagccttaggcatctcctcgactcggaccgatg

SEQ ID NO: 3820 - DNA, 203 bp, Homo sapiens
  source 1..203: mol_type = other DNA
ggcgcgccagtcctttatagaagtagtacaaggagcttgtagagctattcgccacatacctagaagaataagacagggcttggaaaggattttgctataagatgggtggcaagtggtcaaaaagtagtgtgattggatggcctactgtaagggaaagaatgagacgagctgagccagcagcagataggcgactcggaccgatg

SEQ ID NO: 3821 - DNA, 203 bp, Homo sapiens
  source 1..203: mol_type = other DNA
ggcgcgccagtcctatcaaacaaaacccatctggagcctcagatcatcccaagtcattgttcatcagatctagtactcaaataagttaataaaaatatccacatggggcaaataatcattggaggaaatccaactaatcacaatatctgtcaacatagacaagtcaacacgccaggcaaaatcaaccacgactcggaccgatg

SEQ ID NO: 3822 - DNA, 203 bp, Homo sapiens
  source 1..203: mol_type = other DNA
ggcgcgccagtcctaatgaaatccattggacctctcaagacttgattgatgcaattcaaaattttctacaacatctaggtattactgatgatatatacacaatatatatattagtgtcataacactcaatcctaatgcttaccacatcatcaaactattaactcaaacaattcaagccatgggacaaacgactcggaccgatg

SEQ ID NO: 3823 - DNA, 203 bp, Homo sapiens
  source 1..203: mol_type = other DNA
ggcgcgccagtcctcggcgggtagccttcgcgggagatactgcgtttttttgcgccggccccgtcgctcccgtccattcccatcgcgagggggtccggcggcacctaccccggcctccatccgcgctgtggggtctttttcttttttggggggtagcggacatccgataacccgcgtctatcgccacccgactcggaccgatg

SEQ ID NO: 3824 - DNA, 203 bp, Homo sapiens
  source 1..203: mol_type = other DNA
ggcgcgccagtcctctcgacctctccacacctgcaccacccccgccgtccgaacccaggcctaattgtccgcgcatccgaccctagcgtgttcgtggaaccatgacctctcgccgctccgtgaagtcgggtccgcgggaggttccgcgcgatgagtacgaggatctgtactacaccccgtcttcaggtcgactcggaccgatg

SEQ ID NO: 3825 - DNA, 203 bp, Homo sapiens
  source 1..203: mol_type = other DNA
ggcgcgccagtcctctaaccttcggcataaaagccaccgcgcgcctgttgaccaggttcagttgcacgactccgcccccgcgagtagcgacggccgtgtgccagtcgccatcgtacccccgacccaagctgtccggctggacaaggatcgccccggatccccactgactcatcttcctgttagggacgcgactcggaccgatg

SEQ ID NO: 3826 - DNA, 203 bp, Homo sapiens
  source 1..203: mol_type = other DNA
ggcgcgccagtccttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagcgactcggaccgatg

SEQ ID NO: 3827 - DNA, 203 bp, Homo sapiens
  source 1..203: mol_type = other DNA
ggcgcgccagtcctgggagtcccggccgcccgcctctccccgcggttcccgtcttcctgccccattgcgtccgcgcgcccaagggccagtacccgcccgcgatggcttctcttctcggggctatatgtggctggggagcgcgccccgaggaacaatatgagatgatccgcgcggccgttccgccctcgcgactcggaccgatg

SEQ ID NO: 3828 - DNA, 203 bp, Homo sapiens
  source 1..203: mol_type = other DNA
ggcgcgccagtcctttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgccgactcggaccgatg

SEQ ID NO: 3829 - DNA, 203 bp, Homo sapiens
  source 1..203: mol_type = other DNA
ggcgcgccagtcctcccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttacgactcggaccgatg

SEQ ID NO: 3830 - DNA, 203 bp, Homo sapiens
  source 1..203: mol_type = other DNA
ggcgcgccagtcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttccgactcggaccgatg

SEQ ID NO: 3831 - DNA, 203 bp, Homo sapiens
  source 1..203: mol_type = other DNA
ggcgcgccagtcctaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagccgggtccgactcggaccgatg

SEQ ID NO: 3832 - DNA, 203 bp, Homo sapiens
  source 1..203: mol_type = other DNA
ggcgcgccagtcctcgtggacgcggccctcggttgggcgacgcatgccagcccaacaaaatccgccggggtgccagtcccattcccgaaggcgtagcccgttaacttggctggcttggatggggagtagggccttttccattaccccaaggacctagcgcgcgggagtcgtggctttggggcgcatcccgactcggaccgatg

SEQ ID NO: 3833 - DNA, 203 bp, Homo sapiens
  source 1..203: mol_type = other DNA
ggcgcgccagtcctccccccccaaaacacaccccccgggggtcgcgcgcggccctttaaagcggtggcggcgggcagcccgggccccccgcggccgagactagcgagttagacaggcaagcactactcgcctctgcacgcacatgcttgcctgtcaaactctaccaccccggcacgctctctgtctcccgactcggaccgatg

SEQ ID NO: 3834 - DNA, 203 bp, Homo sapiens
  source 1..203: mol_type = other DNA
ggcgcgccagtcctcctgtcctttttcccacccaagcatcgacgggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgcgactcggaccgatg

SEQ ID NO: 3835 - DNA, 203 bp, Homo sapiens
  source 1..203: mol_type = other DNA
ggcgcgccagtcctcccccgcgtcggcctgtctccccgccgtgcgtggccttacaaatctgcaagtgccccaaatcggacacgggcctgtaatataccaacatgggcgttgttgtcgtcaacgtaatgaccctccttgaccagaacaacgccctgccccggacttccgtcgacgcaagcccggccctgcgactcggaccgatg

SEQ ID NO: 3836 - DNA, 203 bp, Homo sapiens
  source 1..203: mol_type = other DNA
ggcgcgccagtcctacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatccgactcggaccgatg

SEQ ID NO: 3837 - DNA, 203 bp, Homo sapiens
  source 1..203: mol_type = other DNA
ggcgcgccagtcctaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtccgactcggaccgatg

SEQ ID NO: 3838 - DNA, 203 bp, Homo sapiens
  source 1..203: mol_type = other DNA
ggcgcgccagtcctgtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgcgactcggaccgatg

SEQ ID NO: 3839 - DNA, 203 bp, Homo sapiens
  source 1..203: mol_type = other DNA
ggcgcgccagtcctgaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggcccgactcggaccgatg

SEQ ID NO: 3840 - DNA, 203 bp, Homo sapiens
  source 1..203: mol_type = other DNA
ggcgcgccagtcctttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcagcaaatatgccttgcgactcggaccgatg

SEQ ID NO: 3841 - DNA, 203 bp, Homo sapiens
  source 1..203: mol_type = other DNA
ggcgcgccagtcctccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggaccgactcggaccgatg

SEQ ID NO: 3842 - DNA, 203 bp, Homo sapiens
  source 1..203: mol_type = other DNA
ggcgcgccagtccttgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacggcgactcggaccgatg

SEQ ID NO: 3843 - DNA, 203 bp, Homo sapiens
  source 1..203: mol_type = other DNA
ggcgcgccagtccttcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgcgactcggaccgatg

SEQ ID NO: 3844 - DNA, 203 bp, Homo sapiens
  source 1..203: mol_type = other DNA
ggcgcgccagtcctgctctcccgggctgctgcccgaaatcgcccccaacgcatccttgggtgtggcacatcgaagaaccggcgggaccgtgaccgacagtccccgtaatccggtaacccgttgagtcccgggtacgaccatcacccgagtctctgggcggagggtggttcccccccgtggctctcgagcgactcggaccgatg

SEQ ID NO: 3845 - DNA, 203 bp, Homo sapiens
  source 1..203: mol_type = other DNA
ggcgcgccagtcctcccgtaatccggtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcacccccgactcggaccgatg

SEQ ID NO: 3846 - DNA, 203 bp, Homo sapiens
  source 1..203: mol_type = other DNA
ggcgcgccagtccttcgtgccttcccgcaggaggaacgtcctcgtcgaggcgaccggcggcgaccgttgcgtggaccgcttcctgctcgtcgggggggagcatgtcgtgggccctggaaatggcggacaccttcctggacaccatgcgggttgggcccaggacgtacgccgacgtacgcgatgagatccgactcggaccgatg

SEQ ID NO: 3847 - DNA, 203 bp, Homo sapiens
  source 1..203: mol_type = other DNA
ggcgcgccagtcctcgtcaccggtttccgcgacccaccgggcccggccaggcacggcagcatgggacccacagaccgcccgtgatccttaggggccgtgcgatggacaccgcagatatcgtgtgggtggaggagagcgtcagcgccattaccctttacgcggtatggctgcccccccgcgctcgcgagcgactcggaccgatg

SEQ ID NO: 3848 - DNA, 203 bp, Homo sapiens
  source 1..203: mol_type = other DNA
ggcgcgccagtcctataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgaccccccgactcggaccgatg

SEQ ID NO: 3849 - DNA, 203 bp, Homo sapiens
  source 1..203: mol_type = other DNA
ggcgcgccagtcctcctggaggacggcgccggggctctcggggccgcaggacccagcaaggcgtccattctcccgaaccaggccgttccgatcgccctgatcattacccccgtccgcatcgatccggagatctataaggccatccagcgaagcagccgcctggcattcgacgacacgctcgccgagctcgactcggaccgatg

SEQ ID NO: 3850 - DNA, 203 bp, Homo sapiens
  source 1..203: mol_type = other DNA
ggcgcgccagtcctcattacccccgtccgcatcgatccggagatctataaggccatccagcgaagcagccgcctggcattcgacgacacgctcgccgagctatgggcctctcgttctccggggcccggccctgctgctgccgaaacaacgtcctcatcaccgacgacggggaggtcgtctcgctgacccgactcggaccgatg

SEQ ID NO: 3851 - DNA, 203 bp, Homo sapiens
  source 1..203: mol_type = other DNA
ggcgcgccagtcctacacacacaaggcgatactgtcgtcggtggcgctgcctcccgagcttaagcctctcctggtgctggtgtcccgcctgtgtcacaccaacccgtgcgcgcggcacgcgctgtcgtgagaatcagcgttcacccggcggcgcgctcaaccaccgctccccccacgtcgtctcggaacgactcggaccgatg

SEQ ID NO: 3852 - DNA, 203 bp, Homo sapiens
  source 1..203: mol_type = other DNA
ggcgcgccagtcctacccgtgcgcgcggcacgcgctgtcgtgagaatcagcgttcacccggcggcgcgctcaaccaccgctccccccacgtcgtctcggaaatggagtccacggtaggcccagcatgtccgccgggacgcaccgtgactaagcgtccctgggccctggccgaggacacccctcgtggccgactcggaccgatg

SEQ ID NO: 3853 - DNA, 203 bp, Homo sapiens
  source 1..203: mol_type = other DNA
ggcgcgccagtcctgggtcgcggcggcgaagtaccccgatcacgggccttgggcacgcgagactatcagagcaccccccgggtcgcccgcagggtggcggaatggaccgagatgccgcccacgcggccctgcgccgacgcctggccgagacgcacctccgagccgagatttacaaggaccagaccctgcgactcggaccgatg

SEQ ID NO: 3854 - DNA, 203 bp, Homo sapiens
  source 1..203: mol_type = other DNA
ggcgcgccagtcctgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgagcgactcggaccgatg

SEQ ID NO: 3855 - DNA, 203 bp, Homo sapiens
  source 1..203: mol_type = other DNA
ggcgcgccagtcctcttagcctctcggaccccgtcgcgcgggccgctgtccttaggttttgtcgcaaggtgtcgtccgggaacggccggtctcgctagcgggcgccttcccccggccacctcgcccacccactcctccccgcgccgttggcccccgcctctggggtttgccctccccccgcccccggccgactcggaccgatg

SEQ ID NO: 3856 - DNA, 203 bp, Homo sapiens
  source 1..203: mol_type = other DNA
ggcgcgccagtcctgaatacgcatacgcgcgccaaacccacgcccttcccgcggactcgggggacccgcatcgcctacacacccacacccacccccgaaccatgaacgcgcacttggccaacgaggtccagacgatctcggccacggcccgggtcggccctcggtctttggttcacgtcatcatatcccgactcggaccgatg

SEQ ID NO: 3857 - DNA, 203 bp, Homo sapiens
  source 1..203: mol_type = other DNA
ggcgcgccagtcctccgaccggcacccggcctctcacacagcatcccccgcctttttgggtccgggcccgtcgtgtctttcggtggaccttgggccgtcgggcacgtacacgggtggccgggcgttggggtggatcttagcctccccgggccaatatcgctagagacagccgatctccacgcgacccccgactcggaccgatg

SEQ ID NO: 3858 - DNA, 203 bp, Homo sapiens
  source 1..203: mol_type = other DNA
ggcgcgccagtcctgcacgtacacgggtggccgggcgttggggtggatcttagcctccccgggccaatatcgctagagacagccgatctccacgcgaccccatggccgctcccaaccgcgaccctccgggataccggtatgccgcggccatggtgccgaccgggtccctccttagcacgatcgaggtgcgactcggaccgatg

SEQ ID NO: 3859 - DNA, 203 bp, Homo sapiens
  source 1..203: mol_type = other DNA
ggcgcgccagtccttggtcaacatcaaaggttatatcaaggcgcggaacggccttatcaaaacactcgcctccgcggatgcaacccgggtggtgtttgtgcaagaacccgggtgtctttgatctcgggatcctgctgacgtaagcgaccctttgcggtttcggtctccccacctccaccgcacacccccgactcggaccgatg

SEQ ID NO: 3860 - DNA, 203 bp, Homo sapiens
  source 1..203: mol_type = other DNA
ggcgcgccagtcctaagaacccgggtgtctttgatctcgggatcctgctgacgtaagcgaccctttgcggtttcggtctccccacctccaccgcacaccccatgaccatgcgggatgaccttcctctggtggatcgagatctggtcgacgaggccgccttcgggggggaggagggagaactgccgctgcgactcggaccgatg

SEQ ID NO: 3861 - DNA, 203 bp, Homo sapiens
  source 1..203: mol_type = other DNA
ggcgcgccagtcctgggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgcgactcggaccgatg

SEQ ID NO: 3862 - DNA, 203 bp, Homo sapiens
  source 1..203: mol_type = other DNA
ggcgcgccagtcctctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaagggaccgaaaccgggcctactttgtgtgccgactcggaccgatg

SEQ ID NO: 3863 - DNA, 203 bp, Homo sapiens
  source 1..203: mol_type = other DNA
ggcgcgccagtcctctggcactctgtcgataccccaccgagaccccattgggaccaatacgcccgcgtttcttccttttccccaccccaacccccaagttcgggtgaaggcccagggctcgcagccaacgtcggggcggcaagccctgccatagccacgggccccgtgggttagggacggggtccccccgactcggaccgatg

SEQ ID NO: 3864 - DNA, 203 bp, Homo sapiens
  source 1..203: mol_type = other DNA
ggcgcgccagtcctgggtgaaggcccagggctcgcagccaacgtcggggcggcaagccctgccatagccacgggccccgtgggttagggacggggtcccccatggggaatggtttatggttcgtgggggttattattttgggcgttgcgtggggtcaggtccacgactggactgagcagacagacccacgactcggaccgatg

SEQ ID NO: 3865 - DNA, 203 bp, Homo sapiens
  source 1..203: mol_type = other DNA
ggcgcgccagtcctcccgcttaacagcgtcaacagcgtgccgcagatcttggtggcgtgaaactcccgcacctcttcggccagcgccttgtagaagcgcgtatggcttcgtacccctgccatcaacacgcgtctgcgttcgaccaggctgcgcgttctcgcggccataacaaccgacgtacggcgttgcgactcggaccgatg

SEQ ID NO: 3866 - DNA, 203 bp, Homo sapiens
  source 1..203: mol_type = other DNA
ggcgcgccagtcctcggcgggagccacccgacaacagcccccgggttttcccacgccagacgcgggtccgctgtgccatcgcgccccctcatcccaccccccatcttgtccccaaataaaacaaggtctggtagttaggacaacgaccgcagttctcgtgtgttattttcgctctccgcctctcgcagcgactcggaccgatg

SEQ ID NO: 3867 - DNA, 203 bp, Homo sapiens
  source 1..203: mol_type = other DNA
ggcgcgccagtcctaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgccgactcggaccgatg

SEQ ID NO: 3868 - DNA, 203 bp, Homo sapiens
  source 1..203: mol_type = other DNA
ggcgcgccagtccttacccggggggttgtcggtgaaggggagggattcattccccaaccccggtctccaaccctccccttgaccgtcgccgcccccccccggattttgacgctcgggagacataccttgtcgggcgtccgtcgtcgtgccgggattacctccgttcggggaccgattgacaaaaggaccgactcggaccgatg

SEQ ID NO: 3869 - DNA, 203 bp, Homo sapiens
  source 1..203: mol_type = other DNA
ggcgcgccagtcctgattttgacgctcgggagacataccttgtcgggcgtccgtcgtcgtgccgggattacctccgttcggggaccgattgacaaaaggacatggagacaaagcccaagacggcaaccaccatcaaggtcccccccgggcccctgggatacgtgtacgctcgcgcgtgtccgtccgaacgactcggaccgatg

SEQ ID NO: 3870 - DNA, 203 bp, Homo sapiens
  source 1..203: mol_type = other DNA
ggcgcgccagtcctacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgcccgactcggaccgatg

SEQ ID NO: 3871 - DNA, 203 bp, Homo sapiens
  source 1..203: mol_type = other DNA
ggcgcgccagtcctggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctcgactcggaccgatg

SEQ ID NO: 3872 - DNA, 203 bp, Homo sapiens
  source 1..203: mol_type = other DNA
ggcgcgccagtcctcctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccacccgactcggaccgatg

SEQ ID NO: 3873 - DNA, 203 bp, Homo sapiens
  source 1..203: mol_type = other DNA
ggcgcgccagtcctacttaagtggccgtataacaccccgcgaagacgcggggtactcgcaacgcctgcgggggtcctggagggccgcgggggatcgataattcgccgctccctacagcgcacgacagtcattcccgcccggtctcgtcgttggtctacgctgtcccccacccacgcgagccgggcgtccgactcggaccgatg

SEQ ID NO: 3874 - DNA, 203 bp, Homo sapiens
  source 1..203: mol_type = other DNA
ggcgcgccagtccttcgccgctccctacagcgcacgacagtcattcccgcccggtctcgtcgttggtctacgctgtcccccacccacgcgagccgggcgtcatggcagaccgcggtctcccgtccgaggcccccgtcgtcacgacctcacccgcgggtccgccctcggacggacctatgcagcgcctacgactcggaccgatg

SEQ ID NO: 3875 - DNA, 203 bp, Homo sapiens
  source 1..203: mol_type = other DNA
ggcgcgccagtcctcgtccctccccggtttcctttgcgctcccgccttccggacctgctctcgcctactcttctttggctctcggtgcgattcgtcaggcagcggccttgtcgaatctcgaccccaccactcgccggacccgccgacgtcccctctcgagcccgccgaaacccgccgcgtctgttgaacgactcggaccgatg

SEQ ID NO: 3876 - DNA, 203 bp, Homo sapiens
  source 1..203: mol_type = other DNA
ggcgcgccagtcctgcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccgactcggaccgatg

SEQ ID NO: 3877 - DNA, 203 bp, Homo sapiens
  source 1..203: mol_type = other DNA
ggcgcgccagtcctcatgagctgcgcgctgtgaccgacaaaccccctccgcgccaggcccgccgccactgtcgtcgccgtcccacgctctcccctgctgccatggattccgcggccccagccctctcccccgctctgacggcccttacggaccagagcgcgacggcggacctggcgatccagattccacgactcggaccgatg

SEQ ID NO: 3878 - DNA, 203 bp, Homo sapiens
  source 1..203: mol_type = other DNA
ggcgcgccagtcctccgcgtggagttgggccatcgaaattataaagagcgtcccctaacggattattgtcctcttgtgtcggtgttgttgtctgggtcaccatacacagagagacaggctcgggtgtccgggaccgtcgcaccaaccacgccttagttaggccgatccgcagttacaattgacctgaccgactcggaccgatg

SEQ ID NO: 3879 - DNA, 203 bp, Homo sapiens
  source 1..203: mol_type = other DNA
ggcgcgccagtcctatacacagagagacaggctcgggtgtccgggaccgtcgcaccaaccacgccttagttaggccgatccgcagttacaattgacctgacatgggtttgttcgggatgatgaagtttgcccacacacaccatctggtcaagcgccggggccttggggccccggccgggtacttcacccgactcggaccgatg

SEQ ID NO: 3880 - DNA, 203 bp, Homo sapiens
  source 1..203: mol_type = other DNA
ggcgcgccagtcctgtttctggctcggtgagcgagggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggcgactcggaccgatg

SEQ ID NO: 3881 - DNA, 203 bp, Homo sapiens
  source 1..203: mol_type = other DNA
ggcgcgccagtcctcgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgcgactcggaccgatg

SEQ ID NO: 3882 - DNA, 203 bp, Homo sapiens
  source 1..203: mol_type = other DNA
ggcgcgccagtcctcccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggccgactcggaccgatg

SEQ ID NO: 3883 - DNA, 203 bp, Homo sapiens
  source 1..203: mol_type = other DNA
ggcgcgccagtcctctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctggcgactcggaccgatg

SEQ ID NO: 3884 - DNA, 203 bp, Homo sapiens
  source 1..203: mol_type = other DNA
ggcgcgccagtcctattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacgactcggaccgatg

SEQ ID NO: 3885 - DNA, 203 bp, Homo sapiens
  source 1..203: mol_type = other DNA
ggcgcgccagtcctaacacctcggccttctagggcacccacgaattggtactattacaaactccctggtcttaccaatcagcggtggaaaggacctttgcaatctctccaggaagctgcaggagcagccttactctcgatagacggctcccctcagtggatcccgtggcggctcctgaaaaagactgtcgactcggaccgatg

SEQ ID NO: 3886 - DNA, 203 bp, Homo sapiens
  source 1..203: mol_type = other DNA
ggcgcgccagtcctacccagccacttcgggtccttgttctctccgggagagacaaacaagtgggggctcgtccgggatacctacccctgccctctcgcattatgggacaaacctacggcctctcgtccagcccaatccccaaggcccccagggggttatcaacccaccattggttaaacttcctccaacgactcggaccgatg

SEQ ID NO: 3887 - DNA, 203 bp, Homo sapiens
  source 1..203: mol_type = other DNA
ggcgcgccagtcctagccgaagccgcgccgcgtgtcttgtctgctgcagcatcgttctgtgttgtctctgtttgactgtttttctgtatttgtctgaaagcatgggccagactgttaccacccccttaagtttgactttagaccactggaaagatgtcgaacggacagcccacaaccagttggtggagcgactcggaccgatg

SEQ ID NO: 3888 - DNA, 203 bp, Homo sapiens
  source 1..203: mol_type = other DNA
ggcgcgccagtcctctaggacaaaaccttttcaatccagttctagcctccaccccaacctcgtcacggagaatccaagaggcactggaggaggaacacccggacagcatacactcggtggagaccaggacatgcgggtcgatacttccggtattaagcccttatcctctttgtgccaatgtgccagggcgactcggaccgatg

SEQ ID NO: 3889 - DNA, 203 bp, Homo sapiens
  source 1..203: mol_type = other DNA
ggcgcgccagtcctgacagcatacactcggtggagaccaggacatgcgggtcgatacttccggtattaagcccttatcctctttgtgccaatgtgccagggatgaccctggacgcagtgataacccactggaaatggcagaaccagtacagccctggtggaccgacagttctctggagccagagatcacgactcggaccgatg

SEQ ID NO: 3890 - DNA, 203 bp, Homo sapiens
  source 1..203: mol_type = other DNA
ggcgcgccagtcctggtggtatctactggaaccttatagagttatctggaatccactaaagattggagaaggtcacaacaattggcgcccaacgtggggctcgagttttcttctgaccaagataactaagaggggagtgagaaggctcttgcttactatccctagggaactgaggcaccgtctcaggacgactcggaccgatg

SEQ ID NO: 3891 - DNA, 203 bp, Homo sapiens
  source 1..203: mol_type = other DNA
ggcgcgccagtcctcgagttttcttctgaccaagataactaagaggggagtgagaaggctcttgcttactatccctagggaactgaggcaccgtctcaggaatggctcttaatgacttcgaccctatagctctccaggggtatttacccgcaccacgagttttgcaacataatgatattataatatgtcgactcggaccgatg

SEQ ID NO: 3892 - DNA, 203 bp, Homo sapiens
  source 1..203: mol_type = other DNA
ggcgcgccagtcctgacagccaacccctggaaacgggaaccaaaacaggaatttcagccggggtcccgcccccgtcaacgagcaaagtcgcggacgtgggagaagcagccaaggaacaaacaacacaggaagttctgcggtccacagtgtgagattaacatctgctgctccacccatacccccacaagcgactcggaccgatg

SEQ ID NO: 3893 - DNA, 203 bp, Homo sapiens
  source 1..203: mol_type = other DNA
ggcgcgccagtcctgaagcagccaaggaacaaacaacacaggaagttctgcggtccacagtgtgagattaacatctgctgctccacccatacccccacaagatgccggcactccgcccacttcaagtggaaatcaagggcaatcatcttaaaggctactgggactctggggctgaaatcacttgtgtccgactcggaccgatg

SEQ ID NO: 3894 - DNA, 203 bp, Homo sapiens
  source 1..203: mol_type = other DNA
ggcgcgccagtcctacaaatatcatcaaccgcagtgtacatggtcctgtgaagatcgttgtgggcatcgttggaaggagtgcgggaattgtattccacaggatggctcctccgatgacgcttcagcagtggctgcagtggagatataacctagagacgaccaacctcttacagatgaaccctaaaatgcgactcggaccgatg

SEQ ID NO: 3895 - DNA, 203 bp, Homo sapiens
  source 1..203: mol_type = other DNA
ggcgcgccagtccttgttttcagcatactagcctatgctaaaccggtcattattgggataatacttatcattttacttttgttagtcatcagaatattgagatggctagcggtggaacgccggagaaagcaagagtagcctgcagacgagtggatctctcctccttcttggcccagcccgatgactaccgactcggaccgatg

SEQ ID NO: 3896 - DNA, 203 bp, Homo sapiens
  source 1..203: mol_type = other DNA
ggcgcgccagtcctcgcacatttagttcccagagggcgttgtcgtctccccctaagcaagggagaaacacgtggcacatgatcttgcgcttaacgataaaaatggaatctgataaaagtatggcctgtttaaatagaattttgatgaataagatgatgtttgtggaagataagatctctacccttaagcgactcggaccgatg

SEQ ID NO: 3897 - DNA, 203 bp, Homo sapiens
  source 1..203: mol_type = other DNA
ggcgcgccagtcctgggggccgggcccactattgttgtgggctccgagttcctctagggatggccgaaaggcagccatggggccacccaggcggcgccgtgctacaggcggcaaggggaaaaatccttcgggtgaccccgggtggcattccctcccttagcagcatgagtgtggtggtagctgcaacccgactcggaccgatg

SEQ ID NO: 3898 - DNA, 203 bp, Homo sapiens
  source 1..203: mol_type = other DNA
ggcgcgccagtcctcttattattttatacaacaatttatggtgacattgactgatactattgagttcgcccgcttgccattgaatattgccttgtattaccttatagcatttcaaaaagccacagatctcaccctcgagctcattcactttgcagtttgtttgaatcgcatacacaagacatttgaaccgactcggaccgatg

SEQ ID NO: 3899 - DNA, 203 bp, Homo sapiens
  source 1..203: mol_type = other DNA
ggcgcgccagtcctttatagcatttcaaaaagccacagatctcaccctcgagctcattcactttgcagtttgtttgaatcgcatacacaagacatttgaacatgggagcccagttgagcagaaatactgccgggagccacactactggaacctacgctaccggaggctcaaccattaattataacaaccgactcggaccgatg

SEQ ID NO: 3900 - DNA, 203 bp, Homo sapiens
  source 1..203: mol_type = other DNA
ggcgcgccagtcctcacgataaccacagccactgaaggcacggacgctgaagacacgagtgaggtcgacgtcatcaacgtcgtcgatccaataggataactatgttttcagactcagattcctcggacgaggaactaagcagaataattactgacattgacgagagcccccaggatatccagcaaagtcgactcggaccgatg

SEQ ID NO: 3901 - DNA, 203 bp, Homo sapiens
  source 1..203: mol_type = other DNA
ggcgcgccagtcctgtcagcatatcatcaacaggttgtggaccagtggccttctacaagcctccccccaggcccagagcccggatcctggtgtatgcttagaaacccaaagaaatcatctaattgggaaggaccttttctgatcctcctctctacaccaacggcggtaaaagttgaaggacgaccaaccgactcggaccgatg

SEQ ID NO: 3902 - DNA, 203 bp, Homo sapiens
  source 1..203: mol_type = other DNA
ggcgcgccagtcctaaacccaaagaaatcatctaattgggaaggaccttttctgatcctcctctctacaccaacggcggtaaaagttgaaggacgaccaacatggatacacctggatcattgcaagttattgcgatcatctctctcctcctcgttgggggggccagtcaaccagctactttcttagagcgactcggaccgatg

SEQ ID NO: 3903 - DNA, 203 bp, Homo sapiens
  source 1..203: mol_type = other DNA
ggcgcgccagtcctttggccagctggtccaggagagggtgtacaggccgtcacaattaaggcctaagtggaggaagcctacaaaggtcttggaaatattgaatcctagaactgtgattatagtggaccatctaggccaacggaaatctgtgagtattgacaatttaaaacctacagcacaccagcatacgactcggaccgatg

SEQ ID NO: 3904 - DNA, 203 bp, Homo sapiens
  source 1..203: mol_type = other DNA
ggcgcgccagtcctatcctagaactgtgattatagtggaccatctaggccaacggaaatctgtgagtattgacaatttaaaacctacagcacaccagcataatggaacaagaacatgtgatgaccctgaaggaatggatggaatggaatgctcacaaacaactacagaaacttcagtcgactcatcctcgactcggaccgatg

SEQ ID NO: 3905 - DNA, 203 bp, Homo sapiens
  source 1..203: mol_type = other DNA
ggcgcgccagtcctactaatcaagacgccgtcgtgcagcccacaaaagtctagatacgtcacaggagagcatacgctaggtcgcgttgactatccttatatatgacctgcaaatataaacgaaaacactacaacaaaaatacaacagcaaatcctttcttttagttcggaaggtgaatccccgtcgtccgactcggaccgatg

SEQ ID NO: 3906 - DNA, 203 bp, Homo sapiens
  source 1..203: mol_type = other DNA
ggcgcgccagtcctacaggtaggcagacagggaacctgagcaaccaggcaaagaagacacctagggatggaagacctccactagacaaagaccagtgcgcatactgtaaagagaagggccattgggcaagagaatgtccccgaaaaaaacacgtcagagaagccaaggttctagccctagataactagcgactcggaccgatg

SEQ ID NO: 3907 - DNA, 203 bp, Homo sapiens
  source 1..203: mol_type = other DNA
ggcgcgccagtcctcccaaatctgggaccagatcaaagaggtgtataagcctggtaccgtaacaatccctcacccgttccaggtcggggatcaagtgcttgtcagacgccatcgacccagcagccttgagcctcggtggaaaggcccatacctggtgttgctgactaccccgaccgcggtaaaagtcgcgactcggaccgatg

SEQ ID NO: 3908 - DNA, 203 bp, Homo sapiens
  source 1..203: mol_type = other DNA
ggcgcgccagtcctcggtcgcctcgccgccgtctctggtttctttttgtttcgtttctggaaagcctctgtgtcacagtctttctctcccaaatcatcaatatgggacaagataattctacccctatctccctcactctaaatcactggagagatgtgagaacaagggctcacaatctatccgtggaacgactcggaccgatg

SEQ ID NO: 3909 - DNA, 203 bp, Homo sapiens
  source 1..203: mol_type = other DNA
ggcgcgccagtcctgtgttaaaaaactgcgtatgtttaaaacttaggaaccaagacagtgacaattggtcttggtattggacaattgttcaaggttccaaaatgagtgatatatttgacgaggcggctagtttcagaagctatcaatcgaaactcggtcgagatgggcgggcaagtgcggcaacagctcgactcggaccgatg

SEQ ID NO: 3910 - DNA, 203 bp, Homo sapiens
  source 1..203: mol_type = other DNA
ggcgcgccagtcctgaccctggtgcaaggttatatatagagcccaattctcctaattaaacagtgtctcaggttgacaaatggacaagttggatctagtcaatgatggcctcgatattattgactttattcagaagaaccaaaaagaaatacaaaagacatacggacgatcaagcatccaacaaccaacgactcggaccgatg

SEQ ID NO: 3911 - DNA, 203 bp, Homo sapiens
  source 1..203: mol_type = other DNA
ggcgcgccagtcctaatattctcatacctgtccattcaccttggacttaaagagagacaatcattcagccccgtccaagacacacctgagtggccagaaccatggattttagtgtgagtgataaccttgatgatccaatagaaggtgtttcagattttagtcccacctcatgggagaatggagggtatcgactcggaccgatg

SEQ ID NO: 3912 - DNA, 203 bp, Homo sapiens
  source 1..203: mol_type = other DNA
ggcgcgccagtcctaatatcttggcaaacactacactaacctcgtctgtactgtctgaaagtggtcaggattgattgacagttattatttatctttaagcaatggctacacaagaggtcaggctaaagtgtttgctctgtgggatcatagttctggttttgtcattagaagggctagggatactacatcgactcggaccgatg

SEQ ID NO: 3913 - DNA, 203 bp, Homo sapiens
  source 1..203: mol_type = other DNA
ggcgcgccagtcctaggcaggtaccccacctccgggtgggatctgagcctgggctaattgtctacgggtagtttcatttccaatccttttatgtcggagtcatggctgcaacacgggtttcacgatctgtgctcgctgctgtggctcactctgccgctcaccgcacctaccacactgtccttgactgccgactcggaccgatg

SEQ ID NO: 3914 - DNA, 203 bp, Homo sapiens
  source 1..203: mol_type = other DNA
ggcgcgccagtcctaaccaagaacctcgagccacggtggaaaggaccacatatcgtcctcctgaccacccccacagccttaaaggtagacggagttgctgcctggattcacgcctctcacgtgaaagctgcaggaccaaccaccaatcaagacctctcggacagccccagctcagacgatccatcaagcgactcggaccgatg

SEQ ID NO: 3915 - DNA, 203 bp, Homo sapiens
  source 1..203: mol_type = other DNA
ggcgcgccagtcctctggattcacgcctctcacgtgaaagctgcaggaccaaccaccaatcaagacctctcggacagccccagctcagacgatccatcaagatggaaagtccaacgcacccaaaaccctctaaagataagactctctcgtggaacttagcgtttctggtggggatcttattcacaatacgactcggaccgatg

SEQ ID NO: 3916 - DNA, 203 bp, Homo sapiens
  source 1..203: mol_type = other DNA
ggcgcgccagtcctcccgacccccgggaccaccgacccaccatcaggaggtaagctggccggcgaccatacctgttgtccttgtataagtgtctctgtcaattgatctgattttggcggtgggatcgaaggagctgacgagctcgtacttcgcccccgcaaccctggaagacgttccacgggtgtctgcgactcggaccgatg

SEQ ID NO: 3917 - DNA, 203 bp, Homo sapiens
  source 1..203: mol_type = other DNA
ggcgcgccagtcctcaggatggcaggccatgttccgctggatgcgcttccatgacctcggattgtggacaggagatcgcgatcttctgcccgaattcgtaaatgatgatggcgtctaaggacgctacatcaagcgtggatggcgctagtggcgctggtcagttggtaccggaggttaatgcttctgaccgactcggaccgatg

SEQ ID NO: 3918 - DNA, 203 bp, Homo sapiens
  source 1..203: mol_type = other DNA
ggcgcgccagtcctgtgaatgatgatggcgtcaaaagacgtcgttcctactgctgctagcagtgaaaatgctaacaacaatagtagtattaagtctcgtctattggcgagactcaagggttcaggtggggctacgtccccacccaactcgataaagataaccaaccaagatatggctctggggctgatcgactcggaccgatg

SEQ ID NO: 3919 - DNA, 203 bp, Homo sapiens
  source 1..203: mol_type = other DNA
ggcgcgccagtcctcaaagcataccctgatggtttcctcacttgtgtccccaatggggctagctcgggtccacaacagctgccgatcaatggggtctttgtctttgtttcatgggtgtccagattttatcaattaaagcctgtgggaactgccagctcggcaagaggtaggcttggtctgcgccgatacgactcggaccgatg

SEQ ID NO: 3920 - DNA, 203 bp, Homo sapiens
  source 1..203: mol_type = other DNA
ggcgcgccagtcctagcaaaagcaggggaaaataaaaacaaccaaaatgaaggcaaacctactggtcctgttatgtgcacttgcagctgcagatgcagacacaatatgtataggctaccatgcgaacaattcaaccgacactgttgacacagtgctcgagaagaatgtgacagtgacacactctgttacgactcggaccgatg

SEQ ID NO: 3921 - DNA, 203 bp, Homo sapiens
  source 1..203: mol_type = other DNA
ggcgcgccagtccttcaatccgaccttacttttcttaaaagtgccagcacaaaatgctataagcacaactttcccttataccggagaccctccttacagccatgggacaggaacaggatacaccatggatactgtcaacaggacacatcagtactcagaaaaggcaagatggacaacaaacaccgaaacgactcggaccgatg

SEQ ID NO: 3922 - DNA, 203 bp, Homo sapiens
  source 1..203: mol_type = other DNA
ggcgcgccagtcctagtaaatcctgtgtgctaattgaggtgcattggtctgcaaatcgagttgctaggcaataaacacatttggattaattttaatcgttcgttgagcgattagcagagaactgaccagaacatgtctggtcgtaaagctcagggaaaaaccctgggcgtcaatatggtacgacgaggcgactcggaccgatg

SEQ ID NO: 3923 - DNA, 203 bp, Homo sapiens
  source 1..203: mol_type = other DNA
ggcgcgccagtcctcattagtcgaggagtctcgagatgccatgtggacgagggcatgcccacggcacatcttaacccacgcgggggttgcatgggtgaaagcgctattcgtggcgttatggacacagcctgatagggtgtagcagagacctgctattccgctagtaaaaactctgctgtacatggcaccgactcggaccgatg

SEQ ID NO: 3924 - DNA, 203 bp, Homo sapiens
  source 1..203: mol_type = other DNA
ggcgcgccagtcctgcttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtcgactcggaccgatg

SEQ ID NO: 3925 - DNA, 203 bp, Homo sapiens
  source 1..203: mol_type = other DNA
ggcgcgccagtcctgacaccacgtggccatttagggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgagctggcgactcggaccgatg

SEQ ID NO: 3926 - DNA, 203 bp, Homo sapiens
  source 1..203: mol_type = other DNA
ggcgcgccagtcctcccggaagtggtgttttgcgatttcgaggccgggctcgatcctcacctttcattgtcgataggggacattttgacactacctggaaaatgtcgtctgtgctcaaagcatttgagcgattcacaatagaacaggaacttcaagacaggggtgaggagggttcaattccgccggagcgactcggaccgatg

SEQ ID NO: 3927 - DNA, 203 bp, Homo sapiens
  source 1..203: mol_type = other DNA
ggcgcgccagtcctaaggccagcaccgaggatgctctgaatgatatcaagcgagacatcataagaagcgccatatgaactcaccaggaacaccagactcacgggaaaatccacaaactgaaagccacaatgattccctgtttaataaaaaataagcacgaacacaagtccaatccaaccatagcagcacgactcggaccgatg

SEQ ID NO: 3928 - DNA, 203 bp, Homo sapiens
  source 1..203: mol_type = other DNA
ggcgcgccagtcctgaaaaaatcaagccagaacaagcttaggatcacaatacaacacagaaccccagctgctatcataactgttctctggccgctcgaaagatggagccctccaaactcttcacaatgtcagacaatgccacctttgcacctgggcctgttatcaatgcggctgacaagaagacattccgactcggaccgatg

SEQ ID NO: 3929 - DNA, 203 bp, Homo sapiens
  source 1..203: mol_type = other DNA
ggcgcgccagtcctttgctagttaccagatgcaaggatctggtgggaagcgaagagcgaccgaacggaccatatctcccggtcatcagcctattcccaatcaacagccggagccccagagcagcttgtcaacagattctacacttctacaggacccaggagaaggacaatcatccagagatcatttggcgactcggaccgatg

SEQ ID NO: 3930 - DNA, 203 bp, Homo sapiens
  source 1..203: mol_type = other DNA
ggcgcgccagtccttaccttcagcttattaacctatgccaaaccagtaattattggcatagttgttatcgttctccttatccttattattaggatattatcatggctagcagctcttggaccccgtcgccgtcgccgagaggacaaaggagaataaccagaaaagaactctgggaagtggacttatcccgactcggaccgatg

SEQ ID NO: 3931 - DNA, 203 bp, Homo sapiens
  source 1..203: mol_type = other DNA
ggcgcgccagtcctagcagaagcacgcactttcttaaaatgtcgctgtttggagacacaattgcctacctgctttcactaatagaagatggagaaggcaaagcagaactagctgaaaaattacactgttggttcggtgggaaagaatttgacctagattctgctttggaatggataaaaaacaaaaggcgactcggaccgatg

SEQ ID NO: 3932 - DNA, 203 bp, Homo sapiens
  source 1..203: mol_type = other DNA
ggcgcgccagtcctaaaaccttcatcatccttacgtcaattgaattctctagcactcgaagcttattgtcttcaatgtaaaagaaaagctggtctaacaagatgacaactagaacaaagggcaggggccatactgcggccacgactcaaaacgacagaatgccaggccctgagctttcgggctggatccgactcggaccgatg

SEQ ID NO: 3933 - DNA, 203 bp, Homo sapiens
  source 1..203: mol_type = other DNA
ggcgcgccagtcctacagacattgcccttctaattaagaaaaaatcggcgatgaagattaagccgacagtgagcgtaatcttcatctctcttagattatttgttttccagagtaggggtcgtcaggtccttttcaatcgtgtaaccaaaataaactccactagaaggatattgtggggcaacaacacacgactcggaccgatg

SEQ ID NO: 3934 - DNA, 203 bp, Homo sapiens
  source 1..203: mol_type = other DNA
ggcgcgccagtcctgttttccagagtaggggtcgtcaggtccttttcaatcgtgtaaccaaaataaactccactagaaggatattgtggggcaacaacacaatgggcgttacaggaatattgcagttacctcgtgatcgattcaagaggacatcattctttctttgggtaattatccttttccaaagacgactcggaccgatg

SEQ ID NO: 3935 - DNA, 203 bp, Homo sapiens
  source 1..203: mol_type = other DNA
ggcgcgccagtccttccttgattctacaatcatgacagttgtctttagtgacaagggaaagaagcctttttattaagttgtaataatcagatctgcgaaccggtagagtttagttgcaacctaacacacataaagcattggtcaaaaagtcaatagaaatttaaacagtgagtggagacaacttttaacgactcggaccgatg

SEQ ID NO: 3936 - DNA, 203 bp, Homo sapiens
  source 1..203: mol_type = other DNA
ggcgcgccagtcctcattctacaaacgccttactcgaggttccgtctcgtgtttgtgtggaagcaaagttctgtctttgtggaaaccagtaactgttcctaatggcctgcaaccgtgtgacacttgccgtagcaagtgattctgaaatttctgcaaatggctgttctactattgcgcaagccgtccgccgactcggaccgatg

SEQ ID NO: 3937 - DNA, 203 bp, Homo sapiens
  source 1..203: mol_type = other DNA
ggcgcgccagtcctgttaaaatatataacgtatttttaaaacttaggaaccaagacaaacacttttggtcttggtattggatcctcaagaaatatatcatcatgagtgatatctttgaagaggcggctagttttaggagttatcaatctaagttagggagagatgggagggctagtgcagcaactgctcgactcggaccgatg

SEQ ID NO: 3938 - DNA, 203 bp, Homo sapiens
  source 1..203: mol_type = other DNA
ggcgcgccagtcctcaaaggagagattgaatgcttttttggagatctagatcattactatatgtgtctcctataatcacatcataggagtgaaccataatacacatctttgggtaggggaaggaaagtattgttgacgtactgattgatctgcttgagtcaaataatcagtcataacaattcaagaaacgactcggaccgatg

SEQ ID NO: 3939 - DNA, 203 bp, Homo sapiens
  source 1..203: mol_type = other DNA
ggcgcgccagtcctggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgcgactcggaccgatg

SEQ ID NO: 3940 - DNA, 203 bp, Homo sapiens
  source 1..203: mol_type = other DNA
ggcgcgccagtcctcctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagcgactcggaccgatg

SEQ ID NO: 3941 - DNA, 203 bp, Homo sapiens
  source 1..203: mol_type = other DNA
ggcgcgccagtcctcgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccgactcggaccgatg

SEQ ID NO: 3942 - DNA, 203 bp, Homo sapiens
  source 1..203: mol_type = other DNA
ggcgcgccagtcctgattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtcgactcggaccgatg

SEQ ID NO: 3943 - DNA, 203 bp, Homo sapiens
  source 1..203: mol_type = other DNA
ggcgcgccagtcctctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcgactcggaccgatg

SEQ ID NO: 3944 - DNA, 203 bp, Homo sapiens
  source 1..203: mol_type = other DNA
ggcgcgccagtcctacgccccaggcattaagtgccacacatgtgtgtttacttgaggtgatgtcagtatttatagggtgtggagtgcaataaaatatgtgttgactttaagtgcgtggtttatgactcaggggaggggactttgggtatataagcaggtgcagacctgtgtggttagctcagagcggtcgactcggaccgatg

SEQ ID NO: 3945 - DNA, 203 bp, Homo sapiens
  source 1..203: mol_type = other DNA
ggcgcgccagtccttgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagacgactcggaccgatg

SEQ ID NO: 3946 - DNA, 203 bp, Homo sapiens
  source 1..203: mol_type = other DNA
ggcgcgccagtcctaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgactcggaccgatg

SEQ ID NO: 3947 - DNA, 203 bp, Homo sapiens
  source 1..203: mol_type = other DNA
ggcgcgccagtcctagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaacgactcggaccgatg

SEQ ID NO: 3948 - DNA, 203 bp, Homo sapiens
  source 1..203: mol_type = other DNA
ggcgcgccagtcctggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagcgactcggaccgatg

SEQ ID NO: 3949 - DNA, 203 bp, Homo sapiens
  source 1..203: mol_type = other DNA
ggcgcgccagtcctcttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcgactcggaccgatg

SEQ ID NO: 3950 - DNA, 203 bp, Homo sapiens
  source 1..203: mol_type = other DNA
ggcgcgccagtcctccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgactcggaccgatg

SEQ ID NO: 3951 - DNA, 203 bp, Homo sapiens
  source 1..203: mol_type = other DNA
ggcgcgccagtcctccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgcgactcggaccgatg

SEQ ID NO: 3952 - DNA, 203 bp, Homo sapiens
  source 1..203: mol_type = other DNA
ggcgcgccagtcctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctcgactcggaccgatg

SEQ ID NO: 3953 - DNA, 203 bp, Homo sapiens
  source 1..203: mol_type = other DNA
ggcgcgccagtcctcccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgcccgactcggaccgatg

SEQ ID NO: 3954 - DNA, 203 bp, Homo sapiens
  source 1..203: mol_type = other DNA
ggcgcgccagtcctttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgccgactcggaccgatg

SEQ ID NO: 3955 - DNA, 203 bp, Homo sapiens
  source 1..203: mol_type = other DNA
ggcgcgccagtcctacctgggaccgcaatgtccagggttagtagtcagcggcatcgtcggtgtgctttgtgggttagcagttataatcatctgcatgttcatttttgcttgctgctacagaaggcttcaccgacagaaatcagacccactgctgaacctctatgtttaatttttgattttccagagcccgactcggaccgatg

SEQ ID NO: 3956 - DNA, 203 bp, Homo sapiens
  source 1..203: mol_type = other DNA
ggcgcgccagtcctcattgtgatcggggtggtcatcctagcgatgctgctctacttcatcttctgccgccgcatccccaacgcgaaaccggtctacaagcccatcgttatcgggcagccggagccgcttcaggtggagggaggtctaaggaatcttctcttctcttttacagtatggtgatttgaactcgactcggaccgatg

SEQ ID NO: 3957 - DNA, 203 bp, Homo sapiens
  source 1..203: mol_type = other DNA
ggcgcgccagtcctcatcgttatcgggcagccggagccgcttcaggtggagggaggtctaaggaatcttctcttctcttttacagtatggtgatttgaactatgattcctagacagttctttatcattggtcttctctgcgcgctccaagtctgtgccaccctcgctctggtggctaatgcgagtccacgactcggaccgatg

SEQ ID NO: 3958 - DNA, 203 bp, Homo sapiens
  source 1..203: mol_type = other DNA
ggcgcgccagtcctggtctttgtgcgcatcgcctacctgcgccaccacccccagtaccgcgaccaaagagtggcgcagctgctcaggctcatctgataagcatgcgggctttgctacttctcatgcttctactattgctagctcccctggtcgccccctttcccctcaaatcccccacccagtccccccgactcggaccgatg

SEQ ID NO: 3959 - DNA, 203 bp, Homo sapiens
  source 1..203: mol_type = other DNA
ggcgcgccagtccttcggccagcctaagggacaacacccccaggggcttttcttggaatccatctgaagagacgaagggagggttgatgaagggcacggtcggtgcgttgtctgcatcgtagggatacacggggtcgaagccatcatccacccgcgcgcgctttttggacatctaatagaaataaaaacgactcggaccgatg

SEQ ID NO: 3960 - DNA, 203 bp, Homo sapiens
  source 1..203: mol_type = other DNA
ggcgcgccagtcctggtgcgttgtctgcatcgtagggatacacggggtcgaagccatcatccacccgcgcgcgctttttggacatctaatagaaataaaaaatgaagattgagggacaggaggaatttgacatccccttcagagtgtggaggaagtttgcagcccgccggggcctgcagtaccagagccgactcggaccgatg

SEQ ID NO: 3961 - DNA, 203 bp, Homo sapiens
  source 1..203: mol_type = other DNA
ggcgcgccagtcctccccggcgggctgcaaacttcctccacactctgaaggggatgtcaaattcctcctgtccctcaatcttcattttttatttctattagatgtccaaaaagcgcgcgcgggtggatgatggcttcgaccccgtgtatccctacgatgcagacaacgcaccgaccgtgcccttcatccgactcggaccgatg

SEQ ID NO: 3962 - DNA, 203 bp, Homo sapiens
  source 1..203: mol_type = other DNA
ggcgcgccagtccttttccaccaacacagtgggggcgagaggtgccacctccgggacctgcattttgaagtgttccgagaccgtttggaataaagttaatcatggttcttcctgttcttccctcccccgccgtcaccgaaacccaacaaaattgcatcatctggctgggtttggcccattccaccgtgcgactcggaccgatg

SEQ ID NO: 3963 - DNA, 203 bp, Homo sapiens
  source 1..203: mol_type = other DNA
ggcgcgccagtccttagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatcgactcggaccgatg

SEQ ID NO: 3964 - DNA, 203 bp, Homo sapiens
  source 1..203: mol_type = other DNA
ggcgcgccagtccttgtggcttgcccttctcttgttcctggtggtcctatggctaaaaatttcggagaagatatgaatgagtacatacagttactgctaagggaggagcttagggattgcggcagagcaattgatattccacttgttaatctactacaggtgaaccaggagcagaatctgttggaattcgactcggaccgatg

SEQ ID NO: 3965 - DNA, 203 bp, Homo sapiens
  source 1..203: mol_type = other DNA
ggcgcgccagtcctgaagtgcacgtatttttttagtgtgtcaccggtttctgggcgtgttggcgggtatttttagaccttggcctttacgtcagtgaggttagggctatatattgagtacagaagcgggcagttaggttagagctcagctttttctctgactcttgcgcctgccgtgctcggtaagctcgactcggaccgatg

SEQ ID NO: 3966 - DNA, 203 bp, Homo sapiens
  source 1..203: mol_type = other DNA
ggcgcgccagtcctagggctatatattgagtacagaagcgggcagttaggttagagctcagctttttctctgactcttgcgcctgccgtgctcggtaagctatggacgctcaggttttgtatgtgtttctggagggagcgggggctttgctgcctgtgcagaaggggagtaattacattttttacgcacgactcggaccgatg

SEQ ID NO: 3967 - DNA, 203 bp, Homo sapiens
  source 1..203: mol_type = other DNA
ggcgcgccagtcctcgcggcgtcccactcgaggaccgacccataaagtcggtttacggggacacggacagcctctttgtcacccagcggggacacgagctcatggagaccagaggtaagaaacgcatcaaaaagaacggcggaaaactggtttttgatcccaatcagcccgacctcacctggctcgtgcgactcggaccgatg

SEQ ID NO: 3968 - DNA, 203 bp, Homo sapiens
  source 1..203: mol_type = other DNA
ggcgcgccagtcctgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggcgactcggaccgatg

SEQ ID NO: 3969 - DNA, 203 bp, Homo sapiens
  source 1..203: mol_type = other DNA
ggcgcgccagtcctcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgactcggaccgatg

SEQ ID NO: 3970 - DNA, 203 bp, Homo sapiens
  source 1..203: mol_type = other DNA
ggcgcgccagtcctatccctcaaggaagcagctggagcggctctcatcccagtaggtggaagccatctctggatcccgtggcgtctcctaaagaggggtatatgcccaagacccgaaagcaacgcagtcgccgacccagaaaccaaagaccatcaactccatgggtaagtccggtctttatttcagtccgactcggaccgatg

SEQ ID NO: 3971 - DNA, 203 bp, Homo sapiens
  source 1..203: mol_type = other DNA
ggcgcgccagtccttgctgcctgcagcgaggcttggcccggggccaacgcctgtgagattacccagctcggagttgggcctcaagaaagtaagggctaaagctgctagccctaggggagaaagcaaacaggtgggggctcgtccgggatcgatcacctctctgtatctgcccttccccaatcagaacccgactcggaccgatg

SEQ ID NO: 3972 - DNA, 203 bp, Homo sapiens
  source 1..203: mol_type = other DNA
ggcgcgccagtcctctgctagccctaggggagaaagcaaacaggtgggggctcgtccgggatcgatcacctctctgtatctgcccttccccaatcagaaccatgggaaagacttatagctctccggtaaaccctatccccaaagccccaaaagggctagcaattcaccactggctaaactttctccaacgactcggaccgatg

SEQ ID NO: 3973 - DNA, 203 bp, Homo sapiens
  source 1..203: mol_type = other DNA
ggcgcgccagtccttagattcggtgccggtaacgattccagttttatactatctgatcattctctatctctattaaggatatttctagtctaaagttcaaaatgtcaagtgttttaaagacatttgaaagatttactatacaacaggagcttcaggagcaatctgatgacactccagtacctcttgagcgactcggaccgatg

SEQ ID NO: 3974 - DNA, 203 bp, Homo sapiens
  source 1..203: mol_type = other DNA
ggcgcgccagtcctgacacaatagagaaaatctaggtccgaaagcttgcctctcagacagatcccaaaatcatagtccaaaccccaaacacagcagcagacatgcctataatatcattaccagcagatccaacttcacccagtcaatcccttactccgtttccaatacaacttgacaccaaagatggccgactcggaccgatg

SEQ ID NO: 3975 - DNA, 203 bp, Homo sapiens
  source 1..203: mol_type = other DNA
ggcgcgccagtcctgatgttatcataggtccgaactgatcaatctaacaaaaaaactaaacgttccacaataaatcaacgttcaggccaaaatattcagccatgcatcacctgcatccaatgatagtatgcatctttgttatgtacactggaattgtaggttcagatgccattgctggagatcaactacgactcggaccgatg

SEQ ID NO: 3976 - DNA, 203 bp, Homo sapiens
  source 1..203: mol_type = other DNA
ggcgcgccagtcctctcaaccagacaccaccagcatacacgaaaccaaccttcacagtggatacctcagcatccaaaactctccttcccgaatggatcaggatgccttcttttttgagagggatcctgaagccgaaggagaggcaccacgaaaacaagaatcactctcagatgtcatcggactccttgcgactcggaccgatg

SEQ ID NO: 3977 - DNA, 203 bp, Homo sapiens
  source 1..203: mol_type = other DNA
ggcgcgccagtcctcttcccgaatggatcaggatgccttcttttttgagagggatcctgaagccgaaggagaggcaccacgaaaacaagaatcactctcagatgtcatcggactccttgacgtcgtcttatcctacaagcccacagaaattggagaagacagaagctggctccatggtatcatcgacacgactcggaccgatg

SEQ ID NO: 3978 - DNA, 203 bp, Homo sapiens
  source 1..203: mol_type = other DNA
ggcgcgccagtcctccctacatgggtaacaactccaattaaaaaatcagatcaagtacattgtagcatacatacaacaatcaaatctatccacaacttcaccaatcaggtgtacaacaagtaagaaaaacttagggttaaagacaatccagtcaacctataaggcaacagcatccgattatacaaacgcgactcggaccgatg

SEQ ID NO: 3979 - DNA, 203 bp, Homo sapiens
  source 1..203: mol_type = other DNA
ggcgcgccagtcctagttgatcctgccagcggtgggtcgctactgtttcgcgaaccagtcgttttgacagttggttgggatcaaatttgttctgtgcgcgtcacgccactttttgtggcgggaatgtgcgaaaataacaggaaaaagaaccctggaaagggttcaaagaagaaaaagaatgctggaagcgactcggaccgatg

SEQ ID NO: 3980 - DNA, 203 bp, Homo sapiens
  source 1..203: mol_type = other DNA
ggcgcgccagtcctatggcggggaatttgaagaagaaatctgccaaacccaaggcccaaaggagaccacctcagggccgaggagggcaggtcaaacaaaaacccggtgctgctattgtgggagtcatgcattacgtgacccaccaggcgctgggcatgaagttaagtgggagacttaagaagttctggcgactcggaccgatg

SEQ ID NO: 3981 - DNA, 203 bp, Homo sapiens
  source 1..203: mol_type = other DNA
ggcgcgccagtcctacctaacggtgttggggttacagcctgatagggtgctgcagaggcccacgaataggctagtataaaaatctctgctgtacatggcacatggagttgaacaagtttgaacttttatacaaaacaagtaaacaaaaaccagtgggggtgactgaacctatctacgactcagcgggtcgactcggaccgatg

SEQ ID NO: 3982 - DNA, 203 bp, Homo sapiens
  source 1..203: mol_type = other DNA
ggcgcgccagtcctgtgctttagtcagtgtccgcagcgttctgttgaacgtgagtgtgttgagaaaaagacagcttaggagaacaagagctgggagtggttatgatgaccacttctaaaggaaaggggggcggtccccctaggcgcaagcttaaagtgaccgcaaataagtcgcgaccagcaacgagccgactcggaccgatg

SEQ ID NO: 3983 - DNA, 203 bp, Homo sapiens
  source 1..203: mol_type = other DNA
ggcgcgccagtcctcagcgactgtgattgtggatattctttctgcaagttttgtcgtgaacgtgttgagaaaaagacagcttaggagaacaagagctgggaatggccgggaaggccgttctaaaaggaaagggggggggtccccctcgacgagcgtcgaaagtggccccaaagaagacgcgtcagttgcgactcggaccgatg

SEQ ID NO: 3984 - DNA, 203 bp, Homo sapiens
  source 1..203: mol_type = other DNA
ggcgcgccagtcctcatccgtaatacaacccggaataacctccaaaccgagaagaactagtctatgaccagacgaaaaggaactagtccctgttcttttcttagggcctttttcacctgggtaaagtgtagttattgcgtataactctggtatcaataccacccggaagaaattatttatctgccatccgactcggaccgatg

SEQ ID NO: 3985 - DNA, 203 bp, Homo sapiens
  source 1..203: mol_type = other DNA
ggcgcgccagtcctatagtctgtgtgacctgcaggcattttgtgaaaagggtaaagtatgaaagctactctcagaaaagtacttatgtattgatgagagccttaaaatgactttatattcacaaaactgctggaagacaatgatctggggtatcacattccctcttaggttaagtttcgcactactagcgactcggaccgatg

SEQ ID NO: 3986 - DNA, 203 bp, Homo sapiens
  source 1..203: mol_type = other DNA
ggcgcgccagtcctttaaaatgactttatattcacaaaactgctggaagacaatgatctggggtatcacattccctcttaggttaagtttcgcactactaggaatttttgcgaaaattcttaattccattcttatggtgtagtgtttgttcttttcaattggggcgtatctctctttcgcagagaccccgactcggaccgatg

SEQ ID NO: 3987 - DNA, 203 bp, Homo sapiens
  source 1..203: mol_type = other DNA
ggcgcgccagtcctacgggctgaaggatgccctgaaggtacccataggtaaccttaagcgactatggatctgatcaggggcccaccatgtaacacatgggtagaagtcttcggaccttgggttaaaaaacgtctaggcccgccccccacagggatgtggggtttcccttataaccccaatattgtatacgactcggaccgatg

SEQ ID NO: 3988 - DNA, 203 bp, Homo sapiens
  source 1..203: mol_type = other DNA
ggcgcgccagtcctagaagtcttcggaccttgggttaaaaaacgtctaggcccgccccccacagggatgtggggtttcccttataaccccaatattgtataatggctgcatccaaaatgaatcccgttggcaacctgctctccacagtctcctcaaccgttggatctcttctacaaaacccctctgttcgactcggaccgatg

SEQ ID NO: 3989 - DNA, 203 bp, Homo sapiens
  source 1..203: mol_type = other DNA
ggcgcgccagtcctcacgggttggggcttggccataggccatcggcgcatgcgtggaacctttgtggctcctctgccgatccatactgcggaactcctagcagcttgttttgctcgcagccggtctggagcgaaacttatcggaaccgacaactcagttgtcctctctcggaaatacacctcctttcccgactcggaccgatg

SEQ ID NO: 3990 - DNA, 203 bp, Homo sapiens
  source 1..203: mol_type = other DNA
ggcgcgccagtcctctccacaacattccaccaagctctgctagatcccagagtgaggggcctatattttcctgctggtggctccagttccggaacagtaaaccctgttccgactactgcctcacccatatcgtcaatcttctcgaggactggggaccctgcaccgaacatggagagcacaacatcaggcgactcggaccgatg

SEQ ID NO: 3991 - DNA, 203 bp, Homo sapiens
  source 1..203: mol_type = other DNA
ggcgcgccagtcctagactgggaggagttgggggaggagattaggttaaaggtctttgtactaggaggctgtaggcataaattggtctgttcaccagcaccatgcaactttttcccctctgcctaatcatctcatgttcatgtcctactgttcaagcctccaagctgtgccttgggtggctttggggccgactcggaccgatg

SEQ ID NO: 3992 - DNA, 203 bp, Homo sapiens
  source 1..203: mol_type = other DNA
ggcgcgccagtccttgcccttggacaaaggcattaaaccgtattatcctgaatatgcagttaatcattacttcaaaactaggcattatttacatactctgtggaaggctggcattctatataagagagaaactacacgcagcgcctcattttgtgggtcaccatattcttgggaacaagagctacagccgactcggaccgatg

SEQ ID NO: 3993 - DNA, 203 bp, Homo sapiens
  source 1..203: mol_type = other DNA
ggcgcgccagtcctgcatttggtccagggttcaccccaccacacggaggccttttggggtggagccctcaggctcagggcatattgacaacactgccagcagcacctcctcctgcctccaccaatcggcagtcaggaagacagcctactcccatctctccacctctaagagacagtcatcctcaggcccgactcggaccgatg

SEQ ID NO: 3994 - DNA, 203 bp, Homo sapiens
  source 1..203: mol_type = other DNA
ggcgcgccagtccttccaatttggcctgttctgaactacaccatctactgctgtgaagaatgtcctgaaggcaagctggttacagccctgatcaggagccccgctcgtgactctcgatcgacgcggggtcaaaaactgtctaagcagcagcagaaacgcgggagcgtttctttttccttatttgtttccgactcggaccgatg

SEQ ID NO: 3995 - DNA, 203 bp, Homo sapiens
  source 1..203: mol_type = other DNA
ggcgcgccagtcctcgctcgtgactctcgatcgacgcggggtcaaaaactgtctaagcagcagcagaaacgcgggagcgtttctttttccttatttgtttcatgatggcggcgtctaaggtatacagagtgtgcgagcagactctactagcaggcgctgttcggatgatggacaaattcttgcaaaagcgactcggaccgatg

SEQ ID NO: 3996 - DNA, 203 bp, Homo sapiens
  source 1..203: mol_type = other DNA
ggcgcgccagtcctggttacagccctgatcaggagccccgctcgtgactctcgatcgacgcggggtcaaaaactgtctaagcagcagcagaaacgcgggagcgtttctttttccttatttgtttcatgatggcggcgtctaaggtatacagagtgtgcgagcagactctactagcaggcgctgttcggcgactcggaccgatg

SEQ ID NO: 3997 - DNA, 203 bp, Homo sapiens
  source 1..203: mol_type = other DNA
ggcgcgccagtcctacagaagagcaagtactcctgactgggcaatgggactgcattgcatatccctaggcacctattgagatttctctggggcccaccagcatggagttcctgtatgggaatgcaggactggacttgtgctgcctgacagggtcgcggctggccgtctgtactttgtatagtcagttgcgactcggaccgatg

SEQ ID NO: 3998 - DNA, 203 bp, Homo sapiens
  source 1..203: mol_type = other DNA
ggcgcgccagtcctaggttgggaaacctggactgggtctatactgcctgatagggtcgcggctggccgcctgtaactagtatagtcagttgaaaaccccccatggaatctactactactctttcattttgcaactggatccccaagaaacagagagcccgtgtgtaccttaccaccagtgtcacacaccgactcggaccgatg

SEQ ID NO: 3999 - DNA, 203 bp, Homo sapiens
  source 1..203: mol_type = other DNA
ggcgcgccagtcctaagacaggtggaaatttttacgtagtagactgcagctgtttacctttcctaatgcatttcctgtaaatcagaaaggggatcccttgtatacactaaatgatgcaaactggaaatgcttcttccaaaggttgtgggctcggttagacttacacgagcaggacgaccaggaggacacgactcggaccgatg

SEQ ID NO: 4000 - DNA, 203 bp, Homo sapiens
  source 1..203: mol_type = other DNA
ggcgcgccagtcctatgtacaaagcggtgatgatgatacatggaccaaggtgtctggccatgtggaccatgcaggactatactttacacacgaagggacacgtgtaacctatgttaggtttgcacaggaagcacagacatatgggaacactggcacctgggaggtgcatgtgggaggacagctaatttcgactcggaccgatg

SEQ ID NO: 4001 - DNA, 203 bp, Homo sapiens
  source 1..203: mol_type = other DNA
ggcgcgccagtcctgtgtaacctatgttaggtttgcacaggaagcacagacatatgggaacactggcacctgggaggtgcatgtgggaggacagctaatttatgatgcattcgactcctctgtgtctagcacccaggacaccgaccaagaaccgctatcctctactagacctactgaccccccatacacgactcggaccgatg

SEQ ID NO: 4002 - DNA, 203 bp, Homo sapiens
  source 1..203: mol_type = other DNA
ggcgcgccagtccttatatgtattgtatacacagtgtatgtagacacatgtagtgggtttgtgggtgtcatacatttattgggtgtggggtattcattatagtggtgtggtttggtgttttgtttttggctttttgtatggtttgtatttttcatttttttacattatattgctaaataaattttagtcgactcggaccgatg

SEQ ID NO: 4003 - DNA, 203 bp, Homo sapiens
  source 1..203: mol_type = other DNA
ggcgcgccagtcctgtggtgtggtttggtgttttgtttttggctttttgtatggtttgtatttttcatttttttacattatattgctaaataaattttagtatgcatcgctctaaacgtcgcaagcgtgcctccgctacccaattatatcaaacctgcaaattggcaggtacctgtccctccgatgtgcgactcggaccgatg

SEQ ID NO: 4004 - DNA, 203 bp, Homo sapiens
  source 1..203: mol_type = other DNA
ggcgcgccagtcctttcttgtaaatgggtccacatattatttgttgcccccattaggtttgctacctaaaaaacgtaaacgttttccatatttttttgcagatggcaatgtggaagcctagtgacaacaaggtatacctgcctcctgcccctgtgtccaaggtcctcagcaccgacgcctatgtatcccgactcggaccgatg

SEQ ID NO: 4005 - DNA, 203 bp, Homo sapiens
  source 1..203: mol_type = other DNA
ggcgcgccagtcctacctacacaacctacagaaccagcacagcaagcatatagggtggtaacaagttgttgtaggtgttgctgtacagtaaggctggtggtggagagtggacacgcagaaataagacaactccaggagcttctgttgggcgcactgcatatagtgtgtccgctctgcgcataactgctcgactcggaccgatg

SEQ ID NO: 4006 - DNA, 203 bp, Homo sapiens
  source 1..203: mol_type = other DNA
ggcgcgccagtcctcgatcctccgtaggaagcgttggtgtcttggacattgccgagttgaaaccttggtttccggctggaaaccacgtcgctcttcgtcaaatgacgaaaggcaaaatgaaaaacgcgaataaaaagaaagcaaaaaactctaagaccaatcctggtcgaagtggcagaagtaatggacgactcggaccgatg

SEQ ID NO: 4007 - DNA, 203 bp, Homo sapiens
  source 1..203: mol_type = other DNA
ggcgcgccagtcctagaaaaagaggctgcagaacactttctaaatgtgagtgacgacagtcaaaatgattatgagtaattaaaaaagtgggacaagtcaaaatgtcattccctgaaggaaaagatattcttttcatgggtaatgaagcggcaaaattggcagaagctttccaaaaatcattaagaaaacgactcggaccgatg

SEQ ID NO: 4008 - DNA, 203 bp, Homo sapiens
  source 1..203: mol_type = other DNA
ggcgcgccagtcctggagaaacttttgcccacatactaacaacatcacaaccatctcaagaaaagaaactgggcaaaacagcatccaagagacaaatagcaatggatcctcttaatgaatccactgttaatgtctatctccctgattcgtaccttaaaggagtaatttcttttagtgaaactaatgcacgactcggaccgatg

SEQ ID NO: 4009 - DNA, 203 bp, Homo sapiens
  source 1..203: mol_type = other DNA
ggcgcgccagtcctgtgtcatcattgattgggaagatcaaggaaacaatttgttccaataatatcgtacatcttgactaagtcgaacaaggggaagtcgatatggatcgtgggaccagaagaatctgggtgtcgcaaaatcaaggtgatactgatttagattatcataaaattttgacagctggccttcgactcggaccgatg

SEQ ID NO: 4010 - DNA, 203 bp, Homo sapiens
  source 1..203: mol_type = other DNA
ggcgcgccagtcctaattttaatctccagattaagaaaaagatatacgatgaagattaaggcgacaacgagccgaaacttcatctcttttaaagatctaacattatctgttccaaagtcatacaaggacacattcaaatcagggattgtaagctgctatttcttacctccccaaattacctatacaaccgactcggaccgatg

SEQ ID NO: 4011 - DNA, 203 bp, Homo sapiens
  source 1..203: mol_type = other DNA
ggcgcgccagtcctgaagccacgttggtggtgcttgcagctgagaacaactccagagattgtaggtagaaaggaccaacatttataggtaggggtcagaaagcaacaataaccataaaaggagagcctgacattgctatttaatatcctagaacctgatttctaggttctagctttaaaatccggatgcgactcggaccgatg

SEQ ID NO: 4012 - DNA, 203 bp, Homo sapiens
  source 1..203: mol_type = other DNA
ggcgcgccagtcctgtattaaaaattgatagcgcttgcgtaagagtaagatctcaagatggatcctgtatctgtagtacatagcttcgctaggagtcaaggcctgccacttaactttgaaactgtgggttgtgagggtccaagtcacgacccacgctttgtaattgaatgtaaatttcttgatttccacgactcggaccgatg

SEQ ID NO: 4013 - DNA, 203 bp, Homo sapiens
  source 1..203: mol_type = other DNA
ggcgcgccagtcctgtattaaaattcagcaattgtccaatttaggaaacattctgtttaagagttgacaaggtctcaatgaataatggacaagcaacaattacaagaaatggaggaaggttcgaaatcaggtgtcgtcacttggaccgtgactacaccatgccactaccaaatgctactagtaatgatcgactcggaccgatg

SEQ ID NO: 4014 - DNA, 203 bp, Homo sapiens
  source 1..203: mol_type = other DNA
ggcgcgccagtcctgtatttaaaattcatgtttttgcatcatggcgtgggttacgcaagcgtatagttcgggattgtcacagaacagtatcattagtctaacagggaatgacaggactgttgctgatggcacttttaattccatgattatgccaagagctgtaattgctaatgagcgtgaacattttacgactcggaccgatg

SEQ ID NO: 4015 - DNA, 203 bp, Homo sapiens
  source 1..203: mol_type = other DNA
ggcgcgccagtcctaacaatggctaacttggtgtaatgcacaaagctggagccactatgaaaactgggcaataaactacacatttgatttccctggaataaatgcagatgccctccacccagatctccaaaccacccccattgtcccagacaccagtatcagcagcagtggtggtgaaagctctgaagcgactcggaccgatg

SEQ ID NO: 4016 - DNA, 203 bp, Homo sapiens
  source 1..203: mol_type = other DNA
ggcgcgccagtcctgttgtcatgtaggagcctctaacccattttctgtgttaacttgtaaaaaatgtgcttacctgtctggattacaaagttttgtagattatgagtaaaaccactaacaaatggtgggaaagcagtgacaaatttgcccaggacgtgtataagcagtttgtgcaattttatgaaaaacgactcggaccgatg

SEQ ID NO: 4017 - DNA, 203 bp, Homo sapiens
  source 1..203: mol_type = other DNA
ggcgcgccagtcctcattggacggtagcagatgaagaattgttaaaaaatataaaaaatgaaacagggtttcaagcacaagcagtaaaagattactttactttaaaaggtgcagctgcccctgtggcccattttcaaggaagtttaccggaagtgcccgcgtacaacgcctcagaaaaataccccagccgactcggaccgatg

SEQ ID NO: 4018 - DNA, 203 bp, Homo sapiens
  source 1..203: mol_type = other DNA
ggcgcgccagtcctcacaaagtgggccaattggaggtattaaatccatgggaattactactttagttcaatatgctgtgggaataatgacagttaccatgacctttaaattgggacctcgaaaggctactggaaggtggaatccccagcctggcgtttatcctcctcatgcagctggtcatttaccatcgactcggaccgatg

SEQ ID NO: 4019 - DNA, 203 bp, Homo sapiens
  source 1..203: mol_type = other DNA
ggcgcgccagtcctcgcaccgaggatcctaggcattaaggctatcttatttaattgtctttaattgcctcttgtgtcttctgtgcccctacgggaccctatcccatagcgaactgttgctctagcagaccacatgttctgagggttctgaacatcatacctgcagctaaacatggaggaagacatagccgactcggaccgatg

SEQ ID NO: 4020 - DNA, 203 bp, Homo sapiens
  source 1..203: mol_type = other DNA
ggcgcgccagtcctatcaagatggccgttggcagccccacgaaatctagattagtccgaatgtcctattttgattaggtggtcagataggtcagaaactcacctgctaattttcaagaaacacaaatgacacatgaacaacaacaaattttaactttctcttctgaaggtatgaccccatccactagtcgactcggaccgatg

SEQ ID NO: 4021 - DNA, 203 bp, Homo sapiens
  source 1..203: mol_type = other DNA
ggcgcgccagtccttctctgctctcactgccattctcaagtgttcacactgtccaagctcctttggttgttcgcttccacttgccactgtcaactcttgtcatggacccctcaaacttcaagctcttctccatctcccaccgcactgctaagcgctggtcgtggcgcagattccgtgtggagacacgtcgactcggaccgatg

SEQ ID NO: 4022 - DNA, 203 bp, Homo sapiens
  source 1..203: mol_type = other DNA
ggcgcgccagtcctacaagccctatatttacttgttgcattttactcgtcagaagaaatcacagagtatcatttggatttgttactcacattaaggacaagatgggtatgcaaatgagtaagaacaccgctgggtctcacaccactgtgacccaagccagtggaggctcccacataaattacaccaaccgactcggaccgatg

SEQ ID NO: 4023 - DNA, 203 bp, Homo sapiens
  source 1..203: mol_type = other DNA
ggcgcgccagtcctgagggactgtataagccctcgaaaaaagggatgcttcaagtgtggagatctaggacacataatgagaaattgcccaaagatggtgaattttttagggaataccccctggggcagtggcaaacccaggaacttcccggcgatgccattgaccccaacggcccctccaatgccaggcgactcggaccgatg

SEQ ID NO: 4024 - DNA, 203 bp, Homo sapiens
  source 1..203: mol_type = other DNA
ggcgcgccagtcctatgcatagaacactggcatgacagacatcagagaagcttaagctatgcaaagtatagatacctgctgttgatgaataaagcaatgtttactcacatgcaacaagaatgtccttgtagaagtgggcatccgagaggacctcctcctccagggatggtctaacctctgtgttacagcgactcggaccgatg

SEQ ID NO: 4025 - DNA, 203 bp, Homo sapiens
  source 1..203: mol_type = other DNA
ggcgcgccagtcctatccaaagtataaatatctgcatagtagaattaaagcatttgagtttgtaaataagtttccatttaaggacgatggcagtcccttgtttgaacttactgaccaaagctggaaatctttttttcaaaggctttggaggcaattagatctaagtgaccaagaagacgagggtgaggcgactcggaccgatg

SEQ ID NO: 4026 - DNA, 203 bp, Homo sapiens
  source 1..203: mol_type = other DNA
ggcgcgccagtcctatatatattttgaagatgacgaaggcaactggcaaaagactgagggacatttggactatcatggtgcctattttatggatggattaaataaacaatactatatcagatttgctcaagacgcacgcagatttagtgaaactggagaatgggaagttaagtttaacaacgaaatttcgactcggaccgatg

SEQ ID NO: 4027 - DNA, 203 bp, Homo sapiens
  source 1..203: mol_type = other DNA
ggcgcgccagtcctagagaaattggcagtttgtgcatcaggcattccttttgatagagttagaggagcttggaaggcagtgtgtaggttttgtacagagatatgattgggaaacaggctactataccagatattgtgctggatctgcaagaccttgtccagcccattgacctgcattgtgacgaagaccgactcggaccgatg

SEQ ID NO: 4028 - DNA, 203 bp, Homo sapiens
  source 1..203: mol_type = other DNA
ggcgcgccagtcctcagaaaatcaggaggaggagcctgcacctcaaagaatagactacaagatagtttcctcgtgtggtggctgcggaattaagcttcgaatttttgcatcgtgtacccaatttggaattagaactctgcaagacctacttcttgaagaaatagcgttgctgtgtcctgactgcaaaacgactcggaccgatg

SEQ ID NO: 4029 - DNA, 203 bp, Homo sapiens
  source 1..203: mol_type = other DNA
ggcgcgccagtcctaatttaaatatgttaataatgctgaagacaagtatttcgattattaacctctatatttctatataaagtatctgtgagtctcagtggacatcacagtaaggtcgcagttaacttgtaatcttttcattcctgtgtcggagcagtggtaatggagccggacgatttcgccaaaaccgactcggaccgatg

SEQ ID NO: 4030 - DNA, 203 bp, Homo sapiens
  source 1..203: mol_type = other DNA
ggcgcgccagtcctagcagggttaataatcactcactgagtgacatcaacatcatggcgtcgcaaggcaccaaacgatcctatgaacagatggaaactggtggagaacgccagaatgccactgagatcagggcatctgttggaagaatggttggtggaattgggaggttttacgtacagatgtgcactcgactcggaccgatg

SEQ ID NO: 4031 - DNA, 203 bp, Homo sapiens
  source 1..203: mol_type = other DNA
ggcgcgccagtcctggggaattccaaaagcaggtagatattgaaagatgagtcttctaaccgaggtcgaaacgtacgttctctctatcatcccatcaggccccctcaaagccgagatcgcgcagagacttgaggatgtttttgcagggaagaacacagatcttgaggctctcatggaatggctaaagacgactcggaccgatg

SEQ ID NO: 4032 - DNA, 203 bp, Homo sapiens
  source 1..203: mol_type = other DNA
ggcgcgccagtcctaccacaaagatcaggtaattcgggttgttttgtttgtggacaacctggccatcgggctgcagtgtgccctcaaaaacaacaaaaccctgttaacactcctaatttgtgcccacgatgtaaaaaaggaaagcattgggcacgggattgccgttctaaaacggatgttcaaggtaacgactcggaccgatg

SEQ ID NO: 4033 - DNA, 203 bp, Homo sapiens
  source 1..203: mol_type = other DNA
ggcgcgccagtccttttccttatacaggtgcattccttgtcagtgctggtcgcggcaggtggcgcccaacgtggggctcgacagttttcctcgccactactcttgtaaattggatagagtgagtatatgcgtgagtacgtaaattatattatagtggagtagtaaggtatattgttgagagtataaatcgactcggaccgatg

SEQ ID NO: 4034 - DNA, 203 bp, Homo sapiens
  source 1..203: mol_type = other DNA
ggcgcgccagtcctgccccatctcccagttaatctatggggacgcgatatcttaagtaaaatgggtgtctatttatataatccttcacccaccgtaacagatttaatgttagatcaagggttactttcaaatcagggcttaggtaaacagcatcaaggtatcgtcttgccccttgatttaaaacctaacgactcggaccgatg

SEQ ID NO: 4035 - DNA, 203 bp, Homo sapiens
  source 1..203: mol_type = other DNA
ggcgcgccagtccttttaatgttagatcaagggttactttcaaatcagggcttaggtaaacagcatcaaggtatcgtcttgccccttgatttaaaacctaatcaagaacgaagaggtttggggtgttttccctagggacctctgattctcctgtgacacatgccgaccccattgattggaaatctgggcgactcggaccgatg

SEQ ID NO: 4036 - DNA, 203 bp, Homo sapiens
  source 1..203: mol_type = other DNA
ggcgcgccagtcctcatgtaaaaaaccacttgtacgatggaaggatccacttaccaatctgtggtatggaccagaccctgtattgatatggggacgagggcatgtttgtgtttttccacaggatgccgaagcaccgcgttggataccggaaaggctggtacgcgcggcagaggaattccctgacacatcgactcggaccgatg

SEQ ID NO: 4037 - DNA, 203 bp, Homo sapiens
  source 1..203: mol_type = other DNA
ggcgcgccagtcctgcggcagggttggtggaaggaattgcccgcatcagccagtcgtgaacgtgttgagaaaaagacagcttaggagaacaagagctggggatggccgggaaggccattctgaaaggaaaggggggcggtccccctcgacgagtgtcgaaagagaccgctaagaagacgcgtcaacgccgactcggaccgatg

SEQ ID NO: 4038 - DNA, 203 bp, Homo sapiens
  source 1..203: mol_type = other DNA
ggcgcgccagtcctcgcacatgtgatcctaggcgattcttgatcgcgcttattagctaaccaatttaatttggtgttgaagtgttgacacgctctctaacacatggggcagcttatcagcttctttcaggagattcctgtttttctacaggaagctctgaacatcgctttagtggctgttagtctcatcgactcggaccgatg

SEQ ID NO: 4039 - DNA, 203 bp, Homo sapiens
  source 1..203: mol_type = other DNA
ggcgcgccagtcctgcacatgtgatcctaggcgattcttgatcgcgcttattagctaaccaatttaatttggtgttgaagtgttgacacgctctctaacacatggggcagcttatcagcttctttcaggagattcctgtttttctacaggaagctctgaacatcgctttagtggctgttagtctcatacgactcggaccgatg

SEQ ID NO: 4040 - DNA, 203 bp, Homo sapiens
  source 1..203: mol_type = other DNA
ggcgcgccagtcctgcgcacagtggatcctaggcgtaactagatcaagttttgctgagtaaaattttaaacacattgagtatccgtgcaagacagcgcagagctccccacaatgggcaactgcaataagcctcccaagaggcctcccaacacacaaacatcatccaaccaaccctcagcagagttcagcgactcggaccgatg

SEQ ID NO: 4041 - DNA, 203 bp, Homo sapiens
  source 1..203: mol_type = other DNA
ggcgcgccagtcctcgcacagtggatcctaggcggcacttgagcatggaggaatcagtaaatgaaataaaaagccttattagaaagcattttccagaaagacaggagctagcataccaaagggacatctttttatctcaacatcaccccagctctctgttgttggaagggttcaaacttctgtcaagtcgactcggaccgatg

SEQ ID NO: 4042 - DNA, 203 bp, Homo sapiens
  source 1..203: mol_type = other DNA
ggcgcgccagtccttctacgtttctgctacacagtttggaattcgttctttagaagacttgctgctagaagaaccttctttgctgtgtcctgcttgcagaaatggcagataatagaggtattgatcctaaagaagggtgtagtaattggttttctcttgaagcagactgtagtgatttagatgatgatcgactcggaccgatg

SEQ ID NO: 4043 - DNA, 203 bp, Homo sapiens
  source 1..203: mol_type = other DNA
ggcgcgccagtccttagaggttatttttgatgcagatcctgaaaatattatgttatacacatcctggcagttcatttactttgaagacactgatggacattggcaaaaaactgaagggcgtattgattatgctggtttatattatttggaagggcaattaagacattattacgtggaatttaaagtagcgactcggaccgatg

SEQ ID NO: 4044 - DNA, 203 bp, Homo sapiens
  source 1..203: mol_type = other DNA
ggcgcgccagtccttggatattacatatcatatccagaaacaaggaatattccagaagttatatacactgagccagacacgactccaacaataataattcatacagaggatttcagtggtgattattatttacatccaagtttgagacgaagaaaaagaaaacgagcctatttgtaatttttttgcagcgactcggaccgatg

SEQ ID NO: 4045 - DNA, 203 bp, Homo sapiens
  source 1..203: mol_type = other DNA
ggcgcgccagtccttgcgattgtaattattgtagttttgttgttatattttatggtggataatgttactaggctgcatgatgcttagaccataatctaaacatgtttttgatacttttaatttccttaccaacggcttttgctgttataggagatttaaagtgtacttcagatactagttatattaatcgactcggaccgatg

SEQ ID NO: 4046 - DNA, 203 bp, Homo sapiens
  source 1..203: mol_type = other DNA
ggcgcgccagtccttaatagaggtaggcagttttatgagttttacaatgatgtaaaaccaccagtccttgatgtggatgacgtttaggtaatccaaacattatgagtagtaaaactacaccagcaccagtttatatctggactgctgatgaagctattaaattcctaaaggaatggaatttttctttgcgactcggaccgatg

SEQ ID NO: 4047 - DNA, 203 bp, Homo sapiens
  source 1..203: mol_type = other DNA
ggcgcgccagtcctgctaaggttacacacctgtgcacatataagcgtggttttcttgacaggataagcgatactagtggttttgctgtttatgttaagtccaaagtcggtaattaccgactgccatcaacccaaaagggttctggcatggacaccgcattgttgagaaataatatctaaattttaaggcgactcggaccgatg

SEQ ID NO: 4048 - DNA, 203 bp, Homo sapiens
  source 1..203: mol_type = other DNA
ggcgcgccagtcctggttttgagtttgattaagagtggtaggttgttgttacgcaataatggtcgttttggtggttttagtaatcatttagtctcaactaaatgaaacttttcttgattttgcttgttttgcccctggcctcttgctttttcacatgtaatagtaatgctaatctctctatgttacaacgactcggaccgatg

SEQ ID NO: 4049 - DNA, 203 bp, Homo sapiens
  source 1..203: mol_type = other DNA
ggcgcgccagtcctgtgtaattgaaatttcgtcaagtttgtaaactggttaggcaagtgttgtattttctgtgtctaagcactggtgattctgttcactagtgcatacattgatatttaagtggtgttccgtcactgcttattgtggaagcaacgttctgtcgttgtggaaaccaataactgctaacccgactcggaccgatg

SEQ ID NO: 4050 - DNA, 203 bp, Homo sapiens
  source 1..203: mol_type = other DNA
ggcgcgccagtcctgcgaacggagactacatgcaacaagtggtgaccccgacgtgatctgtctgctgagggtagctgcccggcatgcccgtgacgtggagaagagcctgtgaggtggcggcaggtcgcgcacggaagacgtattgcggttaagagcctgcgaggtggcggcaggtcgcatacgtaacacgactcggaccgatg

SEQ ID NO: 4051 - DNA, 203 bp, Homo sapiens
  source 1..203: mol_type = other DNA
ggcgcgccagtcctgtccgagcacttttgcgtctgtaggcagaaataaacacgtcgcgagacctggtgtttgaccagcagggggaagacgcagtggtccgtcggtgtctgcgagagtacgttggcgactatatgagcagaatcatactctgttgcgaacagaacgagcgtcatcgtcgcgccggcacgcgactcggaccgatg

SEQ ID NO: 4052 - DNA, 203 bp, Homo sapiens
  source 1..203: mol_type = other DNA
ggcgcgccagtcctctgaaaacgggagcgcggcagccgcgacagtaccagttgagagtcgattcggtcggttaacatcgtaagcatcgtggcggtggtgtgatggagtggaacacactagtattaggtcttttggttttatcggtagtggcaagttccaacaatacgtcgactgctagcacaccgcgtcgactcggaccgatg

SEQ ID NO: 4053 - DNA, 203 bp, Homo sapiens
  source 1..203: mol_type = other DNA
ggcgcgccagtccttatcgggccctgtatacaagctcggtacacagccaaggtgcgggagactaggtcgtcttggaagccgatgcaacaacggtagatgagcagcaaaacgaccagaatcagcagtgagtacacgcaggcaaaccaaaccacaaggcagacggacggtgcggggtctcctcctctgtacgactcggaccgatg

SEQ ID NO: 4054 - DNA, 203 bp, Homo sapiens
  source 1..203: mol_type = other DNA
ggcgcgccagtcctcagcaaaacgaccagaatcagcagtgagtacacgcaggcaaaccaaaccacaaggcagacggacggtgcggggtctcctcctctgtaatggggaaaaaagagatgataatggtgaaaggcattcctaaaattatgctcctgatctctataacgttcttgctcctttccctcatacgactcggaccgatg

SEQ ID NO: 4055 - DNA, 203 bp, Homo sapiens
  source 1..203: mol_type = other DNA
ggcgcgccagtcctttcctgggatcctttctctccttctctcgggtgtaacgccaaccaccacctggatcacgccgctgaacccagcggcgcggccgcgctatgcggccaggcctcccctcctacctcatcatcctcgccgtctgtctcttcagccacctactttcgtcacgatatggcgcagaagcccgactcggaccgatg

SEQ ID NO: 4056 - DNA, 203 bp, Homo sapiens
  source 1..203: mol_type = other DNA
ggcgcgccagtccttggactttgattttctgcgtctgccgcgcggtggcggtcaagtctggagcgtagtgcctagtttggttttttttcagcaaaaggccgatcgcccatctttttaccgggcttttcgctcgggccgtttcgacttgtgtaccgattctgttctggactatctgggacggcgtcaggcgactcggaccgatg

SEQ ID NO: 4057 - DNA, 203 bp, Homo sapiens
  source 1..203: mol_type = other DNA
ggcgcgccagtcctatcgcccatctttttaccgggcttttcgctcgggccgtttcgacttgtgtaccgattctgttctggactatctgggacggcgtcaggatgagtctgttgcacaccttttggcggctacccgtcgccgtcttcttcgagccgcacgaggaaaacgtgctgcgctgccccgagcgccgactcggaccgatg

SEQ ID NO: 4058 - DNA, 203 bp, Homo sapiens
  source 1..203: mol_type = other DNA
ggcgcgccagtcctttccaccacgtgtcgctcgctgcataaagggcgaacgtcctcggagagggtatattcgttcggcgagagcgggcggcggtggtgggtatgtccccttctgtggaggagactacctcagtcaccgagtccatcatgttcgctatcgtgagtttcaaacacatgggcccgttcgaacgactcggaccgatg

SEQ ID NO: 4059 - DNA, 203 bp, Homo sapiens
  source 1..203: mol_type = other DNA
ggcgcgccagtcctcgcagtcaggccgccacgccggcggctggggcgcgcgttccctcttcgtccccgtcgcctccagtcgaaccgccatctcctgtacagccgcctgcgcttccagcgtcgccgtccgttcttcccgcggaatcaccgccgtcgctttctccctcggagccggcagaggcggcgtcccgactcggaccgatg

SEQ ID NO: 4060 - DNA, 203 bp, Homo sapiens
  source 1..203: mol_type = other DNA
ggcgcgccagtcctacgcgcttaggacgactctataaaaacccacgtccactcagacacgcaacttttggccgccacacctgtcaccgctgctatatttgcgacagttgccggaacccttcccgacctcccacgaagacccgttcacctttgcgcatcccctgaccctccccccatcccgccttcgcacgactcggaccgatg

SEQ ID NO: 4061 - DNA, 203 bp, Homo sapiens
  source 1..203: mol_type = other DNA
ggcgcgccagtcctgacagttgccggaacccttcccgacctcccacgaagacccgttcacctttgcgcatcccctgaccctccccccatcccgccttcgcaatgtctcaggcatcgtcctcgcccggtgagggaccctcgtcggaagcggccgcgatcagcgaggccgaagccgccagcggaagctttcgactcggaccgatg

SEQ ID NO: 4062 - DNA, 203 bp, Homo sapiens
  source 1..203: mol_type = other DNA
ggcgcgccagtcctacggtggggctttgcctctttttttttgtaataaaaaaagacactcaataatccgcggttgtctctgtgtataacgtttttatttcgggttccgcgtttggtcgcctgcctatgtaaggcggcggccgcagagcgcgcgccgctcagtcgcctacacccgtacgcgcaggcagccgactcggaccgatg

SEQ ID NO: 4063 - DNA, 203 bp, Homo sapiens
  source 1..203: mol_type = other DNA
ggcgcgccagtcctatttaactcgtgaggccgtccggtgaggaggacggcgacgaccgcaggttagcggcgagtcacctagacgcaaacgcgggcccggacgcgccacgctcgctctgacgccgcgcccggtgcagacgttgttcgtctccgcttctcctccgtcgcggccaggatttcaccgccgctcgactcggaccgatg

SEQ ID NO: 4064 - DNA, 203 bp, Homo sapiens
  source 1..203: mol_type = other DNA
ggcgcgccagtcctgcgccacgctcgctctgacgccgcgcccggtgcagacgttgttcgtctccgcttctcctccgtcgcggccaggatttcaccgccgctatggcggccatggaggccaacatcttctgcactttcgaccacaagctcagcatcgccgacgtaggcaaactgaccaaactagtagcgcgactcggaccgatg

SEQ ID NO: 4065 - DNA, 203 bp, Homo sapiens
  source 1..203: mol_type = other DNA
ggcgcgccagtcctcgaggcggcgcggcgcagcgccggccattctccgggtcgcgctgctttccccgagctccgacgcctcgcgctcacgccgccgccgcgatggagaactggtcggcgctcgagctcctgcctaaagtaggcattcccactgactttctgacgcacgtcaagaccagcgccggcgagcgactcggaccgatg

SEQ ID NO: 4066 - DNA, 203 bp, Homo sapiens
  source 1..203: mol_type = other DNA
ggcgcgccagtcctgatccaccagacgttgtttcgattgtgctcggcggccgcagccacatcgggcctgtgttcatcccctcccccattgtgtgtgtcctcatcttcctccgtcccttctgtcccaacctccgtcagcgttgacggcagttctgaacccacgtcgccgcgagtgcggtttgcatcacgcgactcggaccgatg

SEQ ID NO: 4067 - DNA, 203 bp, Homo sapiens
  source 1..203: mol_type = other DNA
ggcgcgccagtcctatcttcctccgtcccttctgtcccaacctccgtcagcgttgacggcagttctgaacccacgtcgccgcgagtgcggtttgcatcacgatgatggaagccgcggccgctgccgccgcggcgtttcgtccggaggagcgtccgacgccgggttggcacgacgcggcgttgttaatgcgactcggaccgatg

SEQ ID NO: 4068 - DNA, 203 bp, Homo sapiens
  source 1..203: mol_type = other DNA
ggcgcgccagtcctgacgacaccactagggacgacgaagacgaacgagtgacggcgcccgtcccacaagccacgtccgcgacaacgtggttttcaggtggatcctccgtcgtcctcgcggacgccatctttttcctctcctctcgccgctgccgcctaacctccgctcgcaccaccgccgccgccatccgactcggaccgatg

SEQ ID NO: 4069 - DNA, 203 bp, Homo sapiens
  source 1..203: mol_type = other DNA
ggcgcgccagtcctccgcttggaactggtcgcgtccgtgttcgagcacctgacggtggagtgcgtcaacgacatcctggacgcctgcagccacccggacgtgaacgtcgtggagacaagcaacacctgtcgtccctgcccttctcctgttccctccgcccccaaaactgtcagcgacgctcagacgtccgactcggaccgatg

SEQ ID NO: 4070 - DNA, 203 bp, Homo sapiens
  source 1..203: mol_type = other DNA
ggcgcgccagtcctatagcacgttcctttttttttgtttttgcatcacttatcgccactatcagtgcaatattttgattgtgagactgaaagagtatcgttatgatgcttagaacgtggatatcattaccgatggtactgcttgacgcgtactgtttttgtatttttgtgagttgttcaatcagcacgcgactcggaccgatg

SEQ ID NO: 4071 - DNA, 203 bp, Homo sapiens
  source 1..203: mol_type = other DNA
ggcgcgccagtcctgcctcgttgcacgagtgggccagcccgagttcggggtgcatcatctggtagcgcttgcggcacagcgccgccacattggtgaaggccgtggagatgcaggaggtggggtggctcttgcgcttctgcagctccgcgtagcgctcctggatcttggcggccgaatctccgcgcaaccgactcggaccgatg

SEQ ID NO: 4072 - DNA, 203 bp, Homo sapiens
  source 1..203: mol_type = other DNA
ggcgcgccagtccttataacgcctttcggcgcaccaccagcataatctgcgaggaggaccttgacggtgactgccgtcaactgttccccgagtaacctggacgcggaacgtgacggttgccgaggggaaaggcgacagagaaggtacaaacccaccggcggggaaaatactgaggcgccgccatcatccgactcggaccgatg

SEQ ID NO: 4073 - DNA, 203 bp, Homo sapiens
  source 1..203: mol_type = other DNA
ggcgcgccagtcctaagcgaactgggctgcgagttgctggccggcggtcgcgttttccactgcgaccacatcccgctcctgctcatcgtcacgcccgtggtctttgaccctcagtttacgcgccatgccgtctctaccgtgttagaccgttggagtcgcgacctgtcccgcaagacgaacctaccgatcgactcggaccgatg

SEQ ID NO: 4074 - DNA, 203 bp, Homo sapiens
  source 1..203: mol_type = other DNA
ggcgcgccagtcctctttgaccctcagtttacgcgccatgccgtctctaccgtgttagaccgttggagtcgcgacctgtcccgcaagacgaacctaccgatatgggtgccgaactctgcaaacgaatatgttgtgagttcggtaccacgtccggtgagcccctgaaagatgctctgggtcgccaggtgcgactcggaccgatg

SEQ ID NO: 4075 - DNA, 203 bp, Homo sapiens
  source 1..203: mol_type = other DNA
ggcgcgccagtccttcccatcgtagtatttaacgacccgcgagcctgtcgtcatccgcgcgcccccatcgcctcccgagcgagcgggccgccgctatcgccatggccccctcgcacgtggataaggtgaatacacggacatggagcgcttctatcgttttcatggtgctgacttttgtcaacgtcagccgactcggaccgatg

SEQ ID NO: 4076 - DNA, 203 bp, Homo sapiens
  source 1..203: mol_type = other DNA
ggcgcgccagtcctgatagcggcggcccgctcgctcgggaggcgatgggcgcgcgccgatgacgacaggctcgcgggtcgttaaatactacgatgggagccgccgcggctcacgacgcggtttgagcacgtccgggcggtcggtgaaaaaagaccccgcgggccttcgcgactctcttctgtccgaggcgactcggaccgatg

SEQ ID NO: 4077 - DNA, 203 bp, Homo sapiens
  source 1..203: mol_type = other DNA
ggcgcgccagtccttagaccgtctccgggacatcgcccgtcctctgaaataccgctatcaacgtcttgtcgctaccgtgtagctagttagccagctgtgtgtagttgtattttgcttttgcatatttgttttcagtcagagagtctgaaacggggtgggagggacttttgcgggtagtgcatgctaagcgactcggaccgatg

SEQ ID NO: 4078 - DNA, 203 bp, Homo sapiens
  source 1..203: mol_type = other DNA
ggcgcgccagtccttagttgtattttgcttttgcatatttgttttcagtcagagagtctgaaacggggtgggagggacttttgcgggtagtgcatgctaagatgaacggatgggctggggtgtgcttgataactcactgtttgaatacgcgctcacgcacatatgtagcactcaacatgttagcttttcgactcggaccgatg

SEQ ID NO: 4079 - DNA, 203 bp, Homo sapiens
  source 1..203: mol_type = other DNA
ggcgcgccagtcctcaggaacgcttgaaaggtccgcgccgcgccgcttgatcacggcagacgaggagcggcgcggcccagagcgtgtcggccgatttcgaaatggaggccctgatgatccgcggcgtgctggaggtccatacggatttcactagacagaatgtgatgatcatggagccgcaagtgctccgactcggaccgatg

SEQ ID NO: 4080 - DNA, 203 bp, Homo sapiens
  source 1..203: mol_type = other DNA
ggcgcgccagtcctagcgcgcggaagggaaagaagggccaacggtcgacgcagggcacgcgcgtgccgccggcctcggacgaagcggcagcggcggcagaagaggagacggaggagtgaacggtcgccgttgccgcggcggtagttgcggcagaggggttgttatctgtcgttcgttcaacgcgactgcgactcggaccgatg

SEQ ID NO: 4081 - DNA, 203 bp, Homo sapiens
  source 1..203: mol_type = other DNA
ggcgcgccagtccttcggccacgcgccgcaccgtgatggtgtcaaagagcgtcttgcacactccgtagagcagctgcttgcgcagcacgcacgggtcgcgcagcacctggtgcatgctctggccgcgacacgtccccagaaagccgtgcagcaaccgcaggaagctcatcgtctggcccgtggggaaacgactcggaccgatg

SEQ ID NO: 4082 - DNA, 203 bp, Homo sapiens
  source 1..203: mol_type = other DNA
ggcgcgccagtcctaaaaaattgacaaaaacatcataacataaaggaccacctacctgggacgcgcagttgggcggcggattggggcggcatgctgcggcgatgctgtcggtgatggtctcttcctctctggtcctgatcgtcttttttctaggcgcttccgaggaggcgaagccggcaacgacgacgcgactcggaccgatg

SEQ ID NO: 4083 - DNA, 203 bp, Homo sapiens
  source 1..203: mol_type = other DNA
ggcgcgccagtcctaacgtactgtttaaccacgttgcgtcgtgacgttgtttgtgggtgttgctaggcgggctggaaagatgatgtataaatagagtctgcgacggggttcggcgctctgccggctgcggcggcactcgctccacggcctccgacgagcgttgcgctcgcgctttgcgccgccgcgtccgactcggaccgatg

SEQ ID NO: 4084 - DNA, 203 bp, Homo sapiens
  source 1..203: mol_type = other DNA
ggcgcgccagtcctcgctgctacgccacctagataaatactacgccggactgccgcccgagctgaagcagacgcgcgtcaacctgccggctcactcgcgctatggccctcaagcagtggatgctcgctaacattgctgataataaaggctctctgttaacccccgacgagcaggctcgcgtgttttgtcgactcggaccgatg

SEQ ID NO: 4085 - DNA, 203 bp, Homo sapiens
  source 1..203: mol_type = other DNA
ggcgcgccagtccttaacgttttagggatcgaagacctgagtgccaacttttggcgccaactggctccttaccgtcacactctcatcgtgccgcagacttgatgtgccgccgcccggattgcggcttctctttctcacctggaccggtgatactgctgtggtgttgccttctgctgcccattgtttcccgactcggaccgatg

SEQ ID NO: 4086 - DNA, 203 bp, Homo sapiens
  source 1..203: mol_type = other DNA
ggcgcgccagtcctggtctcgggcgccaccaagaaagacctgttcgacgccgtaaccctgtgcgcttccatcgtagaaaagcagccagacgtatttaatatcaacgtcagcttgttgacgtacccttcgatcgcggcgccccacttgccgctgtacaacgaattcaccagctttcgcctgcccacctccgactcggaccgatg

SEQ ID NO: 4087 - DNA, 203 bp, Homo sapiens
  source 1..203: mol_type = other DNA
ggcgcgccagtcctcaacgtcagcttgttgacgtacccttcgatcgcggcgccccacttgccgctgtacaacgaattcaccagctttcgcctgcccacctcatgaagcggcggcggcgatggcggggctggttgcttttcctggccctgtgcttttgcttactgtgtgaagcggtggaaaccaacgcgcgactcggaccgatg

SEQ ID NO: 4088 - DNA, 203 bp, Homo sapiens
  source 1..203: mol_type = other DNA
ggcgcgccagtccttgtgttgtttttatttcgctgacttctacggggtttcccctcagcctctgtgttcccaacccgtccccccgctgagcgttggcggcgatggtcatgttctcccaggaccacgtccagatcgtctacggctccacacgcatctgcaagtccctggccccggccaacaagagaaagcgactcggaccgatg

SEQ ID NO: 4089 - DNA, 203 bp, Homo sapiens
  source 1..203: mol_type = other DNA
ggcgcgccagtccttggagctggacgtttaggcgtcacaagaggtgacgcgacctcctgccacatatagctcgtccacacgccgtctcgtcacacggcaacatgtgttccgtgctggcgatcgcgctcgtagttgcgctcttgggcgacatgcacccgggagtgaaaagtagcaccacaagcgccgtccgactcggaccgatg

SEQ ID NO: 4090 - DNA, 203 bp, Homo sapiens
  source 1..203: mol_type = other DNA
ggcgcgccagtcctgtgatttcccgtgacagtattaacgtgtggtgagaatgctgtttaataaaagtagcttttttatacatctccgtctctggtctcctgatgtgggggtgcgggtggtcccggatacttgtccttctcctcctcatgtgtatggccctgatggcgagaggcacatacggggcttaccgactcggaccgatg

SEQ ID NO: 4091 - DNA, 203 bp, Homo sapiens
  source 1..203: mol_type = other DNA
ggcgcgccagtcctaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactagcctgcgtcacgggaaataatcgactcggaccgatg

SEQ ID NO: 4092 - DNA, 203 bp, Homo sapiens
  source 1..203: mol_type = other DNA
ggcgcgccagtcctgattcatcgtgcagtacctcaacacattgctgattacaatgatggcggcgatatgggctcgcgttttgataacctacctggtgtcgcggcgtcggtagaggcttgcggaaaccacgtcctcgtcacacgtcgttcgcggacatagcaagaaatccacgtcgccacgtctcgagacgactcggaccgatg

SEQ ID NO: 4093 - DNA, 203 bp, Homo sapiens
  source 1..203: mol_type = other DNA
ggcgcgccagtcctggcgtcggtagaggcttgcggaaaccacgtcctcgtcacacgtcgttcgcggacatagcaagaaatccacgtcgccacgtctcgagaatgccggccccgcggggtccccttcgcgcaacattcctggccctggtcgcgttcgggttgctgcttcagatagacctcagcgacgttcgactcggaccgatg

SEQ ID NO: 4094 - DNA, 203 bp, Homo sapiens
  source 1..203: mol_type = other DNA
ggcgcgccagtcctcgtcacttgtgtgatctgagacgtcatgctggtagcgtttatgagtcgggcggtggccggcacgccgcatttcctaacccgcgcagcatgttgcgcttgctgttcacgctcgtactgctggccctctagggaccgtctgtcgacgctagccgcgactatgtgcatgttcgactacgactcggaccgatg

SEQ ID NO: 4095 - DNA, 203 bp, Homo sapiens
  source 1..203: mol_type = other DNA
ggcgcgccagtccttcacatcaaccggctattttttcggttagtcttagacgaggaacaacgcatttacgacgtagtgtctacaaatattgagttcggtgcctggccagtccctacggcctacaaagcctttctctggaaatacgccaagaaactgaattaccactactttagactgcgctggtgatccgactcggaccgatg

SEQ ID NO: 4096 - DNA, 203 bp, Homo sapiens
  source 1..203: mol_type = other DNA
ggcgcgccagtccttcaaaatggctagacaaacgcaacgataacaggtggtataatgttaatgtaacaagacaaccggaacgagggccgggaaaaataactgtaaccctagtaggtctgaaggaataatatttagtatatattttaaacagacaagtttgttagagcagaaaatatcatgttttcaatcgactcggaccgatg

SEQ ID NO: 4097 - DNA, 203 bp, Homo sapiens
  source 1..203: mol_type = other DNA
ggcgcgccagtccttactttttgccgacgtcaggaaaaataagctgtcgcctacataagagcccggtgctatcgtgctgtcactctttcttgttgccttcgatgtacggcgtcctggctcattactactccttcatcagtagtcccagcgttatggttaattttaagcatcataacgctgtgcagctgcgactcggaccgatg

SEQ ID NO: 4098 - DNA, 203 bp, Homo sapiens
  source 1..203: mol_type = other DNA
ggcgcgccagtcctggctgactatcctgttctgtcctggaaaaactttcagcgtcgtaggtggactttgtagtatgcgggttagtgaagttatgtcatttatttacgtttacgatctcgtattacaaaccgcggagaggatgacaccgttcggccccatgagttatttttattcttccggtaggaggccgactcggaccgatg

SEQ ID NO: 4099 - DNA, 203 bp, Homo sapiens
  source 1..203: mol_type = other DNA
ggcgcgccagtccttttacgtttacgatctcgtattacaaaccgcggagaggatgacaccgttcggccccatgagttatttttattcttccggtaggaggcatgaagcctctggtgatgctcatctgcttcggtgtgatattattgcagcttggggtgactaaagtgtgtcagcataatgaagtgcaacgactcggaccgatg

SEQ ID NO: 4100 - DNA, 203 bp, Homo sapiens
  source 1..203: mol_type = other DNA
ggcgcgccagtcctagaggcagcaaaaaagacctgtaaaaaaaccggacgctcagttgcgggcatcccgggcgagaagctgcgtcgcacggtggtcaccaccacgccggcccgacgtttgagcggccgacacacggagcaggaacaggcgggcagcgtctctgcgaaaaagggaagaaaagaatcatccgactcggaccgatg

SEQ ID NO: 4101 - DNA, 203 bp, Homo sapiens
  source 1..203: mol_type = other DNA
ggcgcgccagtcctcacgccggcccgacgtttgagcggccgacacacggagcaggaacaggcgggcagcgtctctgcgaaaaagggaagaaaagaatcatcatgtgccgccgggagtcgctccgaactctgccgtggctgttctgggtgctgttgagctgcccgcgactcctcgaatattcttcctctcgactcggaccgatg

SEQ ID NO: 4102 - DNA, 203 bp, Homo sapiens
  source 1..203: mol_type = other DNA
ggcgcgccagtcctcggatatgttcggtttcaaactcactgtttgaatatagggacagtccctacggaacctgagaacatgtggaaatcacctgtggtagaatgctgttcaggtacattacctttcatcgcgaaaaggtactttacctaacggctgcatgcatctttggtgtctacatcagcctccaccgactcggaccgatg

SEQ ID NO: 4103 - DNA, 203 bp, Homo sapiens
  source 1..203: mol_type = other DNA
ggcgcgccagtcctcctcgatggtcggacatcgaggaactcttggaaaaggcggtgcagagcgtcatgaaggacgccgagtcaatgcagatgacctgagaccgaaacagcgagcgcgtccgttgtacagttgtatagcagcacacgccttccctctttttcaccgcagctaagagagagaaagagagtcgactcggaccgatg

SEQ ID NO: 4104 - DNA, 203 bp, Homo sapiens
  source 1..203: mol_type = other DNA
ggcgcgccagtcctcgaaacagcgagcgcgtccgttgtacagttgtatagcagcacacgccttccctctttttcaccgcagctaagagagagaaagagagtatgtcagtcaagggcgtggagatgccagaaatgacgtgggacttggacgttggaaataaatggcggcgtcgaaaggtcctgagtcgccgactcggaccgatg

SEQ ID NO: 4105 - DNA, 203 bp, Homo sapiens
  source 1..203: mol_type = other DNA
ggcgcgccagtcctcgcccccggtgtgataaggaattttccgacttggctcacatctccttcctcagtgtttggacaataaacacattccttgccaaaaaatgacgtttccagaaatccaaggcataaatgtccgtacaccggcccttcccgacacggagtttgagattccaagcaggagagaagatccgactcggaccgatg

SEQ ID NO: 4106 - DNA, 203 bp, Homo sapiens
  source 1..203: mol_type = other DNA
ggcgcgccagtcctgacggttcgtccacggagcaggagatctaccacacgcgactttaagtcacggaggaagttacgtgggtaggagggcaccgtgccccgaggcggcgacgggctagcgtataacaagccgcgcgacaacgggcgagcggcggtgagacacacgcgcgcacgtcggcggcgatagcccgactcggaccgatg

SEQ ID NO: 4107 - DNA, 203 bp, Homo sapiens
  source 1..203: mol_type = other DNA
ggcgcgccagtcctccagcagcgcgcacgacgcgatcacggtaacccccatgactagacccacgcagatagccagccccgctagcgtatccagcgccatcccgttcgctcccgtcgtcgtctcctgaacaaagcaacaactccgcagtccccgttttcaaccgtttttgtttccttctccgcgagcaacgactcggaccgatg

SEQ ID NO: 4108 - DNA, 203 bp, Homo sapiens
  source 1..203: mol_type = other DNA
ggcgcgccagtcctggggacgggggactcttgcggcggggacggggacgggggcctttcgcggcggacacggggaacacagacggcacgcacacgcagctcgcctcagcggtcgccctatcacaaccgccgctactctttattaacgtcttcatccccccgcttctacacgcaacgctgcatacagctcgactcggaccgatg

SEQ ID NO: 4109 - DNA, 203 bp, Homo sapiens
  source 1..203: mol_type = other DNA
ggcgcgccagtcctgcctcagcggtcgccctatcacaaccgccgctactctttattaacgtcttcatccccccgcttctacacgcaacgctgcatacagctatgctcacactctatctcttcacagcgacatgttgcttcgtctgtgcactgccgcgacaagcacaagtggacaccgccatctgccaccgactcggaccgatg

SEQ ID NO: 4110 - DNA, 203 bp, Homo sapiens
  source 1..203: mol_type = other DNA
ggcgcgccagtcctcgcgtgttattgtaggttcgttgccagatggcaagtgctgtcaacagcagacgttgtgggcggtcggtgtatttttgtgggttgcggtgagagtcggcactcggtgttttgtgagtgatctcaacagtttgtgttgcttttagcagcgtccaaaacagcgacgcgactttggggcgactcggaccgatg

SEQ ID NO: 4111 - DNA, 203 bp, Homo sapiens
  source 1..203: mol_type = other DNA
ggcgcgccagtccttgagagtcggcactcggtgttttgtgagtgatctcaacagtttgtgttgcttttagcagcgtccaaaacagcgacgcgactttggggatggcctcgtgctcaccgccgcggagagtgtcgccggacctgctcgtcagcagcgagctacgcagacggaatatctggaggagagttcgactcggaccgatg

SEQ ID NO: 4112 - DNA, 203 bp, Homo sapiens
  source 1..203: mol_type = other DNA
ggcgcgccagtcctcgacggagccgtccgcgtgtgtaaacggcgtggtcgctgacgcgggtttgcttcctatatagtggacgtcggaggtgtccggcggccatggcccagcgcaacggcatgtcgccgcgccccccgcccctcggtcgcggccgcggggccggagggccttcgggggttggttcctctcgactcggaccgatg

SEQ ID NO: 4113 - DNA, 203 bp, Homo sapiens
  source 1..203: mol_type = other DNA
ggcgcgccagtcctaccgaaaggatccaagggggctttccaaagccgacgtccctgattcccttcataaagctgttgaccggccctagaaagaccaagagcatgctgtgggcccactgcggtcgcttcttgcgttatcatctgctcccgctgctactgtgtagactgccattcttactcttttttcagcgactcggaccgatg

SEQ ID NO: 4114 - DNA, 203 bp, Homo sapiens
  source 1..203: mol_type = other DNA
ggcgcgccagtcctgttgagcggggtatgcgtgttcagttgggcggcaggggcatgcggccttagcggctcgggctggcgtgctgttttccgtgttgccgacggcggcggggtccgtcgagaccgggggaccgcggagcggaggaggtgacctggctgcttaatgacagcgacggagaggaagaagagcgactcggaccgatg

SEQ ID NO: 4115 - DNA, 203 bp, Homo sapiens
  source 1..203: mol_type = other DNA
ggcgcgccagtcctcggcggcggggtccgtcgagaccgggggaccgcggagcggaggaggtgacctggctgcttaatgacagcgacggagaggaagaagagatggcgtccgggctcggtgacctctcggtcggcgtgtccagccttcccatgcgggaactggcctggcggcgggtagccgacgactcacgactcggaccgatg

SEQ ID NO: 4116 - DNA, 203 bp, Homo sapiens
  source 1..203: mol_type = other DNA
ggcgcgccagtcctagtaccgtaacgcctcttttggcacgtagttgcctactacgtaggggaaacaacgtcaccaagaaacgctatatattcaaaaacaccgtgcagtccacacgctacttctcagcgaagcactgctgcagccagaccggagcggtgagcggagccgagcagcggaccttcggagcccgactcggaccgatg

SEQ ID NO: 4117 - DNA, 203 bp, Homo sapiens
  source 1..203: mol_type = other DNA
ggcgcgccagtcctacgctctcgtcaggcttgtcatggtccgtaaaagctgcatgaaaaacacgacgaaagcgttcagtgttggatcagactcacgtcacacgttacatcatacaacgtagggcggtattgttgagaacatatataatcgccgtttcgtaagtacgtcgatatcgctccttcttcactcgactcggaccgatg

SEQ ID NO: 4118 - DNA, 203 bp, Homo sapiens
  source 1..203: mol_type = other DNA
ggcgcgccagtcctcgttacatcatacaacgtagggcggtattgttgagaacatatataatcgccgtttcgtaagtacgtcgatatcgctccttcttcactatggacctcttgatccgtctcggttttctgttgatgtgtgcgttgccgacccccggtgagcggtcttcgcgtgacccgaaaacccttcgactcggaccgatg

SEQ ID NO: 4119 - DNA, 203 bp, Homo sapiens
  source 1..203: mol_type = other DNA
ggcgcgccagtcctacgctgatgatggtggcagtgattcaagtgttttgggggctgtatgtgaaaggttggctgcaccgacattttccctggatgttttcggaccagtggtgatatatagactgaagcggagtgcatctcgagtcgctcggaaacgactcaccagactttttgctttaacccaaaacccgactcggaccgatg

SEQ ID NO: 4120 - DNA, 203 bp, Homo sapiens
  source 1..203: mol_type = other DNA
ggcgcgccagtcctgaccagtggtgatatatagactgaagcggagtgcatctcgagtcgctcggaaacgactcaccagactttttgctttaacccaaaaccatgctacgccggggaagcctccggaaccctctggcgatctgcctgttgtggtggctgggagtggtggcggcagccacggaggagacgcgactcggaccgatg

SEQ ID NO: 4121 - DNA, 203 bp, Homo sapiens
  source 1..203: mol_type = other DNA
ggcgcgccagtcctccccgtgacgtgcaagactacatgctataagatagccttacagcttttgagtctagacaggggaacagccttcccttgtaagacagaatgaatcttgtaatgcttattctagccctctgggccccggtcgcgggtagtatgcctgaattatccttgactcttttcgatgaacctcgactcggaccgatg

SEQ ID NO: 4122 - DNA, 203 bp, Homo sapiens
  source 1..203: mol_type = other DNA
ggcgcgccagtccttgatcgtgctcagtcccaacctctggcgcctgccctggacgaccgtctttgccgccttcagatcctcgtattgcgaaggtggcggtggctcgtagccaccacccatcgtccccctttctctataaaacttgccgggtacctgaagccccgacgactgttcgtcgagcacccgtccgactcggaccgatg

SEQ ID NO: 4123 - DNA, 203 bp, Homo sapiens
  source 1..203: mol_type = other DNA
ggcgcgccagtcctctacctggccaagctgggcacctatcatcattaccgggttgacaacggcacgctcagcgtcatcctcaacagcaccaccgcgacgttccagagcagggttgcttgagacccgctggtttataagaagactccaccgagacgctcacccgttcactcgggcgcatcacccgcctccgactcggaccgatg

SEQ ID NO: 4124 - DNA, 203 bp, Homo sapiens
  source 1..203: mol_type = other DNA
ggcgcgccagtcctccagagcagggttgcttgagacccgctggtttataagaagactccaccgagacgctcacccgttcactcgggcgcatcacccgcctcatggacccgccgctgccgtcgctacattcgccgcaatgggcttccctcctgcagctgcaccacggccttatgtggctgcgccgttttcgactcggaccgatg

SEQ ID NO: 4125 - DNA, 203 bp, Homo sapiens
  source 1..203: mol_type = other DNA
ggcgcgccagtcctgccgctggaacgcgcgcttttggcggccgtcaaggtgtttctcagcctggttttcactctgctgatggtgctgagaatcatgaccctgcgcacctttttgcaaacctacttttcctctgacaagctgtagcttcgagaccttgcggatacgccgccgggcgctgcggtcccgaccgactcggaccgatg

SEQ ID NO: 4126 - DNA, 203 bp, Homo sapiens
  source 1..203: mol_type = other DNA
ggcgcgccagtcctgcgcacctttttgcaaacctacttttcctctgacaagctgtagcttcgagaccttgcggatacgccgccgggcgctgcggtcccgacatggagacagtttccacgcagcgggaaaccgcgtcgtcggaaacggagcgtaccagggaagccgcgtccgcggaaacgacggacgctcgactcggaccgatg

SEQ ID NO: 4127 - DNA, 203 bp, Homo sapiens
  source 1..203: mol_type = other DNA
ggcgcgccagtcctaacgccgttgtccaccctctcgccctagattttcgttcggaactggttttcggacagagcagccgtttccagagaacgcagcgcaccatgagaagagaaaaagggtttcaagtacccaccgatggcacggtcatctacgtgccccccgggatccaagagacccggctggcgacccgactcggaccgatg

SEQ ID NO: 4128 - DNA, 203 bp, Homo sapiens
  source 1..203: mol_type = other DNA
ggcgcgccagtcctacagaacaccgcaactcggtgttgtactcgtgttttttattcaacaataaagctttttcacgcttactcgagtgtgacgtgactttatgggggaacgccgtgtgggaatgacggtgattatattacactctataaacggtttctcatacgcgccttttgatagccaccgccgtccgactcggaccgatg

SEQ ID NO: 4129 - DNA, 203 bp, Homo sapiens
  source 1..203: mol_type = other DNA
ggcgcgccagtcctgtaccatcttctgaggctctggttgtggagcccatgacgacgggtcggatacagggtgccgccacggtttgaccacactcgtgacgtcaatcaaatccgcggtaaccgggtgctgataagacggactgtttcatcgacgcctaccttagaccgacagcggtcgtaagcggcagccgactcggaccgatg

SEQ ID NO: 4130 - DNA, 203 bp, Homo sapiens
  source 1..203: mol_type = other DNA
ggcgcgccagtcctacgggactttgacagccgccagtacgacggggaagtcctaatgcctataaaaccgcgcccgttttcacagcagccgcgcttgtcgccatgcttcatgtcgtcccgctagaatggaccgtcgaggaggtagtcccctacctagagaggctggcggtatggctgcgcgcctccgtccgactcggaccgatg

SEQ ID NO: 4131 - DNA, 203 bp, Homo sapiens
  source 1..203: mol_type = other DNA
ggcgcgccagtcctctgctcagacgacggtcgctgcgacggtcgctgccacagcagcggcgtcgccccagttcgtctcctaatcgacgtgtccgcggcgtgaccacgtcaccgtgccccactcgctcgcttgtgtataagagaagggtaggtgcgccgcagcggctttgtgccgagaccgtcgccacccgactcggaccgatg

SEQ ID NO: 4132 - DNA, 203 bp, Homo sapiens
  source 1..203: mol_type = other DNA
ggcgcgccagtcctcagccgcgattcgtctgacgctgctcctatattaagctttcgcgcagcgcgctttatccgactcgctgtcgagacggctttgccggcatgtccctactcaccaaagccgccgccgaagcctggggcacctatctccgacagcgcgacgagcgctgcgaagatgctatccgctgccgactcggaccgatg

SEQ ID NO: 4133 - DNA, 203 bp, Homo sapiens
  source 1..203: mol_type = other DNA
ggcgcgccagtcctcggaggacgcggaataaaacgtgtcgcacaaagaactctctttctctgcttcttttctggggtgtctagctggcggcctcttttgacatgtggcgtacacgctgggaagacggagctcccacgtttacgcgaaacgatgaattcctctattgccacacgcgctacgaaacttttcgactcggaccgatg

SEQ ID NO: 4134 - DNA, 203 bp, Homo sapiens
  source 1..203: mol_type = other DNA
ggcgcgccagtcctctttgcggtcgcacatgttccaaattacgtgagtctttgacgtcgatgtcagtcttttcgggtggtttacagaccggagctgccaaccgcagcccacgaacgacgtgaacaagccacgtcactgaagaaactccataaaataggctgccaagtgccgctccacgccgcggcacccgactcggaccgatg

SEQ ID NO: 4135 - DNA, 203 bp, Homo sapiens
  source 1..203: mol_type = other DNA
ggcgcgccagtcctgccctgacctccctctgccacctgctgtgctactggtgttccgaatcgtaccggcgtctgaacaccgaagaggaaaacgaggcggcggaggaaactgccgcgggagaagcctctgcggtagcggcggcggccgtctctgaggaagagcagcagcgggagtaaacgaggagagcccgactcggaccgatg

SEQ ID NO: 4136 - DNA, 203 bp, Homo sapiens
  source 1..203: mol_type = other DNA
ggcgcgccagtcctattataccgtaataaaaaagcgctacctcggccttttcatacaaaccccgtgtccgcccctcttttccccgtgcccgatatacacgatattaaacccacgaccatttccgtgcgattagcgaaccggaaaagtttatggggaaaaagacgtaggaaaggatcatgtagaaaaaccgactcggaccgatg

SEQ ID NO: 4137 - DNA, 203 bp, Homo sapiens
  source 1..203: mol_type = other DNA
ggcgcgccagtcctggggcttcatgctgacgtaggtaccgactggggtcaaaagcctgggtacttatggggagcgcgcacaaaggaccgtcaggcgccggcatggagcgtcgccgaggtacggtaccgctgggatgggtgttttttgttctttgcttatctgcctcttccccgtgtgctgttgatctgcgactcggaccgatg

SEQ ID NO: 4138 - DNA, 203 bp, Homo sapiens
  source 1..203: mol_type = other DNA
ggcgcgccagtccttagtgacggtacccacgctgctgttatatacgtcatccgacatcggtgacacagcttcagaaacaacgtgtgtggcgcacgctacttatggggaacccccggagcccgctcgatcgacggctacggttcaggaatgtaccgttcttaccgccccgaattgcggcatcgtcaacacgactcggaccgatg

SEQ ID NO: 4139 - DNA, 203 bp, Homo sapiens
  source 1..203: mol_type = other DNA
ggcgcgccagtcctgctcctcctgcggttccctcgcagccccccgagtattcgtctgtgtttccgcctgtataaaaataaagagacgggaggctgatcgcggccttcagcgtctcatttgtctttactctcgagtgcggtcggtgtctcatcggtgagacgaggccgccgcccgacaagttcgatctccgactcggaccgatg

SEQ ID NO: 4140 - DNA, 203 bp, Homo sapiens
  source 1..203: mol_type = other DNA
ggcgcgccagtcctgagagtaactgcagtctacgcacccacggcgtgtacacacggggtgaacaacactaatcgataagtcgcgtgtaggcgactggctacatcaaccggatatctgcggggatttaaaaagacgacccgttgtcatccggcttagagcaaaccgtccttttatcatcttccgtcgcccgactcggaccgatg

SEQ ID NO: 4141 - DNA, 203 bp, Homo sapiens
  source 1..203: mol_type = other DNA
ggcgcgccagtcctccgtgacttggctgaacgttgaaacataaagccaaagcgccgtcggcacttggcttcagagcagcgcctcggggcgatgcgacggcgatgaacttagagcaactcatcaacgtccttggtctgctcgtctggattgccgctcgtgctgtcagccgcgttggtccgcatggctcccgactcggaccgatg

SEQ ID NO: 4142 - DNA, 203 bp, Homo sapiens
  source 1..203: mol_type = other DNA
ggcgcgccagtcctgcgactgtgtcagcggctgcgcattcgcctgccgcatcgataccagcggttacgcaccgaggactgaacggataaccgcaaaggccacgtgcaacgttcacgctgctataagaaggccatgtcccccgtggacgggtctctttgacacgagcgcggcacgccgttgccacgagccgactcggaccgatg

SEQ ID NO: 4143 - DNA, 203 bp, Homo sapiens
  source 1..203: mol_type = other DNA
ggcgcgccagtcctggtccctgatcacccgacagctaacaaacgctataacaccatgaccatcagcagtgtcctcctagccctgcttttatgcgctttgctattcgcgttcctgcactactttaccaccttgaaacaatacctacgtaacctggcctttgcgtggcgctatcgcaaggtccggtcgtccgactcggaccgatg

SEQ ID NO: 4144 - DNA, 203 bp, Homo sapiens
  source 1..203: mol_type = other DNA
ggcgcgccagtcctattcgcgttcctgcactactttaccaccttgaaacaatacctacgtaacctggcctttgcgtggcgctatcgcaaggtccggtcgtcatgaccagcaacgccctgtatgagctgtttcgacgtcggttaccgcgtgcccccgtcaacacggtcatgtttctcacgcgacgcactcgactcggaccgatg

SEQ ID NO: 4145 - DNA, 203 bp, Homo sapiens
  source 1..203: mol_type = other DNA
ggcgcgccagtcctcgggacgaaagacgacgtcaggggattcacggtatttagccatgcagcgtgcggcgcctctctcatggatccactgtcaccgtcgcgatgggaggtagccctgttccccagctcaccaccgtcactcaaggactcatgccatctgtgcgcatggactttcgggctcgccggccccgactcggaccgatg

SEQ ID NO: 4146 - DNA, 203 bp, Homo sapiens
  source 1..203: mol_type = other DNA
ggcgcgccagtcctacatgacctcgagatgtcgtcacccaaggtatttaacggcacacagccagacgcgttcgtcagcagcgacgccgacaagacctcagcatggctcggaggctatggatcttgagcttactagccgtgaccttgacggtggctttggcggcaccttctcagaaatcgaagcgcaggcgactcggaccgatg

SEQ ID NO: 4147 - DNA, 203 bp, Homo sapiens
  source 1..203: mol_type = other DNA
ggcgcgccagtcctgcgtgctcgtgaaaacgctgtcctccgcctcctcatccgccggcgtgtcctcgttgctcgaggggatataaatcaccgtcgagggttcgccagagcgacgtgacgagctgcgacgccgcgacgacatcctctcgtctgctgaggtgcgttcggctcagttgcttacctgcataccgactcggaccgatg

SEQ ID NO: 4148 - DNA, 203 bp, Homo sapiens
  source 1..203: mol_type = other DNA
ggcgcgccagtcctcggccctcactatataacgtcccgcccgggtctcctccatgtatgcaggtaagcaactgagccgaacgcacctcagcagacgagaggatgtcgtcgcggcgtcgcagctcgtcacgtcgctctggcgaaccctcgacggtgatttatatcccctcgagcaacgaggacacgccgcgactcggaccgatg

SEQ ID NO: 4149 - DNA, 203 bp, Homo sapiens
  source 1..203: mol_type = other DNA
ggcgcgccagtcctggcctcacgaggtcggaggtcacgccacatgaagccgcggcggcgcgttataagcaccgtggggtcatcgaccgacgaggcgcggcgatgacgagcaggcgcgcacccgacggcggtttgaatttagacgattttatgcgccgccagcgcggtcgccacctggatctgccctatcgactcggaccgatg

SEQ ID NO: 4150 - DNA, 203 bp, Homo sapiens
  source 1..203: mol_type = other DNA
ggcgcgccagtcctctgtgatgactagctatatagccgctgtctggctttaccgccgtcgctccgcgtcgcttcgccgccaccttcttcttcctctcagtcatgaaccccgtggatcagccgccacctccaccgctaacccagcagccggaggagcaggctaaagaagaccatgacgacggtgacgagcgactcggaccgatg

SEQ ID NO: 4151 - DNA, 203 bp, Homo sapiens
  source 1..203: mol_type = other DNA
ggcgcgccagtcctgtccgagacggtgtatataaaccgcgtcggcctcgccggcccgagcgcgccggggagaagaatctcttcccgggccctgcgttcaagacggcgtgccgtgacgctcgatgggtccgcttcatcagactgcgtacgctttggagcgtcagacccagggcgcatgtagccgacttgcgactcggaccgatg

SEQ ID NO: 4152 - DNA, 203 bp, Homo sapiens
  source 1..203: mol_type = other DNA
ggcgcgccagtcctaagagattcttctccccggcgcgctcgggccggcgaggccgacgcggtttatatacaccgtctcggacggcgggacgccgagcccgcgccgcggccgctcatccggagacggcggaaaccgcggcgccggaggaaacggggaccggcaacgacggcggtggcggcgaccagattcgactcggaccgatg

SEQ ID NO: 4153 - DNA, 203 bp, Homo sapiens
  source 1..203: mol_type = other DNA
ggcgcgccagtcctcagcggcgcccgggtgaaaaccgcgtatccgcctccgctattaaactaccccccctccctctaggtggggcgctcaccgtggtgttgtggatgatggtgtccatcgtggacgaatagcagaccgcgggcgcagtccggggcgacgacgcttccgggttctggagaaaagccagccgactcggaccgatg

SEQ ID NO: 4154 - DNA, 203 bp, Homo sapiens
  source 1..203: mol_type = other DNA
ggcgcgccagtccttggatgatggtgtccatcgtggacgaatagcagaccgcgggcgcagtccggggcgacgacgcttccgggttctggagaaaagccagcatgagtttgcagtttatcggtctacagcggcgcgatgtggtagccctggtcaactttctgcgccatctcacgcaaaagcccgacgtgcgactcggaccgatg

SEQ ID NO: 4155 - DNA, 203 bp, Homo sapiens
  source 1..203: mol_type = other DNA
ggcgcgccagtcctataaactgcaaactcatgctggcttttctccagaacccggaagcgtcgtcgccccggactgcgcccgcggtctgctattcgtccacgatggacaccatcatccacaacaccacggtgagcgccccacctagagggagggggggtagtttaatagcggaggcggatacgcggtttcgactcggaccgatg

SEQ ID NO: 4156 - DNA, 203 bp, Homo sapiens
  source 1..203: mol_type = other DNA
ggcgcgccagtcctacgccgtccggcgcaacttctgtctcggcacggtacgataaaaacgacgtcccccgtcgacgttgttttctccgagcggtgatcgttcccgtccctctcctccctccgcggcccccacggcggcggcctgctcgcacggacctatactattaccgccccaccgccgtcgtcgtccgactcggaccgatg

SEQ ID NO: 4157 - DNA, 203 bp, Homo sapiens
  source 1..203: mol_type = other DNA
ggcgcgccagtcctcccgtccctctcctccctccgcggcccccacggcggcggcctgctcgcacggacctatactattaccgccccaccgccgtcgtcgtcatgaacttcatcatcaccacccgagacttctccaacgacgattcagtcctgcgagccgccgagatgcgtgacaacgtggcaggctcgcgactcggaccgatg

SEQ ID NO: 4158 - DNA, 203 bp, Homo sapiens
  source 1..203: mol_type = other DNA
ggcgcgccagtcctgaagttccagcacaaaaaacgacgttcattggatcgtctgacgtcaacgctgatagtgtctataaaggccgtgccgccgcgccgtagttctccgaaggcggacggaggagtctgtcgaccgcagcggtggctggagaagcgcagcgtcggcgagcgaaggtagaggagtccgtccgactcggaccgatg

SEQ ID NO: 4159 - DNA, 203 bp, Homo sapiens
  source 1..203: mol_type = other DNA
ggcgcgccagtccttgcggaggcaccggttcctgtggcaacggcggcgacgagctcggctgctgcagcacaacggcccccagcagtctcaccagtaagcaggggtaaacaaaaaaaccacagactccgggatagtataagaagggactttaccgctattgctgctattcatagagaaggatagaaaggcgactcggaccgatg

SEQ ID NO: 4160 - DNA, 203 bp, Homo sapiens
  source 1..203: mol_type = other DNA
ggcgcgccagtcctcatacgcaggggctggacgtggttaccggtcactggactcggtttcgctgtagctgtggttcaacctgaacatggctcccagagctgctaggaaccggtccagtcacattttttggtgggtggggggtactaaaaaagtatttaatattggggtttaatgataaaatccaggttcgactcggaccgatg

SEQ ID NO: 4161 - DNA, 203 bp, Homo sapiens
  source 1..203: mol_type = other DNA
ggcgcgccagtcctcttgactgtaccatcattgctgctacggaataataactacgctacgacctggcctgtggtgtgtgttgttttttgtgcacgcacgacatgacactcttttgccgcaccgccaacagcaccgccggctacgtcgacatgaacgtctgcatcggcatgatcggcgtggtttgtttccgactcggaccgatg

SEQ ID NO: 4162 - DNA, 203 bp, Homo sapiens
  source 1..203: mol_type = other DNA
ggcgcgccagtcctaaggggctctttgctcgaaggtgagccgcggacgccgtcggtaccgtctccaccacagttaccaccgtcgccgtcactgccaccgacatggagcccacgccgatgctccgcgaccgggatcacgacgacgcgccccccacctacgagcaggccatgggtctgtgcccgacgacgcgactcggaccgatg

SEQ ID NO: 4163 - DNA, 203 bp, Homo sapiens
  source 1..203: mol_type = other DNA
ggcgcgccagtcctgaggaggaggcggcggtttggatcgcaactccggcaattacttcaacgacgcgaaagaggagagcgacagcgaggattctgtaacgttcgagttcgtccctaacaccaagaagcaaaagtgcggctagagcgtgggccgcgtgcctgggaacgtgcgcacggcgcggtcccgcgcgactcggaccgatg

SEQ ID NO: 4164 - DNA, 203 bp, Homo sapiens
  source 1..203: mol_type = other DNA
ggcgcgccagtcctcagcgttcccggtcgtcgtgtgtgctctctataaaactttcgctcgctcgcgcccgctccttagtcgagacttgcacgctgtccgggatggatcgcaagacgcgcctctcggagccgccgacgctggcgctgcggctgaagccgtacaagacggctatccagcagctgcgatctcgactcggaccgatg

SEQ ID NO: 4165 - DNA, 203 bp, Homo sapiens
  source 1..203: mol_type = other DNA
ggcgcgccagtccttcgaattgggagactttcgagaattcgtctgagcggcgctgacagcatacggggaggagacacagaagaaaaaaacacatcgcacacagactttataaaccgtagttgtcggcgccatctagactcactttattgaaatctacctgatttctttgttattttcctcgtaaacttcgactcggaccgatg

SEQ ID NO: 4166 - DNA, 203 bp, Homo sapiens
  source 1..203: mol_type = other DNA
ggcgcgccagtcctagactttataaaccgtagttgtcggcgccatctagactcactttattgaaatctacctgatttctttgttattttcctcgtaaacttatgaatccggctgacgcggacgaggaacagcgggtgtcctcggtgcccgcacatcggtgccggccaggtaggattccaagccgcagccgactcggaccgatg

SEQ ID NO: 4167 - DNA, 203 bp, Homo sapiens
  source 1..203: mol_type = other DNA
ggcgcgccagtccttgcctgggaacgctatggctataacgggaaagaaccggtttggcaacattccattgtggggggggggtacttatagcgtgcctagctatgacgttgatatatgtggatgcggataatactcgtaatgagctaaaagcgacgactgggagtaattttaccattacgcataggaaacgactcggaccgatg

SEQ ID NO: 4168 - DNA, 203 bp, Homo sapiens
  source 1..203: mol_type = other DNA
ggcgcgccagtcctaactctaccaggccctcgggcacgaagaaacgcgccgtgagcgcctggtgatcggcgtggtagagatagcgaaccgatatagtatttacctcgcgtttggctttgagcgccgtcactagttcattgtcctcgtcggccgggtcgcgcggccgtttggccaccgcgcgcgcgtcccgactcggaccgatg

SEQ ID NO: 4169 - DNA, 203 bp, Homo sapiens
  source 1..203: mol_type = other DNA
ggcgcgccagtcctccccgtaagccaggcgcagcaggacatcttgtcttcgatcgacccgcccgccggctcgacatcggtgtccctgccgccggcctcgccatgaaagtcacacaggccagctgccaccagggcgacatcgctcgctttggagcgcgagcgggcaatcaatgcgtctgcaacggcatccgactcggaccgatg

SEQ ID NO: 4170 - DNA, 203 bp, Homo sapiens
  source 1..203: mol_type = other DNA
ggcgcgccagtcctgtcagacgggcgagtaccgcgacagctgtttggaaagcgaagacggcgccccgctgtgtcgaggctgcgcgctggttaaacagaccgcctgccacgtcggcggccacattgtgcagcaggcgcgcggcggtttagcagcgacgtcctcctcgtcctccccccacggcctgcccccgactcggaccgatg

SEQ ID NO: 4171 - DNA, 203 bp, Homo sapiens
  source 1..203: mol_type = other DNA
ggcgcgccagtcctcgtgcacgccgtccttggagcggactggttatcgttgggcaccgtcatcgtggtggcgagcgcgctccgggccatcgcgaccgcagtctgggccgtggctgcccgcgcgctttgcgactctgggcccgctggtgctggctcttctgctggtgctggctctgctgtggcggggtccgactcggaccgatg

SEQ ID NO: 4172 - DNA, 203 bp, Homo sapiens
  source 1..203: mol_type = other DNA
ggcgcgccagtcctctgggccgtggctgcccgcgcgctttgcgactctgggcccgctggtgctggctcttctgctggtgctggctctgctgtggcgcggtcatggccaatcgtcgtctccgacacgctccgcacaccgcgactgatgagttccaccaggctctgcgccgtctcttcgcgcccctctgccgactcggaccgatg

SEQ ID NO: 4173 - DNA, 203 bp, Homo sapiens
  source 1..203: mol_type = other DNA
ggcgcgccagtcctgccttcctcaagtacgtgcacggcgactgcgcgacctgcagtcacggagagatcctccgtgagaagacgcaactattaacggcgatcgtcagcaagctcatggacattaacggaatcctggagggaaaagacgagccggcgccgggtaaataaatcggcggtggcgtcggtgcgcgactcggaccgatg

SEQ ID NO: 4174 - DNA, 203 bp, Homo sapiens
  source 1..203: mol_type = other DNA
ggcgcgccagtcctgtcagcaagctcatggacattaacggaatcctggagggaaaagacgagccggcgccgggtaaataaatcggcggtggcgtcggtgcgatggagatgaacaaggttctccatcaggatctggtgcaggccacgcggcgtatcctcaagttgggtcctagcgagctgcgcgtcacccgactcggaccgatg

SEQ ID NO: 4175 - DNA, 203 bp, Homo sapiens
  source 1..203: mol_type = other DNA
ggcgcgccagtccttgagggggagtcgttgggccgttactgctcacgtgggtactcggattcatggcgatcggcgccgctgattgaggacgcggaaaaagaatgtcctgggctaagcagcgggtgccgtttctggacgatgacgacggagaggaggaaaacgacgtgcaggatgacgtggattctccgcgactcggaccgatg

SEQ ID NO: 4176 - DNA, 203 bp, Homo sapiens
  source 1..203: mol_type = other DNA
ggcgcgccagtcctccagccgcgggctccgcgtcctcgtcgatcaccagcggtcgcgtcggcaccggagaatccacgtcatcctgcacgtcgttttcctcctctccgtcgtcatcgtccagaaacggcacccgctgcttagcccaggacattctttttccgcgtcctcaatcagcggcgccgatcgcccgactcggaccgatg

SEQ ID NO: 4177 - DNA, 203 bp, Homo sapiens
  source 1..203: mol_type = other DNA
ggcgcgccagtccttaagtcgacttccgcgacgtgtgtggctctgcatcacactcttcaaggcctttcagattacaaaacgcacctacaaaggcaaagtgcacctggcggactttatgcgcgatttcacgcagctgttggagaattgcgacatcaagctggtggaccccacgtacgtgatagacaagtcgactcggaccgatg

SEQ ID NO: 4178 - DNA, 203 bp, Homo sapiens
  source 1..203: mol_type = other DNA
ggcgcgccagtcctacggcggctcttggattcggcattggtgcgccgcgtcttggcctgcatgatcatcgtcatcatgatcgccattagcatctggatcctgacctacgtgctgtttctctaataagaaccccggcccctgacggtaattttcctttcttctccgtttctcctcagctgccgtacgtgcgactcggaccgatg

SEQ ID NO: 4179 - DNA, 203 bp, Homo sapiens
  source 1..203: mol_type = other DNA
ggcgcgccagtcctgacctacgtgctgtttctctaataagaaccccggcccctgacggtaattttcctttcttctccgtttctcctcagctgccgtacgtgatgcctcacggccatctccgacaggccctctccccgacctcctggacatgtgagggcttgttgctcctcctgggattgctggtgctccgactcggaccgatg

SEQ ID NO: 4180 - DNA, 203 bp, Homo sapiens
  source 1..203: mol_type = other DNA
ggcgcgccagtcctcctccaccctgacggccgccgcggccgtctcgggtgccttcagggagcgggaccgaccttggctgccaagtccgtacccctcctcctcgaccgcgggcgtttcccggagggtccgcgcaacacgcaagagaccacgacgcgcctcatcgctgctggatttggcccgcgacgaaccgactcggaccgatg

SEQ ID NO: 4181 - DNA, 203 bp, Homo sapiens
  source 1..203: mol_type = other DNA
ggcgcgccagtcctcttccggttcccatgtcctaatcataacaaaacaccgtgtcactgtccatctccctgtcttttcgcgccgccggtcccccccaaaccatgtctctagatgccgccagccaccaaccggcggcacggcggctcttggattcggcattggtgcgccgcgtcttggcctgcatgatccgactcggaccgatg

SEQ ID NO: 4182 - DNA, 203 bp, Homo sapiens
  source 1..203: mol_type = other DNA
ggcgcgccagtcctacgtgagggagatcatgtcatgggcgggctgaagaccgtgcgggaaggattgacgtgtgcggtgcttgtggaacacggtgttttaatatgtatccgcgtgtaatgcacgcggtgtgctttttagcactcggtttgataagctacgtggccgtttgcgccgaaaacacggttacccgactcggaccgatg

SEQ ID NO: 4183 - DNA, 203 bp, Homo sapiens
  source 1..203: mol_type = other DNA
ggcgcgccagtcctgaattgctgggatcgttgcggttgtcgcctttggtggtccgcaaccgcagccagaccgcagtggtggccacggtggtgtctcagacgtcgtgcgtcaaacatgacgtgctgaacttttccttggtataaaattcactcagtggcggcgtagccattgtcttccgttcatccacccgactcggaccgatg

SEQ ID NO: 4184 - DNA, 203 bp, Homo sapiens
  source 1..203: mol_type = other DNA
ggcgcgccagtccttcgtgcgtcaaacatgacgtgctgaacttttccttggtataaaattcactcagtggcggcgtagccattgtcttccgttcatccaccatgagccacgaggaactaaccgcgctagcgccggtggggcccgcggcttttctctacttcagcaggttgaacgcagaaacgcaggagcgactcggaccgatg

SEQ ID NO: 4185 - DNA, 203 bp, Homo sapiens
  source 1..203: mol_type = other DNA
ggcgcgccagtcctcacgcaaaaagctggaacaacacgcggctaaaaagcagaacatctacgaacggattccataccggccctccagacagaacgacaactccccgttgatcgaaccgacgggcacagacgacgaagaggacgaggacgacgacgtctgataaggaaggcgagaacgtcttttgcacccgactcggaccgatg

SEQ ID NO: 4186 - DNA, 203 bp, Homo sapiens
  source 1..203: mol_type = other DNA
ggcgcgccagtcctccccgttgatcgaaccgacgggcacagacgacgaagaggacgaggacgacgacgtctgataaggaaggcgagaacgtcttttgcaccatgcagacctacagcacccccctcacgcttatcatagtcacgtcgctgtttttgttcacaactcagggaagttcatcgaacgccgtccgactcggaccgatg

SEQ ID NO: 4187 - DNA, 203 bp, Homo sapiens
  source 1..203: mol_type = other DNA
ggcgcgccagtccttccggcctctcactccattgcgcctgggtttcgggactgatgatctttgttggtgcactggtcatctgctttctgcggtcgcaacgaatcggggaacaggacgctgaacagctgcggacggacctggatacggaacctctgttgttgacggtggacggagatttggaataaaagcgactcggaccgatg

SEQ ID NO: 4188 - DNA, 203 bp, Homo sapiens
  source 1..203: mol_type = other DNA
ggcgcgccagtcctaacgccaaaaacgtccacatttccatcaaaatcagaccgcccgacgcgcccatgccgccggcgaccgccgtctgagcctcactttccacggcgccggtgacccgccccccggcagcggtctcatctatatatacatcagcgtgccagaacgtgaccttcctagcgacggcggcccgactcggaccgatg

SEQ ID NO: 4189 - DNA, 203 bp, Homo sapiens
  source 1..203: mol_type = other DNA
ggcgcgccagtcctatgtcttttctattgacaatagcaaaggaatacaaaagactatgccaagatgctaaggcagctcaaatgatgacagtaggaactgtatcaaactacactacgttcaagaaatggactacatcaaggaaggaaaagaatccttcactaagaatgagatgggcaatgagcagcaaacgactcggaccgatg

SEQ ID NO: 4190 - DNA, 203 bp, Homo sapiens
  source 1..203: mol_type = other DNA
ggcgcgccagtcctatattatgtaatcacacttttggaagtaatataatgagaccccacttggaaaaagcaataaaaggagttgaaggcagagttggagagatgggacgaatggcaatgaaatggttagttgttataatatgtttctctataacaagtcaacctgcttctgcttgcaatctaaagacccgactcggaccgatg

SEQ ID NO: 4191 - DNA, 203 bp, Homo sapiens
  source 1..203: mol_type = other DNA
ggcgcgccagtcctcgcacagtggatcctaggcagaaccgtaacttaaacttctggcagtcatgcaagaccccctcttaggaaccctgtctgaattaaaggatttggttagaaaaaccataccagatgtaattgagcttgcatatcaaaaggacgcattactttcacaagtgcatccaagatcagtgtcgactcggaccgatg

SEQ ID NO: 4192 - DNA, 203 bp, Homo sapiens
  source 1..203: mol_type = other DNA
ggcgcgccagtcctgcgcacagtggatcctaggcattgctttcacgctttgaggtgaaccacctcactggagcaccagatttcatctaatgggtaactccaagtcaaaatcaaagctgtctgctaaccagtatgaacagcaaacagtcaatagcaccaaacaggtagccattttaaagagacaggctgcgactcggaccgatg

SEQ ID NO: 4193 - DNA, 203 bp, Homo sapiens
  source 1..203: mol_type = other DNA
ggcgcgccagtcctaccttcatctttttaccataatcttgttctcagtaccatttgataagggtacacttgccaatacgcccccatcctaagggtctcgcaatggggggtcttagcctactccaattgcccagggacaaatttcggaaaagctctttctttgtttgggtcatcatcttattccaaaagcgactcggaccgatg

SEQ ID NO: 4194 - DNA, 203 bp, Homo sapiens
  source 1..203: mol_type = other DNA
ggcgcgccagtcctcgaggcggcaattcagttaatttcatatcaagataacatccatttccaagaccacagataactatattattaatctttaccacaaatatggagaggggtcgtgagcgcgggagatcaaggaattcacgtgccgaccagcaaaattcaacaggtcctcaatttaggacaagatcccgactcggaccgatg

SEQ ID NO: 4195 - DNA, 203 bp, Homo sapiens
  source 1..203: mol_type = other DNA
ggcgcgccagtcctgtatggtggtcatcatgattttgttatcaaaacatctcatgatgattagaatctcttgtcagatctcattaaatctaaactttatttatggacgtttggagacctagctacacacattctcttgttattagagaatttggtgttacaaaccttgaagatttgtgtctaaagtatcgactcggaccgatg

SEQ ID NO: 4196 - DNA, 203 bp, Homo sapiens
  source 1..203: mol_type = other DNA
ggcgcgccagtcctttggcaaatttgcttctcactttacattacgtagtcacgatatttcccatagtaataattttggtgttgtaactagttttactacttatggtaatactgtttctgaggctgtgtctagattagttgaatcagcttctgaatttattgtttggcgtgcagaggcacttaataagtcgactcggaccgatg

SEQ ID NO: 4197 - DNA, 203 bp, Homo sapiens
  source 1..203: mol_type = other DNA
ggcgcgccagtcctatggtaatactgtttctgaggctgtgtctagattagttgaatcagcttctgaatttattgtttggcgtgcagaggcacttaataagtatggttgatttatttttcaatgatactgcttggtacataggacagattttagttttagttttattttgtcttatttctttaatctttcgactcggaccgatg

SEQ ID NO: 4198 - DNA, 203 bp, Homo sapiens
  source 1..203: mol_type = other DNA
ggcgcgccagtcctgtacctataaacgtgcctttttagataagttagatgttaatagtggttttgctgtttttgttaagtctaaagttggtaactatcgtttaccgtctagtaaacctagtggtatggatactgccttgttaagagcttaaatctaaactattaggatgtcttatactcccggtcattcgactcggaccgatg

SEQ ID NO: 4199 - DNA, 203 bp, Homo sapiens
  source 1..203: mol_type = other DNA
ggcgcgccagtcctaggaaaaagcataaaagaggtactcttccaacaacaagcccgaaacaagaggggacgtcaaaggtcaggaaattcgggttgttttgtttgtggccagcctggacatcgggctgcagtatgccctcaaaaacaacaaagtcctgttaacactcctaatttgtgcccgcgctgtaacgactcggaccgatg

SEQ ID NO: 4200 - DNA, 203 bp, Homo sapiens
  source 1..203: mol_type = other DNA
ggcgcgccagtccttctccttatacaggtgtaacttttgtccgtgctggctgcggcaagtggcgcccaacgtggggctcgacagctttcctcgtcactactcttattatttgaacaaagtgagtatttgaatgaataagtgatttacattaaagaggagtagtaaggtatatagttgagagtataaatcgactcggaccgatg

SEQ ID NO: 4201 - DNA, 203 bp, Homo sapiens
  source 1..203: mol_type = other DNA
ggcgcgccagtcctgtaaaattttcgaattttataataattaagaaaggagtttaatagtttatcacaacttaaaagtgaaatttatttaagaaaggaggactacttatgcaagtagcccctaatgtatggagtaaatattttaatattccaaatccaggattacgtgcttactttagcaatgtagtgcgactcggaccgatg

SEQ ID NO: 4202 - DNA, 203 bp, Homo sapiens
  source 1..203: mol_type = other DNA
ggcgcgccagtcctttttcgaattttataataattaagaaaggagtttaatagtttatcacaacttaaaagtgaaatttatttaagaaaggaggactacttatgcaagtagcccctaatgtatggagtaaatattttaatattccaaatccaggattacgtgcttactttagcaatgtagtgtctggacgactcggaccgatg

SEQ ID NO: 4203 - DNA, 203 bp, Homo sapiens
  source 1..203: mol_type = other DNA
ggcgcgccagtcctagcaaaagcaggagtaaagatgaatccaaatcaaaagataataacgattggctctgtttctctcaccatttccacaatatgcttcttcatgcaaattgccatcctgataaccactgtaacattgcatttcaagcaatatgaattcaactcccccccaaacaaccaagtgatgctcgactcggaccgatg

SEQ ID NO: 4204 - DNA, 203 bp, Homo sapiens
  source 1..203: mol_type = other DNA
ggcgcgccagtccttcaatccgactctactgttcctaaaggttccagcgcaaaatgccataagcaccacattcccttatactggagatcctccatacagccatggaacaggaacaggatacaccatggacacagtcaacagaacacaccaatattcagagaaggggaagtggacgacaaatacagaaacgactcggaccgatg

SEQ ID NO: 4205 - DNA, 203 bp, Homo sapiens
  source 1..203: mol_type = other DNA
ggcgcgccagtcctatggcgtcccaaggcaccaaacggtcttatgaacagatggaaactgatggggaacgccagaatgcaactgagatcagagcatccgtcgggaagatgattgatggaattggacgattctacatccaaatgtgcaccgaacttaaactcagtgattatgaggggcgactgatccagcgactcggaccgatg

SEQ ID NO: 4206 - DNA, 203 bp, Homo sapiens
  source 1..203: mol_type = other DNA
ggcgcgccagtcctctccagcaagtcctccaaactcacctgcgagctctgtaagtactattactttctttaacacttggcacgcacagccacgtgacgaagatgagctcagggaatatgaaagacaagcatcgctcctacaaaagaaaagggagtccagaaagaggggagaggaagagacactggcagcgactcggaccgatg

SEQ ID NO: 4207 - DNA, 203 bp, Homo sapiens
  source 1..203: mol_type = other DNA
ggcgcgccagtcctgacacttagctaatgtttcctcacagacagaagcagacgagataactgacgaggaaatgctttctgctgctgaaagcatggaagcagatgcctccaattaagagacagcctagagggtgggtgctgcctggatacagatatcttgggccatttaatccacttgataacggtgaacgactcggaccgatg

SEQ ID NO: 4208 - DNA, 203 bp, Homo sapiens
  source 1..203: mol_type = other DNA
ggcgcgccagtcctggcttttaaattgcacgtcggtcccagctgatcactggtgccatggccgagctagcctgtttcgtttccttctcactgactgaagataaagtagtatggtatccaattaataaaaaagcagtacaaaccatgttgtgtgctaaagtggaaaaagatcagaggagtaattattatcgactcggaccgatg

SEQ ID NO: 4209 - DNA, 203 bp, Homo sapiens
  source 1..203: mol_type = other DNA
ggcgcgccagtcctggctttaaaaattgcgacaatgtctgattttggaattaatcttgatgccatttgcgacaatgtaaaaaaaggccaaacagaatcaagaactggttctcaattatcaaatcggagttcacgaagaatggattttgttgatgatgaagagttaagtacttactttaactcaaaagccgactcggaccgatg

SEQ ID NO: 4210 - DNA, 203 bp, Homo sapiens
  source 1..203: mol_type = other DNA
ggcgcgccagtcctgtctccatatccgggagttgttggacgcggcgcctagccagggtccctatcctcctgactatacgcctcacggaggcgtctgaggtcatgttcaacatgaacgtggacgagagcgcctctggcgccctcggctcctcggccattcctgttcaccccacgccggcctgggtccgacgactcggaccgatg

SEQ ID NO: 4211 - DNA, 203 bp, Homo sapiens
  source 1..203: mol_type = other DNA
ggcgcgccagtcctacgagctctaccggagcagtcgcctggccatctacatcgaggacctcggtcgaaaatactgccccgcgagcgcgaccgggggagatcatggcatccggcaagcaccatcagcccggggggacacggagcctgaccatgcaaaaagtaagcctgcgcgtgaccccccgcctggtgcgactcggaccgatg

SEQ ID NO: 4212 - DNA, 203 bp, Homo sapiens
  source 1..203: mol_type = other DNA
ggcgcgccagtccttaaacgctcagtataaaaggccggtggacacgtatgatccttgcctaattctaacgggagaggcagaaagatatatggtggacgctgtgggaaattaccgggaagcctccactggaactaccgtactctaccccacgtatgatctgggctccatagttgcggacatggtgacttcgactcggaccgatg

SEQ ID NO: 4213 - DNA, 203 bp, Homo sapiens
  source 1..203: mol_type = other DNA
ggcgcgccagtccttgggaaattaccgggaagcctccactggaactaccgtactctaccccacgtatgatctgggctccatagttgcggacatggtgacttatgaagatgagtagttctaagcgagatctggtggcccagcaactaagagcctcggtagaaaagagagcggctgtgagcgcacgtgaccgactcggaccgatg

SEQ ID NO: 4214 - DNA, 203 bp, Homo sapiens
  source 1..203: mol_type = other DNA
ggcgcgccagtccttataaattactggcgtgaattgtgcccaccagagggtgagcccacctgtctgacttggcccctgtgtacataatactcggggtctcggcacccaggcagccttgcgtggtgctgtcctgctgaagggcgtttcttaggttctcggtcagacggccgcgctgcgaggcatacagccgactcggaccgatg

SEQ ID NO: 4215 - DNA, 203 bp, Homo sapiens
  source 1..203: mol_type = other DNA
ggcgcgccagtcctcgggtgggctggttggggctgcttcccagctagtagcccttggaactgacgggcactgcgtccacctggccaccacatcggacgggcaggcatttttggtgctgcctgggggctttgttattaaaggccaattggcactcacccccgaggagaggggatatattctggcacgtccgactcggaccgatg

SEQ ID NO: 4216 - DNA, 203 bp, Homo sapiens
  source 1..203: mol_type = other DNA
ggcgcgccagtcctaactggtcaggggcagctggaggcatgaaacggaagcaatgtcgtgttgaccggctcagggaccgctcattccctgcatacctcgaggaggtcatgtatgtgatggttcagtagagtattgggtgtggagactagctataaaagaggccgggaggccttctgcgtccagacgcgcgactcggaccgatg

SEQ ID NO: 4217 - DNA, 203 bp, Homo sapiens
  source 1..203: mol_type = other DNA
ggcgcgccagtcctgaggtcatgtatgtgatggttcagtagagtattgggtgtggagactagctataaaagaggccgggaggccttctgcgtccagacgcgatggcacacgccagagacaaggcaggcgctgttatggccatgatactcatctgtgagacaagccttatttggacatctagtggcagtcgactcggaccgatg

SEQ ID NO: 4218 - DNA, 203 bp, Homo sapiens
  source 1..203: mol_type = other DNA
ggcgcgccagtcctcccggatagacctggatgacctgtcagtggcggatgatttatcacgcatgcgtgtgatgatgacctacctacagtctttggcatcactatttaatttggggcctcgcttggccacagcggcatactctcaagagaccctgacggccacttgctggttaagataaagggggtacccgactcggaccgatg

SEQ ID NO: 4219 - DNA, 203 bp, Homo sapiens
  source 1..203: mol_type = other DNA
ggcgcgccagtcctgaggcattccccgcactctcagcctcctcccgggcactcatcgatgagtttatgtctgtcaaacagacccacgcccccatccattacggacactatataattgaagaggtggcgccggtacgaagaatattaaagtttggaaataaggtggttttttgataattgtcaataaagcgactcggaccgatg

SEQ ID NO: 4220 - DNA, 203 bp, Homo sapiens
  source 1..203: mol_type = other DNA
ggcgcgccagtcctggacactatataattgaagaggtggcgccggtacgaagaatattaaagtttggaaataaggtggttttttgataattgtcaataaagatggatttgaaagtggtagtgtctctctcctctcgtctgtataccgatgagattgccaagatgcaacagaggattggctgcatcttacgactcggaccgatg

SEQ ID NO: 4221 - DNA, 203 bp, Homo sapiens
  source 1..203: mol_type = other DNA
ggcgcgccagtcctcgacacgcgtaaaaggtggcctccctgcccagggccgtgtccaaccatttgattagaagggtagcatcctcgggaagtgtgggtgggctgcggttgcaggccagggcgtaaaagagacccagctgtgaagagaagccctcgagacctccccccatctccctcttaccttgtgtccgactcggaccgatg

SEQ ID NO: 4222 - DNA, 203 bp, Homo sapiens
  source 1..203: mol_type = other DNA
ggcgcgccagtcctctgcggttgcaggccagggcgtaaaagagacccagctgtgaagagaagccctcgagacctccccccatctccctcttaccttgtgtcatggcctcaaatgagggtgtggaaaacagacccttcccctatctgacggtggatgccgacctgctctcgaacctgcggcagtcagcgcgactcggaccgatg

SEQ ID NO: 4223 - DNA, 203 bp, Homo sapiens
  source 1..203: mol_type = other DNA
ggcgcgccagtccttagaccccgagtagcacctcaaacttgatgcccgcctctctggcatccttgcccaccagcaggtcaaagctatgaaacaacccctcagccgctgactgccgcaggttcgagagcaggtcggcatccaccgtcagataggggaagggtctgttttccacaccctcatttgaggcccgactcggaccgatg

SEQ ID NO: 4224 - DNA, 203 bp, Homo sapiens
  source 1..203: mol_type = other DNA
ggcgcgccagtcctgccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgccgactcggaccgatg

SEQ ID NO: 4225 - DNA, 203 bp, Homo sapiens
  source 1..203: mol_type = other DNA
ggcgcgccagtcctgctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgcgactcggaccgatg

SEQ ID NO: 4226 - DNA, 203 bp, Homo sapiens
  source 1..203: mol_type = other DNA
ggcgcgccagtcctcctaccttcagtttgtgcttgtggacctctcagagtttcaggacgatttacctggatgctggacggagatttacatgcaggcattgaagaatccggcaatacgatctcagtttttcgattgggctggtctgagcaaggtgatctctgattttgagaggggaaatcgggactaggcgactcggaccgatg

SEQ ID NO: 4227 - DNA, 203 bp, Homo sapiens
  source 1..203: mol_type = other DNA
ggcgcgccagtcctggtcccgggggcagagacaaaaaagaggccagttgctcccagctcttaagagagagcagcttggagtaacaccgaaggtgcgctcgcttacctgccgcctttctagccgggggaagactgtgaaattttgccaggtcgtgtgtggagagggcacacagaccccgggtgggatcccgactcggaccgatg

SEQ ID NO: 4228 - DNA, 203 bp, Homo sapiens
  source 1..203: mol_type = other DNA
ggcgcgccagtccttcgtgtctttcgttttcaggggactcatcctcctgacattttcgccagccgccgggcgggccggcctcctttcctggaaatccagccatggatcccacccggggtctgtgtgccctctccacacacgacctggcaaaatttcacagtcttcccccggctagaaaggcggcaggtcgactcggaccgatg

SEQ ID NO: 4229 - DNA, 203 bp, Homo sapiens
  source 1..203: mol_type = other DNA
ggcgcgccagtcctttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggcgactcggaccgatg

SEQ ID NO: 4230 - DNA, 203 bp, Homo sapiens
  source 1..203: mol_type = other DNA
ggcgcgccagtcctcgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgccgactcggaccgatg

SEQ ID NO: 4231 - DNA, 203 bp, Homo sapiens
  source 1..203: mol_type = other DNA
ggcgcgccagtcctccgaccggagcatccggcaggtgttccaccgtgagtggcaagggcttcttcagagggagctggctcttgacggtgaggggatccaggtgaaggcaggcgtccttgggtggggcgtccgggcgctccacgaagccgcagacgtatacagacggtgcctgcaccattgtgcccgctcgactcggaccgatg

SEQ ID NO: 4232 - DNA, 203 bp, Homo sapiens
  source 1..203: mol_type = other DNA
ggcgcgccagtcctttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacacgactcggaccgatg

SEQ ID NO: 4233 - DNA, 203 bp, Homo sapiens
  source 1..203: mol_type = other DNA
ggcgcgccagtcctagcatcttcaggaggagcccgtgaatcccaggtgtcattcgcgcgtcatccccgcgcacccccagtcccattaacatagcgggcacaatggtgcaggcaccgtctgtatacgtctgcggcttcgtggagcgcccggacgccccacccaaggacgcctgccttcacctggatccccgactcggaccgatg

SEQ ID NO: 4234 - DNA, 203 bp, Homo sapiens
  source 1..203: mol_type = other DNA
ggcgcgccagtccttatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaaccgactcggaccgatg

SEQ ID NO: 4235 - DNA, 203 bp, Homo sapiens
  source 1..203: mol_type = other DNA
ggcgcgccagtccttgaattaaccaatgagaagccccccactcctgagcaaaccttaaggtattgcacagagaccccaaaaagaggataaaagaaggcgagctggcccggctcgccagcgtcgtccagacgctcggggggtgcacacctcccagccggcccggcgtccttgcggcggcctcccccccccgactcggaccgatg

SEQ ID NO: 4236 - DNA, 203 bp, Homo sapiens
  source 1..203: mol_type = other DNA
ggcgcgccagtcctgctgcacatcggccccagcaccagacttggacttgcgctcttctggccggccgagcgaagtgacaacctagacgccgggcggatattctaccagctaacgagcggagagttgtattggggccgcaccgtcgcccgccccccgactctcaccttgcccgtcgacgagctccggcccgactcggaccgatg

SEQ ID NO: 4237 - DNA, 203 bp, Homo sapiens
  source 1..203: mol_type = other DNA
ggcgcgccagtcctctaccagctaacgagcggagagttgtattggggccgcaccgtcgcccgccccccgactctcaccttgcccgtcgacgagctccggccatggccgaagcttaccccggaggagcccatgcagcactagcgtcccggcgctcgtcgttcaggaacagcctccgccgcctgcggccccgactcggaccgatg

SEQ ID NO: 4238 - DNA, 203 bp, Homo sapiens
  source 1..203: mol_type = other DNA
ggcgcgccagtcctccattttatggactctctcaagaaccaggtgacagtcaccgccagatacttcagaagggtgcctagccagtccacctgagtgcgaggatggccctgcaaactgacacacaggcctggcgggtggagatagggaccagaggactaatgttctctaactgtgtcccactccacctgcgactcggaccgatg

SEQ ID NO: 4239 - DNA, 203 bp, Homo sapiens
  source 1..203: mol_type = other DNA
ggcgcgccagtcctgtgggccgcaggcggcggaggctgttcctgaacgacgagcgccgggacgctagtgctgcatgggctcctccggggtaagcttcggccatggccggagctcgtcgacgggcaaggtgagagtcggggggcgggcgacggtgcggccccaatacaactctccgctcgttagctggtcgactcggaccgatg

SEQ ID NO: 4240 - DNA, 203 bp, Homo sapiens
  source 1..203: mol_type = other DNA
ggcgcgccagtcctaactcacagtttattttctccaaatcgctccttgcaacaatggacacgcaagggcgaatgcagaaaatagtctggaagtccaccaggcagggaggtggcatgcaaaataactgactgcctgggcaagttcctcttttgctgcagacaccacccagtctggctctgaccagcaagcgactcggaccgatg

SEQ ID NO: 4241 - DNA, 203 bp, Homo sapiens
  source 1..203: mol_type = other DNA
ggcgcgccagtcctcagggaggtggcatgcaaaataactgactgcctgggcaagttcctcttttgctgcagacaccacccagtctggctctgaccagcaagatgctctccaccatggcccccgggtccaccgtggggaccctggtggccaacatgacttccgtcaatgcaacggaagatgcgtgcactcgactcggaccgatg

SEQ ID NO: 4242 - DNA, 203 bp, Homo sapiens
  source 1..203: mol_type = other DNA
ggcgcgccagtcctccgttttccaggcctacgcagaagacgctatcacgatccagagaccgccgccgcactgcttggggaggcagagactgagttttaaccatgtctgggggactcttctataaccctttcctaagacctaataaaggccttctgaaaaagcctgacaaggagtacctgcgtctcattcgactcggaccgatg

SEQ ID NO: 4243 - DNA, 203 bp, Homo sapiens
  source 1..203: mol_type = other DNA
ggcgcgccagtcctggcggtccttgatcctgcgccgggcggacgcggtcagccccggccaggccctgcccccggatgggctttacctcacgtacgactctgaccgccccctaattcttctgtataagggcagggggtgggtatttaaggatctatatgcccttctctacctgcacctccaaatgagagcgactcggaccgatg

SEQ ID NO: 4244 - DNA, 203 bp, Homo sapiens
  source 1..203: mol_type = other DNA
ggcgcgccagtcctaccgccccctaattcttctgtataagggcagggggtgggtatttaaggatctatatgcccttctctacctgcacctccaaatgagagatgactcggcgtagggtgctaagcgtggtcgtgctgctagccgccctggcgtgccgtctcggtgcgcagaccccagagcagcccgcacgactcggaccgatg

SEQ ID NO: 4245 - DNA, 203 bp, Homo sapiens
  source 1..203: mol_type = other DNA
ggcgcgccagtcctaggagggcagggctccgggggcagacgcaagcgccgtctggccaccgttctccccggactcgaggtctagagacccctggggcggcgatgtcggggctgctggcggcggcgtacagccaggtgtacgccctggcggttgagctgagcgtgtgcacccggctggacccccggagtcgactcggaccgatg

SEQ ID NO: 4246 - DNA, 203 bp, Homo sapiens
  source 1..203: mol_type = other DNA
ggcgcgccagtcctgcggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgacgactcggaccgatg

SEQ ID NO: 4247 - DNA, 203 bp, Homo sapiens
  source 1..203: mol_type = other DNA
ggcgcgccagtcctccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaacgactcggaccgatg

SEQ ID NO: 4248 - DNA, 203 bp, Homo sapiens
  source 1..203: mol_type = other DNA
ggcgcgccagtcctaggctgggcggcatgccaagatcgctgagacgtcagttccccgtgacgtgggccctggccagcctgactgacttcctgaaatctttgtaaatgaataaacagtgggtgttgcgtgatgagtaaagtgtaacatttaatgtgggactgggaggccggggcgataccttgggcatccgactcggaccgatg

SEQ ID NO: 4249 - DNA, 203 bp, Homo sapiens
  source 1..203: mol_type = other DNA
ggcgcgccagtccttaaatgaataaacagtgggtgttgcgtgatgagtaaagtgtaacatttaatgtgggactgggaggccggggcgataccttgggcatcatgcagggtgcacagactagcgaggataatctgggcagccagagccagccgggtccgtgcggctacatctacttttaccccctggcccgactcggaccgatg

SEQ ID NO: 4250 - DNA, 203 bp, Homo sapiens
  source 1..203: mol_type = other DNA
ggcgcgccagtcctaagaaagcggtgacagcctggccggcggccacacaggaggccaacaggaggagctgagcgatgaacctggccattgctctggactctcctcacccaggcctcgcgtcttatactattctgccacgcccattttatcatataagcctgaagcccgtgagctggcctgacgagacccgactcggaccgatg

SEQ ID NO: 4251 - DNA, 203 bp, Homo sapiens
  source 1..203: mol_type = other DNA
ggcgcgccagtcctggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcacgactcggaccgatg

SEQ ID NO: 4252 - DNA, 203 bp, Homo sapiens
  source 1..203: mol_type = other DNA
ggcgcgccagtcctgagacccctgggctctcaggaactccgcccaggtcttgccaattggggtgatcctgtagcgccgcggtttcagcatcacaggttattttgcctgaagcttgctggggcgtaaatccctctcgccttgtttctcagagagcatttcaggccggttttgcagtcgctgctgcagctcgactcggaccgatg

SEQ ID NO: 4253 - DNA, 203 bp, Homo sapiens
  source 1..203: mol_type = other DNA
ggcgcgccagtcctccagacgtcagcagactaagactactcctggtggtactctgtgtcctgtttggacttttatgcctgctcctcatctaagaagccaccatgcgaccgggtagaccactggctggattctacgctactctccgccgttccttcagaagaatgtccaaaaggtcaaagaacaaggcccgactcggaccgatg

SEQ ID NO: 4254 - DNA, 203 bp, Homo sapiens
  source 1..203: mol_type = other DNA
ggcgcgccagtcctttgctctcatgcttataattataattttgatcatctttatcttcagaagagaccttctctgtccacttggagccctttgtatactcctactgatgagtaagtattacaccctttgccccacaccccctttcccttactcttccttctctaacgcactttctcctctttccccagcgactcggaccgatg

SEQ ID NO: 4255 - DNA, 203 bp, Homo sapiens
  source 1..203: mol_type = other DNA
ggcgcgccagtccttactgatgagtaagtattacaccctttgccccacaccccctttcccttactcttccttctctaacgcactttctcctctttccccagtcaccctcctgctcatcgctctctggaatttgcacggacaggcattgttccttggaattgtgctgttcatcttcgggtgcttacttgcgactcggaccgatg

SEQ ID NO: 4256 - DNA, 203 bp, Homo sapiens
  source 1..203: mol_type = other DNA
ggcgcgccagtccttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggcgactcggaccgatg

SEQ ID NO: 4257 - DNA, 203 bp, Homo sapiens
  source 1..203: mol_type = other DNA
ggcgcgccagtcctagttttgcctgaacctgtggttgggcaggtacatgccaacaaccttctaagcacccgcgcttgtgttttgctttatctgccgccatcatgcctacattctatcttgcgttacatgggggacaaacatatcatctaattgttgacacggatagtcttggaaacccgtcactctcacgactcggaccgatg

SEQ ID NO: 4258 - DNA, 203 bp, Homo sapiens
  source 1..203: mol_type = other DNA
ggcgcgccagtcctcgggcccctggtggctcggccgcggtcctcccccgtgaacggggcgcgctgggccgcggctgccccctggacccctaggcctgtgccatggggaccccctgccagtcggcgcggggtcccaggaccacgcccctccctcactgcccccccccctgccttccaggtgcacgggaccgactcggaccgatg

SEQ ID NO: 4259 - DNA, 203 bp, Homo sapiens
  source 1..203: mol_type = other DNA
ggcgcgccagtcctaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagcgactcggaccgatg

SEQ ID NO: 4260 - DNA, 203 bp, Homo sapiens
  source 1..203: mol_type = other DNA
ggcgcgccagtcctgtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttgcgactcggaccgatg

SEQ ID NO: 4261 - DNA, 203 bp, Homo sapiens
  source 1..203: mol_type = other DNA
ggcgcgccagtcctgaactggacgtggtcctgcgcatccacggccttgacctggtacagtcctatcaaacttcccaggtctacgtgtgaaaagtaaacccgatggccccggtcaccccagatgccgtgaatgcacgccaacagcgaccggcagatcccgcattgcgccgcctaatgcatccgcaccaccgactcggaccgatg

SEQ ID NO: 4262 - DNA, 203 bp, Homo sapiens
  source 1..203: mol_type = other DNA
ggcgcgccagtcctccttgtccttgtggcggtgtcccagaaactggtgccgaccccggtattaaaaacccagaagacctcaccttgccacccagatgtgtcatggctcacaaagtcacgagcgcaaacgagccaaaccccctgaccggaaaaagactgtccagctgccccctcacgaggagtggcgtacgactcggaccgatg

SEQ ID NO: 4263 - DNA, 203 bp, Homo sapiens
  source 1..203: mol_type = other DNA
ggcgcgccagtcctgttacgccactcctcgtgagggggcagctggacagtctttttccggtcagggggtttggctcgtttgcgctcgtgactttgtgagccatgacacatctgggtggcaaggtgaggtcttctgggtttttaataccggggtcggcaccagtttctgggacaccgccacaaggacaacgactcggaccgatg

SEQ ID NO: 4264 - DNA, 203 bp, Homo sapiens
  source 1..203: mol_type = other DNA
ggcgcgccagtccttccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagccgactcggaccgatg

SEQ ID NO: 4265 - DNA, 203 bp, Homo sapiens
  source 1..203: mol_type = other DNA
ggcgcgccagtcctgacacgcgagactcgccgtatgcgcgggagccattcacgggtggaacacgtgccccccgagacccgggagacggtggtggggggagcatggcgttattcttcgcgcgccacaccttatctggcacgggtgctggctgtcacggccgtggccctgctcctgatgtttctgaggtgcgactcggaccgatg

SEQ ID NO: 4266 - DNA, 203 bp, Homo sapiens
  source 1..203: mol_type = other DNA
ggcgcgccagtcctggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttcgactcggaccgatg

SEQ ID NO: 4267 - DNA, 203 bp, Homo sapiens
  source 1..203: mol_type = other DNA
ggcgcgccagtcctatctctcggcggctgccgccgccagccgcgtaagaccccggaccagaaggggggcgacaaggcgtcctccccgccccaccgccgaagatgagtaacggcgactgggggcaaagccagcgcacccggggaaccggccccgtgcgcggaatcaggaccatggatgtgaatgccccccgactcggaccgatg

SEQ ID NO: 4268 - DNA, 203 bp, Homo sapiens
  source 1..203: mol_type = other DNA
ggcgcgccagtcctagaattcgtcttgctctattcacccttacttttcttcttgcccgttctctttcttagtatgaatccagtatgcctgcctgtaattgttgcgccctacctcttttggctggcggctattgccgcctcgtgtttcacggcctcagttagtaccgttgtgaccgccaccggcttggccgactcggaccgatg

SEQ ID NO: 4269 - DNA, 203 bp, Homo sapiens
  source 1..203: mol_type = other DNA
ggcgcgccagtcctcgccagacggccgccgcactcagcgaggaggcctgcgcgtgttcctcaaccagcccacgaacgtcccgcgtgaattcggacccccgggaaatatttagacgccgggccggagggggcagcagccccgcgattcggcgttgcagacggcggcgatcgacggacccctggaccttccgactcggaccgatg

SEQ ID NO: 4270 - DNA, 203 bp, Homo sapiens
  source 1..203: mol_type = other DNA
ggcgcgccagtcctccaaagatccccagctccagaggcatcagcgcgcgcaggcgggcagcggggtcgtccccagacagcagcaactgacgcgtcacgcgggcgagccccccgtccacctctgccaggggtggctgggcgtctgcccctccgctaccgccgctgctgtcactctccatagcggacgcccgactcggaccgatg

SEQ ID NO: 4271 - DNA, 203 bp, Homo sapiens
  source 1..203: mol_type = other DNA
ggcgcgccagtcctttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagccgactcggaccgatg

SEQ ID NO: 4272 - DNA, 203 bp, Homo sapiens
  source 1..203: mol_type = other DNA
ggcgcgccagtcctggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctcgactcggaccgatg

SEQ ID NO: 4273 - DNA, 203 bp, Homo sapiens
  source 1..203: mol_type = other DNA
ggcgcgccagtcctcgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcaccgactcggaccgatg

SEQ ID NO: 4274 - DNA, 203 bp, Homo sapiens
  source 1..203: mol_type = other DNA
ggcgcgccagtcctacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatccgactcggaccgatg

SEQ ID NO: 4275 - DNA, 203 bp, Homo sapiens
  source 1..203: mol_type = other DNA
ggcgcgccagtcctgtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacacccgactcggaccgatg

SEQ ID NO: 4276 - DNA, 203 bp, Homo sapiens
  source 1..203: mol_type = other DNA
ggcgcgccagtcctcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttcgactcggaccgatg

SEQ ID NO: 4277 - DNA, 203 bp, Homo sapiens
  source 1..203: mol_type = other DNA
ggcgcgccagtcctcatcacaggccatcacggtcaccttcatgagtcagtgcttcgccggtcgctgtggggccaatcaaccgaccgcccatttctccatcagcgtgcccgcctccagaatcataaatagggctgaggccagtcaagacagcactacatcccagctagcccgtcgtagagacagacaagcgactcggaccgatg

SEQ ID NO: 4278 - DNA, 203 bp, Homo sapiens
  source 1..203: mol_type = other DNA
ggcgcgccagtcctgagccagagcccgcagcacgaccagtctgggagatagaaggccatcgttctgtttagcccgccgttggggcctcccggtcttaaataatgtccgcccccgtcgtcatcaaggcccttgtggcctcaaacactgacattgcggaggccatcctcgatgccatcctctcgcggcctcgactcggaccgatg

SEQ ID NO: 4279 - DNA, 203 bp, Homo sapiens
  source 1..203: mol_type = other DNA
ggcgcgccagtcctgggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgcgactcggaccgatg

SEQ ID NO: 4280 - DNA, 203 bp, Homo sapiens
  source 1..203: mol_type = other DNA
ggcgcgccagtcctagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagcgactcggaccgatg

SEQ ID NO: 4281 - DNA, 203 bp, Homo sapiens
  source 1..203: mol_type = other DNA
ggcgcgccagtcctacataacttcaagttcaacctcttccatgtcactgagacccagttcaaacccagagacactcagcccctccaccagtgacaattcaacgtcacatatgcctttactaacctccgctcacccaacaggtggtgaaaatataacacaggtgacaccagcctctatcagcacacatccgactcggaccgatg

SEQ ID NO: 4282 - DNA, 203 bp, Homo sapiens
  source 1..203: mol_type = other DNA
ggcgcgccagtcctgacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccacccgactcggaccgatg

SEQ ID NO: 4283 - DNA, 203 bp, Homo sapiens
  source 1..203: mol_type = other DNA
ggcgcgccagtcctggcaacagactgcggggaggaggggggcagtgataagtcatgacaattttagatgaggtagaaattttgcatattttcagacccaccatggaatcatttgaaggacagggggactctagacagtcacccgacaatgagcggggagataatgtacagactaccggcgagcatgatcgactcggaccgatg

SEQ ID NO: 4284 - DNA, 203 bp, Homo sapiens
  source 1..203: mol_type = other DNA
ggcgcgccagtccttatgcatgagccacaggcattgctaatgtacctcatagacacacctaaatttagcacgtcccaaaccatgacatcacagaggaggctggtgccttggctttaaaggggagatgttagacaggtaactcactaaacattgcaccttgccggccacctttgctatctttgctgaagcgactcggaccgatg

SEQ ID NO: 4285 - DNA, 203 bp, Homo sapiens
  source 1..203: mol_type = other DNA
ggcgcgccagtcctggtgccttggctttaaaggggagatgttagacaggtaactcactaaacattgcaccttgccggccacctttgctatctttgctgaagatgatggacccaaactcgacttctgaagatgtaaaatttacacctgacccataccaggtgccttttgtacaagcttttgaccaagctcgactcggaccgatg

SEQ ID NO: 4286 - DNA, 203 bp, Homo sapiens
  source 1..203: mol_type = other DNA
ggcgcgccagtcctgcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctccgactcggaccgatg

SEQ ID NO: 4287 - DNA, 203 bp, Homo sapiens
  source 1..203: mol_type = other DNA
ggcgcgccagtcctgcgtctgtttgtgtagtgaggtgttgtgtcctgtatggtattctactttaaaaaggccggctgacatggattactggtcttttatgagccattggcatgggcgggacaatcgcaatataaaaccctgaccatcacatggggcattaggcgactctgcatcagcatcgcttaagtcgactcggaccgatg

SEQ ID NO: 4288 - DNA, 203 bp, Homo sapiens
  source 1..203: mol_type = other DNA
ggcgcgccagtcctattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtcgactcggaccgatg

SEQ ID NO: 4289 - DNA, 203 bp, Homo sapiens
  source 1..203: mol_type = other DNA
ggcgcgccagtcctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgccgactcggaccgatg

SEQ ID NO: 4290 - DNA, 203 bp, Homo sapiens
  source 1..203: mol_type = other DNA
ggcgcgccagtcctccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactcgactcggaccgatg

SEQ ID NO: 4291 - DNA, 203 bp, Homo sapiens
  source 1..203: mol_type = other DNA
ggcgcgccagtcctgagtgagtatgggttttgtgtaaatttattgctaaaatttcattaagcagtgaagtaaaggaattgtgggaattctattgactgtgaatgcaatgtaatgtaacaaattgtatgattatttgggatactattcatagatgtcggcagcgtccgaatgaggaatagatccagtatcgactcggaccgatg

SEQ ID NO: 4292 - DNA, 203 bp, Homo sapiens
  source 1..203: mol_type = other DNA
ggcgcgccagtcctgtgaaggaagttacttcacactcagtccaggtcaaaggtaaatcaggcgcaccttggcaccacctgacacattgtacaccagcaccagcacctgacagaacgctgacagaagtcagaagcgacttgatcgcctccaatttggctataaattctgagagccccgacaactgaagacgactcggaccgatg

SEQ ID NO: 4293 - DNA, 203 bp, Homo sapiens
  source 1..203: mol_type = other DNA
ggcgcgccagtcctgcacctgacagaacgctgacagaagtcagaagcgacttgatcgcctccaatttggctataaattctgagagccccgacaactgaagaatgtggagacgactccattcctcagatgtccgggagggtcacccatggtccaggcgatgcagaacgccatggggtcgactgggatgtcgactcggaccgatg

SEQ ID NO: 4294 - DNA, 203 bp, Homo sapiens
  source 1..203: mol_type = other DNA
ggcgcgccagtcctgccgtcataaaggagctgagctgactctgctggtggcctcgcgtaccactgtggccaggcggtagctgggacgtgcagcccaccaccatggggagcagcaagagcaagcccaaggaccccagccagcgccggcgcagcctggagccacccgacagcacccaccacgggggattccgactcggaccgatg

SEQ ID NO: 4295 - DNA, 203 bp, Homo sapiens
  source 1..203: mol_type = other DNA
ggcgcgccagtccttaaagcaaaaacactattatgtgcattttaccaaggaagcagtaaaatatggacaaaaagggatgtggcaagtgaggactggaactgatgtattatttggtccttcttctatcgctagcacttcgacgggggccgagcaaggtgacaccaccgcacaagtcacccgaagcgccacgactcggaccgatg

SEQ ID NO: 4296 - DNA, 203 bp, Homo sapiens
  source 1..203: mol_type = other DNA
ggcgcgccagtcctatatagactgggaaggaaataaacatttctatgtgcggtttgcagatgaggcaacacaatttgatgcagcaaatgaatggcaagtacgaactgaaagtgaaataatatctaattctgttaccagcacccccccacggagcgacccgaggcctactggatcttctgccatcacctcgactcggaccgatg

SEQ ID NO: 4297 - DNA, 203 bp, Homo sapiens
  source 1..203: mol_type = other DNA
ggcgcgccagtcctgaactgaaagtgaaataatatctaattctgttaccagcacccccccacggagcgacccgaggcctactggatcttctgccatcacctatgaaacttccagacacgacacgaggaggactaggagatctactaaaagaccccgaccgtcccccagcccatccgcgacatcggcgacgactcggaccgatg

SEQ ID NO: 4298 - DNA, 203 bp, Homo sapiens
  source 1..203: mol_type = other DNA
ggcgcgccagtcctctcgattgttacttacacctcaggcagttcctgctgttcaggtccctcctttggttcgtgtcctgacacttcctccaggcacagccctacaaatcttactctcagatgtagggggtcttgtacctttttctgtgccttctgtacatcctgttattcctggcactgtgtttccagcgactcggaccgatg

SEQ ID NO: 4299 - DNA, 203 bp, Homo sapiens
  source 1..203: mol_type = other DNA
ggcgcgccagtccttacaaatcttactctcagatgtagggggtcttgtacctttttctgtgccttctgtacatcctgttattcctggcactgtgtttccagatgtgtctgaacctcctattgttgtggatggttttgatgcatttgatacattttatttgcatccaagtcacagacgcaaacgcaagccgactcggaccgatg

SEQ ID NO: 4300 - DNA, 203 bp, Homo sapiens
  source 1..203: mol_type = other DNA
ggcgcgccagtcctagtatattctgcgtgctaatcgttcaacgttagtccgtggagtgagcttctgttaagttgttaacacgtttgaataatttctactgaaagggtagagaaaaggagttttgcttctcatggcaacaagaggagcaagcaagtctcgggtcacgacccggggcgtcaatatggtgacgactcggaccgatg

SEQ ID NO: 4301 - DNA, 203 bp, Homo sapiens
  source 1..203: mol_type = other DNA
ggcgcgccagtcctttagtccgtggagtgagcttctgttaagttgttaacacgtttgaataatttctactgaaagggtagagaaaaggagttttgcttctcatggcaacaagaggagcaagcaagtctcgggtcacgacccggggcgtcaatatggtgacggccaaggccaagagtctggccgtcaaacgactcggaccgatg

SEQ ID NO: 4302 - DNA, 203 bp, Homo sapiens
  source 1..203: mol_type = other DNA
ggcgcgccagtcctgaaatttccaataaactctggtgtaaggcttagagtgatggtcgaggtgccctatttagggtgaggagcctcggtggcagccccaccaaatcctctattggataggaacagctgtactgggcagttacagcagtcgtatggtaacacatgcggcgttccgaaataccatgcctgcgactcggaccgatg

SEQ ID NO: 4303 - DNA, 203 bp, Homo sapiens
  source 1..203: mol_type = other DNA
ggcgcgccagtcctgcaacagtatttaaaaactgctctgttgtgctgctgtttaagagggcaggcaccggcagtcctcggagttgaaattccatcaacagctttgtctggtgaaggctcccgcctcccccactcaggcctttggtaagcttttcaagagcgtctgtgccgtccattgccggcgtggatcgactcggaccgatg

SEQ ID NO: 4304 - DNA, 203 bp, Homo sapiens
  source 1..203: mol_type = other DNA
ggcgcgccagtccttttgtctggtgaaggctcccgcctcccccactcaggcctttggtaagcttttcaagagcgtctgtgccgtccattgccggcgtggatatgaaggtgcaggctgaaaatgcggctcgcctgggtaggcaagtgttgggtcttttacctccaccaactcaccgggtatccctcactcgactcggaccgatg

SEQ ID NO: 4305 - DNA, 203 bp, Homo sapiens
  source 1..203: mol_type = other DNA
ggcgcgccagtcctccaaccgtgggtcgtgtggacgccgcatatttagagagtaaatcccgcacccccctggcaaactccggtcctctagtgagggatacccggtgagttggtggaggtaaaagacccaacacttgcctacccaggcgagccgcattttcagcctgcaccttcatatccacgccggcacgactcggaccgatg

SEQ ID NO: 4306 - DNA, 203 bp, Homo sapiens
  source 1..203: mol_type = other DNA
ggcgcgccagtcctgtctgccttcgaggcaccggacgacgaactccgttttgtcccactgacgctggcaggcctccggaaactgtttgtcgaatagaggccatggcagcccagcctctgtacatggagggaatggcctccacccaccaagctaactgtatattcggagaacatgctggatcccagtgccgactcggaccgatg

SEQ ID NO: 4307 - DNA, 203 bp, Homo sapiens
  source 1..203: mol_type = other DNA
ggcgcgccagtccttactaattttgaaaggcggggttctgccaggcatagtctttttttgtggcggcccttgtgtaaacctgtctttcagaccttgttggacatcccgtacaatcaagatgttcctgtatgttgtttgcagtctggcggtttgctttcgaggactattaagcctttctctgcaatcgtcgactcggaccgatg

SEQ ID NO: 4308 - DNA, 203 bp, Homo sapiens
  source 1..203: mol_type = other DNA
ggcgcgccagtcctttgggcgggccaggggggtaggactgtgcggattctgggcgcctttcagtggagcttaggccgtgcggtcgcgctggtgagaaggtcatggccctggatcagcgctgggatcgctttcttgtgtcttggtttggtttggatgaggcccagctgacggcccaccgcgtgttcgagcgactcggaccgatg

SEQ ID NO: 4309 - DNA, 203 bp, Homo sapiens
  source 1..203: mol_type = other DNA
ggcgcgccagtcctgccgtattctccgaggcgcgggcacggccctgattgactgcgggtgtcgcgctttgggggccttgccagccccaccccgctgtcgccatgagtgtcgttggtaagcgtgtagtggacgaactgtgtcgggtggtatcctcatacttgggacagtctggtcagtccctggatttgcgactcggaccgatg

SEQ ID NO: 4310 - DNA, 203 bp, Homo sapiens
  source 1..203: mol_type = other DNA
ggcgcgccagtcctggtctttctctttaagggtctccaaaacgccagggtggggaaaaccacctcactagacattattcgggagctaaccgcacaactaaaaagacaccgcctagacctggcccacccctcacagacgtcacacttgtacgcttgagctggtcccgggccttcgcaccccatccaccgcgactcggaccgatg

SEQ ID NO: 4311 - DNA, 203 bp, Homo sapiens
  source 1..203: mol_type = other DNA
ggcgcgccagtccttggtgccctcctccccgggaacctggtgccctcctccccgggaacctggtgccctcctccccgggaacctggtgccctcctccccgggaacctggtgccctcctccccgggaacctggtgccctcctccccgggaacctggtgccctcctccctcctcactccaatcccaatgccgactcggaccgatg

SEQ ID NO: 4312 - DNA, 203 bp, Homo sapiens
  source 1..203: mol_type = other DNA
ggcgcgccagtccttgggatgcgatgtttccgttctacaggcggcagtggaacagatcctaacatctgtttcggactttgatctgcgcattctggacagctattaagcttgtgattttgtttagggcggaaaaataaattttcctttgtttttccacatcggtgccttcacatatacaagccggcacccgactcggaccgatg

SEQ ID NO: 4313 - DNA, 203 bp, Homo sapiens
  source 1..203: mol_type = other DNA
ggcgcgccagtcctattaagcttgtgattttgtttagggcggaaaaataaattttcctttgtttttccacatcggtgccttcacatatacaagccggcaccatggccacttacgaggttctctgtgaggtggcgcggaaactgggcacggatgacagggaagtggtattgttcctcctaaacgtgttccgactcggaccgatg

SEQ ID NO: 4314 - DNA, 203 bp, Homo sapiens
  source 1..203: mol_type = other DNA
ggcgcgccagtcctagtgtctgcgatctccatcctgtggccatgggcggtactgcagcctgctactgtgtgtaaccgcttaattgtctgagagctcccccttgtggtcactacgggtattgcataatgtgaatatactgccaccgcctccataattttactttggttgtcagaccagatttcccgaggcgactcggaccgatg

SEQ ID NO: 4315 - DNA, 203 bp, Homo sapiens
  source 1..203: mol_type = other DNA
ggcgcgccagtccttcaagctactttctgattggtgccccaggcaggactgccataaaaactgaagaaggcgtgtctgctttgcagaatttaccccccactgtgctcccggttgctggcaccggttcagtggtccgacctgtcgtctgtgctcccccgtggacgacgccgagtgcctctcgggggtcccgactcggaccgatg

SEQ ID NO: 4316 - DNA, 203 bp, Homo sapiens
  source 1..203: mol_type = other DNA
ggcgcgccagtcctctggcccaaacggaggatcctaggtgggtgtgcatttattagacgttggtgtgttgaaggacggatcaggcggggaggaggggtgggggagacttactgcagcactaggttaggttgaaagccggggtaaaaggcgtggctaaacaacacctatactacttgttattgtaggcccgactcggaccgatg

SEQ ID NO: 4317 - DNA, 203 bp, Homo sapiens
  source 1..203: mol_type = other DNA
ggcgcgccagtcctgtttcctcttgcgctatgtgggacaactagagtccaacctggcaagcagtggagcaagacgccagacagccgatctcgaaaaaaataatgcagacagaggcaacgttcatcctaggtgactgggagataacggtgtctaactgccggtttacttgcagcagcctaacatgtggccgactcggaccgatg

SEQ ID NO: 4318 - DNA, 203 bp, Homo sapiens
  source 1..203: mol_type = other DNA
ggcgcgccagtccttaaggcagccagccaggcaccatacagcttctacgactgcaaagaagagagctggcacgtggggctcttccagatcaaacacggacctggaggggtctgtacaccaccttgccacgtagcgattagggccgaccgccacgaggaacccatgcaatcgtgactgtccgagcacatcgactcggaccgatg

SEQ ID NO: 4319 - DNA, 203 bp, Homo sapiens
  source 1..203: mol_type = other DNA
ggcgcgccagtcctaaggctggaccctcctctctagttgatatccttccacagggtttgcttgggggtggctatggttccatgggcgtgattaggaaacgttcggctgtttcgtctgcccttatgtttcattaaaagtatataagagcacactgtgtggttggtggtgtttacctataccctcgctgccgactcggaccgatg

SEQ ID NO: 4320 - DNA, 203 bp, Homo sapiens
  source 1..203: mol_type = other DNA
ggcgcgccagtccttcggctgtttcgtctgcccttatgtttcattaaaagtatataagagcacactgtgtggttggtggtgtttacctataccctcgctgcatggatcctacactttactgtgtagttgcggttgataccaaactcgggatcggaaaaaacagatgtctcccgtggcctgcattgcggcgactcggaccgatg

SEQ ID NO: 4321 - DNA, 203 bp, Homo sapiens
  source 1..203: mol_type = other DNA
ggcgcgccagtcctgaccccggttgcctggacgcgtgccctggtacggtcacttgttgcaggggttaatgccatgttttattgtgggttctctctcaggatatggaagatgaggatgttcctgtctgctggatttgcaacgaggagctcggaaatgagagatttagagcctgtggatgcacaggagagcgactcggaccgatg

SEQ ID NO: 4322 - DNA, 203 bp, Homo sapiens
  source 1..203: mol_type = other DNA
ggcgcgccagtcctggattttttggggtgttggccttcgtaataaaagcccaggatcctggagtttacaggtaggcgtcgtagaaccagcactacatcacgtacgtgttttgaaccgagttgagctgtttaccgcgcctgacctaacatcgccgtttcgcatttacacgaggacacacgaggggagttcgactcggaccgatg

SEQ ID NO: 4323 - DNA, 203 bp, Homo sapiens
  source 1..203: mol_type = other DNA
ggcgcgccagtcctcgcaatattttgggttatacataagttacatttggcaacgctggtctttatcgtcgcgtttggggaggaaaagcgcggcgacccctggtcgcctgggcttcaataatttataactaggctgggatttagggtaatgcacccctttgcgcatcatcgttgtggcgccagaactgtcgactcggaccgatg

SEQ ID NO: 4324 - DNA, 203 bp, Homo sapiens
  source 1..203: mol_type = other DNA
ggcgcgccagtccttttccagggaaagcctggatgtaggaaaatagacacacatgtggcgtccgtgaatacgttagacatctgtcaaggcgggatagcgacagtagggcggacggcgggtcggagactaactgggcactctgctcacctcccctttccctttttcagacttccaccccagctgcagagcgactcggaccgatg

SEQ ID NO: 4325 - DNA, 203 bp, Homo sapiens
  source 1..203: mol_type = other DNA
ggcgcgccagtcctagtagggcggacggcgggtcggagactaactgggcactctgctcacctcccctttccctttttcagacttccaccccagctgcagagatggcgtccaaggacgtagaagagggtgtagagggacccatctgctggatatgtagggaagaggtggggaacgagggcatacacccccgactcggaccgatg

SEQ ID NO: 4326 - DNA, 203 bp, Homo sapiens
  source 1..203: mol_type = other DNA
ggcgcgccagtccttggattattaagggtcagcttgaaggatgatgttaatgacataaaggggcgtggcttccaaaaatgggtggctaacctgtccaaaatatgggaacactggagataaaaggggccagcttgagtcagtttagcactgggactgcccagtcaccttggctgccgcttcacctatggcgactcggaccgatg

SEQ ID NO: 4327 - DNA, 203 bp, Homo sapiens
  source 1..203: mol_type = other DNA
ggcgcgccagtcctaagcagttgaggcgcattagatatataaaacttgggtacacacccttggtgctgtgcgcgtgctatgtgccctggtgaccgtccacaatggacgaggacgttttgcctggagaggtgttggccattgaagggatattcatggcctgtggattaaacgaacctgagtacctgtaccgactcggaccgatg

SEQ ID NO: 4328 - DNA, 203 bp, Homo sapiens
  source 1..203: mol_type = other DNA
ggcgcgccagtcctttcgtcagtcccctggagaccttaatggcaaaagctatagatgccagcttcatacgggaccgcctcgacctattgaaaactgacagaggtgtggccagcatattgagcccggcgtatttaaaggccagccaattcccggtcggcatccaagccgtcacaccacccagaccagcccgactcggaccgatg

SEQ ID NO: 4329 - DNA, 203 bp, Homo sapiens
  source 1..203: mol_type = other DNA
ggcgcgccagtcctggtgtggccagcatattgagcccggcgtatttaaaggccagccaattcccggtcggcatccaagccgtcacaccacccagaccagccatgaacagctctggtcaagaggatatcatatccatccccaaatccgccttcctgagcatgctacaaagcagcatcgatggaatgaagcgactcggaccgatg

SEQ ID NO: 4330 - DNA, 203 bp, Homo sapiens
  source 1..203: mol_type = other DNA
ggcgcgccagtccttttccatatgaggccaagtgcattggctattttaggggcggtgaccacgcactatagtgcgcggtgtggcagaaaattcacaccgtatataaacaaggaaaggggactctgcgcgcttaagcgccaagccattatacacacgggttttttgttgtcttggccaatcgtgtctcccgactcggaccgatg

SEQ ID NO: 4331 - DNA, 203 bp, Homo sapiens
  source 1..203: mol_type = other DNA
ggcgcgccagtccttataaacaaggaaaggggactctgcgcgcttaagcgccaagccattatacacacgggttttttgttgtcttggccaatcgtgtctccatggcgctaaagggaccacaaaccctcgaggaaaatattgggtctgcggcccccactggtccctgcgggtacctctatgcctatgtgcgactcggaccgatg

SEQ ID NO: 4332 - DNA, 203 bp, Homo sapiens
  source 1..203: mol_type = other DNA
ggcgcgccagtcctacctgatccggatcgagatagagctcttgctccagcttggggcaggacacaacatctacaaaccctccgacgtacaggccctgtgccatgctcggaaaatacgtgtgtgagaccgagccgctgagcccggggcttaggaggctcatgtggcgctttttgcaaaataagaatttacgactcggaccgatg

SEQ ID NO: 4333 - DNA, 203 bp, Homo sapiens
  source 1..203: mol_type = other DNA
ggcgcgccagtcctacagactttcccgttagtggtttcctctcctcagggaggtcgtccatatccgtgctggttgtggaggtgcttgattcgtcgtccgagctccccaagtcccacctgcctcccctagtcacagaggccttttctccgccgcgccccaccgagtccgctccaaaaccgccttctgcccgactcggaccgatg

SEQ ID NO: 4334 - DNA, 203 bp, Homo sapiens
  source 1..203: mol_type = other DNA
ggcgcgccagtcctctccccaagtcccacctgcctcccctagtcacagaggccttttctccgccgcgccccaccgagtccgctccaaaaccgccttctgccatggtacgtccaaccgaggccgaggttaagaaatccctgagcaggcttccagcagcacgcaaaagagcaggtaaccgggcccacctgcgactcggaccgatg

SEQ ID NO: 4335 - DNA, 203 bp, Homo sapiens
  source 1..203: mol_type = other DNA
ggcgcgccagtcctcactggcgccaccgaacggccgcgtccaacgagcagacaccgccagccgatccccgcgtacgttgcgtccgtccgctggtctaagctatgttacgagttccggacgtgaaggctagtctagtagagggcgccgcgcgcctgtcgacaggcgagcgcgtgtttcacgtcttgacccgactcggaccgatg

SEQ ID NO: 4336 - DNA, 203 bp, Homo sapiens
  source 1..203: mol_type = other DNA
ggcgcgccagtcctttggtatatacgcccagtagcgcttcgaaacggacactgccttctctggcgtccttgccgagcaatagctgaaagctcttgaagagtccgtcggcagccgactccttaatctgcgttaggaggttggcctccgtggcgaggtacgggaaaggtcgttgctccaaggtcgcctcccgactcggaccgatg

SEQ ID NO: 4337 - DNA, 203 bp, Homo sapiens
  source 1..203: mol_type = other DNA
ggcgcgccagtcctccgtcggcagccgactccttaatctgcgttaggaggttggcctccgtggcgaggtacgggaaaggtcgttgctccaaggtcgcctccatggcagcgctcgagggccccctactactgccaccgagcgcctccctgacgacgagtccgcagaccacgtgttatcaagcgacttggcgactcggaccgatg

SEQ ID NO: 4338 - DNA, 203 bp, Homo sapiens
  source 1..203: mol_type = other DNA
ggcgcgccagtccttcattgaagaggtggcgccgatgaagagactattaaagctcggaaacaaggtggtgtattagctaacccttctagcgttggctagtcatggcactcgacaagagtatagtggttaacttcacctccagactcttcgctgatgaactggccgcccttcagtcaaaaatagggagccgactcggaccgatg

SEQ ID NO: 4339 - DNA, 203 bp, Homo sapiens
  source 1..203: mol_type = other DNA
ggcgcgccagtcctgttgagcgtcccagatgacatcaccaggatgcgcgtcatgttctcctatcttcagagtctcagttctatatttaatcttggccccagactgcacgtgtatgcctactcggcagagactttggcggcctcctgttggtattccccacgctaacgatttgaagcgggggggggggtcgactcggaccgatg

SEQ ID NO: 4340 - DNA, 203 bp, Homo sapiens
  source 1..203: mol_type = other DNA
ggcgcgccagtcctactgcacgtgtatgcctactcggcagagactttggcggcctcctgttggtattccccacgctaacgatttgaagcgggggggggggtatggcgtcatctgatattctgtcggttgcaaggacggatgacggctccgtctgtgaagtctccctgcgtggaggtaggaaaaaaactcgactcggaccgatg

SEQ ID NO: 4341 - DNA, 203 bp, Homo sapiens
  source 1..203: mol_type = other DNA
ggcgcgccagtccttgaacaatttttcagtcaaccccttagggagcaagtggtcgcgggggtcagggcactcgacggcctcggtctcgctgactctctatgtcacaaaacagaaagactctgcctgctgatggacctggtgggcacggagtgctttgcgagggtgtgccgcctagacaccggtgcgaacgactcggaccgatg

SEQ ID NO: 4342 - DNA, 203 bp, Homo sapiens
  source 1..203: mol_type = other DNA
ggcgcgccagtcctcggtgagtgtcttcccgtactgggggaggcccaaggcgggtacgccctggtctgtagcatgtatctgcacgttatcgtctccatctattcgacaaaaacggtgtacaacagtatgctatttaaatgcacaaagaataaaaagtacgactgcattgccaagcgggtgcggacaaacgactcggaccgatg

SEQ ID NO: 4343 - DNA, 203 bp, Homo sapiens
  source 1..203: mol_type = other DNA
ggcgcgccagtcctactggttagagattttaaaacagcccgatgtgcaaaagacagtcagcgggagtcttgtggcatgcgtgatcgtcacacccgcattggaagcctggcttgtgttacctgggggttttgctattaaaggccgctatagggcgtcgaaggaggatctggtgttcattcgaggccgctcgactcggaccgatg

SEQ ID NO: 4344 - DNA, 203 bp, Homo sapiens
  source 1..203: mol_type = other DNA
ggcgcgccagtcctaccgaactgtatgagtttattctgtgcaccacgccaataaaagggtgcgccatccgtgccgttttgggacagtgtcgcgtgaatgtcggggcactcagttcccacctctctccggcgtctttggcggtctcctgcaggttggcggcaaggcgctccctgtgacggctgagcagccgactcggaccgatg

SEQ ID NO: 4345 - DNA, 203 bp, Homo sapiens
  source 1..203: mol_type = other DNA
ggcgcgccagtcctggggcactcagttcccacctctctccggcgtctttggcggtctcctgcaggttggcggcaaggcgctccctgtgacggctgagcagcatgtttgctttgagctcgctcgtgtccgagggtgacccggaggtgaccagtaggtacgtcaagggcgtacaacttgccctggaccttcgactcggaccgatg

SEQ ID NO: 4346 - DNA, 203 bp, Homo sapiens
  source 1..203: mol_type = other DNA
ggcgcgccagtccttgaagcgcgaagccgagctcgggactctggtacgcaaggcgggccagaggtttgaggcgctgaaaagggaacggtcaattttgcgccagccgcgcgacctcccacgggtcgccgacattgacgccctggtcgacgccgtcgcggacctcaaagaagaggtggccgtgcgcctagcgactcggaccgatg

SEQ ID NO: 4347 - DNA, 203 bp, Homo sapiens
  source 1..203: mol_type = other DNA
ggcgcgccagtcctagccgcgcgacctcccacgggtcgccgacattgacgccctggtcgacgccgtcgcggacctcaaagaagaggtggccgtgcgcctagatgcgctggaagagaatggagaggagacccccactcactcctcttcggagatcaaggacacaatcgtcaggtggaggcttgacgattcgactcggaccgatg

SEQ ID NO: 4348 - DNA, 203 bp, Homo sapiens
  source 1..203: mol_type = other DNA
ggcgcgccagtccttcaggatcctgtcaactgtaccatcggtggcgatgctttagacccgcacgtggagattcctacgctgctaatcgtaacccccgtctactttccccgaggcgcaaagcatcgtctgcttcaccaagctgccaacttttggtcaagaagtgcgaaggacacctttccatatatcaacgactcggaccgatg

SEQ ID NO: 4349 - DNA, 203 bp, Homo sapiens
  source 1..203: mol_type = other DNA
ggcgcgccagtccttttaaaagtcaaccgcgataggcagtggcatcagattggctctcccgccgcagcgccgcctggcgaaagttaaaaagaccgagaaacatgcgcgcttcaaagagcgaccgttttctcatgtcctcctgggtcaagctgttgtttgtggctgtaattatgtacatttgctctgcacgactcggaccgatg

SEQ ID NO: 4350 - DNA, 203 bp, Homo sapiens
  source 1..203: mol_type = other DNA
ggcgcgccagtcctcggcctatttatatcagactagcagactctttgtgtatataaccgacgtgggacagaaatactgtctagttacaccacccttcgagaatgtccctggaaagggccctggcgagactgactggagtgccaatgagtactcatgccccgaagactcgcgagtcagaagaggcctgtcgactcggaccgatg

SEQ ID NO: 4351 - DNA, 203 bp, Homo sapiens
  source 1..203: mol_type = other DNA
ggcgcgccagtcctttccccgctcctgcagtccccgttattacgtatgccgaaaacggcagaaaggggccttcgtcttccagtggatcgaactctaggtcataccagcccatctccgggggcgaggtagtgatatttgacaacctgtcaatctgttccactacgctcctgactttggcatccgatgtccgactcggaccgatg

SEQ ID NO: 4352 - DNA, 203 bp, Homo sapiens
  source 1..203: mol_type = other DNA
ggcgcgccagtccttaccagcccatctccgggggcgaggtagtgatatttgacaacctgtcaatctgttccactacgctcctgactttggcatccgatgtcatgttgaggatgaacccggggctgggctcgtccatatcagtgcacccttccgagctgtccatctccctctttgagatcctgcaaggccgactcggaccgatg

SEQ ID NO: 4353 - DNA, 203 bp, Homo sapiens
  source 1..203: mol_type = other DNA
ggcgcgccagtcctgactcgtatgtcctccagtcggacaagacgtggtcgtagctacagttggccaatgcattcttgtacaggtggataaatagctgtctgaaaaaaacacccgggtttcgcaggctgcagtgtagagtctgacctctgacataagaatacttgccttgcaggatctcaaagagggagcgactcggaccgatg

SEQ ID NO: 4354 - DNA, 203 bp, Homo sapiens
  source 1..203: mol_type = other DNA
ggcgcgccagtcctaaaaaaacacccgggtttcgcaggctgcagtgtagagtctgacctctgacataagaatacttgccttgcaggatctcaaagagggagatggacagctcggaagggtgcactgatatggacgagcccagccccgggttcatcctcaacatgacatcggatgccaaagtcaggagccgactcggaccgatg

SEQ ID NO: 4355 - DNA, 203 bp, Homo sapiens
  source 1..203: mol_type = other DNA
ggcgcgccagtccttagatgattgcgagttacagtttgtgggcccagaagagccttgccttatccaaggacagtcggtagtggaggagctttttccgtccccgggcgtcccaagcctgacagtgggtaaaaaacgaaaaatcgcatccctgctctctgacctggatttgtagttgtgtacccgtaacgcgactcggaccgatg

SEQ ID NO: 4356 - DNA, 203 bp, Homo sapiens
  source 1..203: mol_type = other DNA
ggcgcgccagtcctgtggactggggcctgttggagcagtaaaggcaataactcgtgtgctttgtaaatttccgcccctagcggtcaaccccgtacaaggccatggcgatgtttgtgaggacctcgtctagcacacacgatgaagagagaatgcttccaattgaaggagcgcctcgcagacgacccccccgactcggaccgatg

SEQ ID NO: 4357 - DNA, 203 bp, Homo sapiens
  source 1..203: mol_type = other DNA
ggcgcgccagtcctcgtgggaaatagacctcacccccgtgtcgcgaaaaggtcaatttcagtaattgtcctcattagtcgggactcgcgcatgcgtgaaccctcactatataaaacagatattacggaagggggctccctggggagcaccgaaccaggcaacacaagggtgaaacccggatttgcccccgactcggaccgatg

SEQ ID NO: 4358 - DNA, 203 bp, Homo sapiens
  source 1..203: mol_type = other DNA
ggcgcgccagtcctccttgcggagtaaggttgactttttaaaggggacgtgtcattgccacccagctactggtttctgggcggggcttaatgagtcgccggtagctgcctggtatttagtggaggataagctgtagctgggtcctatgggggttgggtggggagaccctagcgtacatgtgactgaaccgactcggaccgatg

SEQ ID NO: 4359 - DNA, 203 bp, Homo sapiens
  source 1..203: mol_type = other DNA
ggcgcgccagtccttagctgcctggtatttagtggaggataagctgtagctgggtcctatgggggttgggtggggagaccctagcgtacatgtgactgaacatggaggtgtgtatcccaattccgggtattggagatgaaaattgtgagagctggagggcacagattgtggcattcggtaccacatcgcgactcggaccgatg

SEQ ID NO: 4360 - DNA, 203 bp, Homo sapiens
  source 1..203: mol_type = other DNA
ggcgcgccagtcctctatttgtgaaacaataatgattaaagggggtggtatttcctccgttgtcgactataacctggcgtgtaaacgtgtaaccctgccaaatgcccagaatgaaggacatacctactaagagttccccgggaacggacaattctgagaaagatgaagctgtcattgaggaagatctacgactcggaccgatg

SEQ ID NO: 4361 - DNA, 203 bp, Homo sapiens
  source 1..203: mol_type = other DNA
ggcgcgccagtccttttgtcagtctgagtctggcttcatttgctctcgacgtcattctaaatttgcttgtttcgaacacatattccaccctgggtagaggggcagagtcggactgcattgcagagtgtatataagaggcgaacgcggaacgttggatagacggcttggagcctcggcggttgttcatacgactcggaccgatg

SEQ ID NO: 4362 - DNA, 203 bp, Homo sapiens
  source 1..203: mol_type = other DNA
ggcgcgccagtcctgcagagtcggactgcattgcagagtgtatataagaggcgaacgcggaacgttggatagacggcttggagcctcggcggttgttcataatgacagcgtccacggtggccctggctttatttgtggcctcgatactaggtcactgctgggttacggccaactcgacaggtgtcgcacgactcggaccgatg

SEQ ID NO: 4363 - DNA, 203 bp, Homo sapiens
  source 1..203: mol_type = other DNA
ggcgcgccagtcctgacagccttccagagggtcaccgaggcgcttgtaagcgtggttgccgcgtccaaaaaggtttataccgcaacacgtccaggtgtaccatggagacgacataccgccgcgaggcgctgacagtaagggttattttttgtacgagtggcgacagcgccgagacgatcgccgacgtccgactcggaccgatg

SEQ ID NO: 4364 - DNA, 203 bp, Homo sapiens
  source 1..203: mol_type = other DNA
ggcgcgccagtcctcgctggtttttgactacccaggcaattctgcggctaggcccactaatatgtcagccacctagccgtgatatatagagagcctgtcgcctctctatatctgatggccggtggctccccggcatagctgtgcttaccactggacattgcggcgcgagctagtctggttgcgggacacgactcggaccgatg

SEQ ID NO: 4365 - DNA, 203 bp, Homo sapiens
  source 1..203: mol_type = other DNA
ggcgcgccagtcctctctctatatctgatggccggtggctccccggcatagctgtgcttaccactggacattgcggcgcgagctagtctggttgcgggacaatggacccaggccaaagaccgaacccttttggggcgcctggggcgatacccaaaaaaccttgtttgtcacaagggtcaccgggaacacgactcggaccgatg

SEQ ID NO: 4366 - DNA, 203 bp, Homo sapiens
  source 1..203: mol_type = other DNA
ggcgcgccagtcctttttttcatagcaagaaggggggcactataaggctcagtcgggactgtgcctcaaagacgaacgccgatcggtttctgtgtcggaccatgcctaaagccggtggctcagaatgggccacgttatggattattgatgcccttgaaaacaataagtttccctatttttcctggtttcgactcggaccgatg

SEQ ID NO: 4367 - DNA, 203 bp, Homo sapiens
  source 1..203: mol_type = other DNA
ggcgcgccagtcctccttggtgttggtggataaaaaatatggctggatatttaaagacctgtacgcccttctgtaccaccacctgcaattgagcaaccacaatgactcccaggtctagattggccaccctggggactgtcatcctgttggtctgcttttgcgcaggcgcggcgcactcgaggggtgaccgactcggaccgatg

SEQ ID NO: 4368 - DNA, 203 bp, Homo sapiens
  source 1..203: mol_type = other DNA
ggcgcgccagtcctgccagcgctggagaacacgattcatagtgagaaacacatgtgtctaatacaggcaatgctttttgacccgtgactgaaggttaaagctgcaggaagcatgttgtggtttgcgtagtagattacttctgttgaggtggggtaatgctcggaggcagaccattctgacaggtcaaccgactcggaccgatg

SEQ ID NO: 4369 - DNA, 203 bp, Homo sapiens
  source 1..203: mol_type = other DNA
ggcgcgccagtccttgcaggaagcatgttgtggtttgcgtagtagattacttctgttgaggtggggtaatgctcggaggcagaccattctgacaggtcaacatggcgggacgcaggcttacctggatttctgagtttattgtaggtgctttggactctgataaatatcctttggtcaagtggctagatcgactcggaccgatg

SEQ ID NO: 4370 - DNA, 203 bp, Homo sapiens
  source 1..203: mol_type = other DNA
ggcgcgccagtcctgtgccagtggggttggggtccagctagttgtggcgagaaagtcgcccacggaaaaggtgttttgtgtcgtggcttttgcctaaaaagatgcctcgctacacggagtcggaatggctcacggactttattatagatgctttagacagtggacgcttctggggggtagggtggttgcgactcggaccgatg

SEQ ID NO: 4371 - DNA, 203 bp, Homo sapiens
  source 1..203: mol_type = other DNA
ggcgcgccagtcctggcctcacaagaggcgctcagactcgagccagtccagggatcgtgggaaggtgcccaaaaccacatttaaccccctgatttgacaccatgtgccgcctggacagtgagcgcgctctgtcgctcttcagttatctgagcgggacgttggcggcgaccccctttctgtggtgttttcgactcggaccgatg

SEQ ID NO: 4372 - DNA, 203 bp, Homo sapiens
  source 1..203: mol_type = other DNA
ggcgcgccagtcctacgagctgtatataaatcggcttgtttttggggcggtttgtacgctgggcacagttccctttgattctcatccggtgcaccaaagtctgaacgtgaagggcacgtccttgcctgtactggtgtttgcgaactttgaggccgcgtgtggcccctggactgtgtttctgtaaggtccgactcggaccgatg

SEQ ID NO: 4373 - DNA, 203 bp, Homo sapiens
  source 1..203: mol_type = other DNA
ggcgcgccagtccttctcagcaccgatttctaggcagcaccctctttaataggtgcaaggggggtgcggtgttggtgagtcacactttcgttgcagacaaaatggacaaggacaggccgggtctcccggccccggatgacaacatagaagaagtaccatctacctcgggtgttcaggaacgggcgtctcgactcggaccgatg

SEQ ID NO: 4374 - DNA, 203 bp, Homo sapiens
  source 1..203: mol_type = other DNA
ggcgcgccagtcctgggacattgcagtttcttccccttcctcttctgaaacatcgaatgatgagtgatttcaaccacgtaacaagaactgggatgaaccctcgggcagtatcagactgcggggaggggcagtgataagtcatgacaattttagatgaggtagacattttgcatattttcagacccacccgactcggaccgatg

SEQ ID NO: 4375 - DNA, 203 bp, Homo sapiens
  source 1..203: mol_type = other DNA
ggcgcgccagtcctcgggcagtatcagactgcggggaggggcagtgataagtcatgacaattttagatgaggtagacattttgcatattttcagacccaccatggaatcatttgaaggagagggggactctatacagtcacctgacaatgcgcggggagatgatgtacagaatactggtgagcatattcgactcggaccgatg

SEQ ID NO: 4376 - DNA, 203 bp, Homo sapiens
  source 1..203: mol_type = other DNA
ggcgcgccagtcctaggaggtgtacaagcccggtaccgtggcaatcccccacccgttccaggtcggggaccaagtgcttgtcagacgccatcgacccggcagccttgagcctcggtggaaaggcccgtacctggtgttgctgaccaccccgaccgcggtaaaagtcgacggtatcgctgcctgggtcccgactcggaccgatg

SEQ ID NO: 4377 - DNA, 203 bp, Homo sapiens
  source 1..203: mol_type = other DNA
ggcgcgccagtcctgggagctggaaaaagctgatcatcctcttaagctgcgtattcggcggcggcggaacgagtctgcaaaataaaaacccccaccagcctatgaccctcacctggcagggggaccccattcctgaggagctctataagatgctgagtggccactcgattcgctccttcgatgacctccgactcggaccgatg

SEQ ID NO: 4378 - DNA, 203 bp, Homo sapiens
  source 1..203: mol_type = other DNA
ggcgcgccagtcctgggatcggagacccccacccagggaccaccgacccaccaacgggaggtaagctggccagcgatcgctctgtgtctcgcttctgtgtctaactccgtaactctgactgtccctctgagtgcgcgcattttggtttcagtttgttccgggctgatcgctctgtgagcgacgtgtgacgactcggaccgatg

SEQ ID NO: 4379 - DNA, 203 bp, Homo sapiens
  source 1..203: mol_type = other DNA
ggcgcgccagtccttcggcagaggatcattgtgttctgatcccaccgccgcgtctagagaggcgcgctctgccatctgactctttctcttgcctctacgctactcgatctcgccgccgtttctggtttctttttgttttgtttctgataagcctctgtgtcggagtttctctcttcgaaatcttcgaacgactcggaccgatg

SEQ ID NO: 4380 - DNA, 203 bp, Homo sapiens
  source 1..203: mol_type = other DNA
ggcgcgccagtcctctagagtggacacagcttggatacagacacctttagtattactgggtgttccagactagttcctgaggtaccaagttgtgaggggctatgggaaaacccctttgatccacactgcctgatagggtcgcggctggtcgagtcccatacactataataccagttgactttcatgcacgactcggaccgatg

SEQ ID NO: 4381 - DNA, 203 bp, Homo sapiens
  source 1..203: mol_type = other DNA
ggcgcgccagtcctatgggaaaacccctttgatccacactgcctgatagggtcgcggctggtcgagtcccatacactataataccagttgactttcatgcaatggacactctaactaaaaacattgaagatgaaactgtcaagattattggatcctgtgccgagaaggcacaagaagcaatttctggtcgactcggaccgatg

SEQ ID NO: 4382 - DNA, 203 bp, Homo sapiens
  source 1..203: mol_type = other DNA
ggcgcgccagtcctccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcacccgactcggaccgatg

SEQ ID NO: 4383 - DNA, 203 bp, Homo sapiens
  source 1..203: mol_type = other DNA
ggcgcgccagtcctaatcatttatttgtttgttggttttatacctctgaactttaaagtgctaaagactctcaattttatattatatctcaacaaatcaggatgggcgcacaggtatccacgcagaagactggggcacacgagaccggtttgaacgccagtaataattcggttatacactatacaaatcgactcggaccgatg

SEQ ID NO: 4384 - DNA, 203 bp, Homo sapiens
  source 1..203: mol_type = other DNA
ggcgcgccagtccttccccaaatccgtaggcaggcctcccctgccatctgaatctgaatactggccgcggctccttggttattgtctagtctgtgttgtctggtctgtgtcgacattgtagtcatctttgtgtatgtgtgtgtaagtgtgctggtgtggacgcgtggacaggacaggacgacacagcccgactcggaccgatg

SEQ ID NO: 4385 - DNA, 203 bp, Homo sapiens
  source 1..203: mol_type = other DNA
ggcgcgccagtcctggtctgtgtcgacattgtagtcatctttgtgtatgtgtgtgtaagtgtgctggtgtggacgcgtggacaggacaggacgacacagccatgggacagacattgactactcctctaactttgactctgactcatttctcggacgtccaagcaagagctcacaatctttcccttgagcgactcggaccgatg

SEQ ID NO: 4386 - DNA, 203 bp, Homo sapiens
  source 1..203: mol_type = other DNA
ggcgcgccagtcctgagtagcatggactcgaatcagaagagctggagctcgcttggtacggcacgtagcattgctttgcctaaagaccaagggggtatggctataggtgggggcctatagcttgtccagtgctggttgacagactcgtgctacgcgtctggttcgagtataagtagctgcaactcactcgactcggaccgatg

SEQ ID NO: 4387 - DNA, 203 bp, Homo sapiens
  source 1..203: mol_type = other DNA
ggcgcgccagtcctgggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagacgactcggaccgatg

SEQ ID NO: 4388 - DNA, 203 bp, Homo sapiens
  source 1..203: mol_type = other DNA
ggcgcgccagtccttactgctgaaagaactcgatttctaaattcagtgactttgccaaagggtacaacctacgcatttggttaccttgattcattgtaactatgtataaaaccagaagtaaacgtgacactgctgagaatttgtatagacactgtaaagctactggcaactgtcctccagatgtagaacgactcggaccgatg

SEQ ID NO: 4389 - DNA, 203 bp, Homo sapiens
  source 1..203: mol_type = other DNA
ggcgcgccagtccttgaaaaattagattgtatctttaggggtgagtgtttccatcttgtgagaaacacttggaggggaacgtgcagaaattgttgtagaaaatgattgggaaggagccctcaattaatgatctagaaataaagctggaagaacatgtattgcctgctaaccttttaagcaacgaggttcgactcggaccgatg

SEQ ID NO: 4390 - DNA, 203 bp, Homo sapiens
  source 1..203: mol_type = other DNA
ggcgcgccagtcctctactttgggtgtccgtgtttcttgtttttcatactgggtcgcttatggttacaactaattgttgtaatcattggcagtgcgcgctgaccacgcgattattgatatttccatttgttggatactccaatagtgtcaactcatatacacaacttttaccactgatcaagataaaacgactcggaccgatg

SEQ ID NO: 4391 - DNA, 203 bp, Homo sapiens
  source 1..203: mol_type = other DNA
ggcgcgccagtccttcatcatatagctattggattggccatccggatattattcttgtgtttatttgtgtaatttgatataatttagaaccctgtataagaatgggagctcaagtttcaactcagaggactggctcgcatgaaaacgccaatatggcaatggatggttctaccattaattacaccacccgactcggaccgatg

SEQ ID NO: 4392 - DNA, 203 bp, Homo sapiens
  source 1..203: mol_type = other DNA
ggcgcgccagtccttgccatatagcgattggattggccatccggatattgttttagacacttgtgtttgtgagtagatctcttctgacataggatataacaatgggtgcacaggtttcaacacagaaaactggatcacatgaaaacgccaacatggcagtaggaggctccaccatcaactacaccactcgactcggaccgatg

SEQ ID NO: 4393 - DNA, 203 bp, Homo sapiens
  source 1..203: mol_type = other DNA
ggcgcgccagtcctacacttatcataagaggtgttagttcctaaggataatcaatacacaatattccacgacaattggcgcccaacgtggggctcgaatataagtcgggatatttataaaaatattaattttaatccctagggaccttcgtgcactgcggaaggtataattctactgccttaatagaacgactcggaccgatg

SEQ ID NO: 4394 - DNA, 203 bp, Homo sapiens
  source 1..203: mol_type = other DNA
ggcgcgccagtcctatcctcggacagtgataattttggaccatcttggcaacagacgtactgtaagtgttgacaaccttaagttaacagcttatcaggataatggcacctccaatgactctggaacaatggctcttatggaagaagatgagtcaagcacatcaagcacttgaaaatgtaaccaccttgcgactcggaccgatg

SEQ ID NO: 4395 - DNA, 203 bp, Homo sapiens
  source 1..203: mol_type = other DNA
ggcgcgccagtcctagcggtaagcctcctattctatgcaaaacctattttgataggaataggagttatactgcttattgcccttctttttaagataatatcatggcttcctgggaagcccaagaagaattgagagaacttctacatcatctaccagaggacgatccaccagcagatctaactcatctacgactcggaccgatg

SEQ ID NO: 4396 - DNA, 203 bp, Homo sapiens
  source 1..203: mol_type = other DNA
ggcgcgccagtccttgatagtttgattgatataagagcgagagtggcctccaccggtcaataccccgaggtgtgtgacattcatccagctactggattagacgaatgcgaagctgaggaaatagtcagggttgggaaccttttgtcatacctttaggtcctcttttatcctcctttatagggaacctccgactcggaccgatg

SEQ ID NO: 4397 - DNA, 203 bp, Homo sapiens
  source 1..203: mol_type = other DNA
ggcgcgccagtcctggggcgctgccggcggcgaggagtcctacttcgacatgggggcggacctgcattggcagccgagcccgcgcgccttggaggccgcctacggtccagaggacttggatgaggaagaggaagaggaggaggatgcacccgctgcggggtactgacgcctccgtgatgtgtttttagcgactcggaccgatg

SEQ ID NO: 4398 - DNA, 203 bp, Homo sapiens
  source 1..203: mol_type = other DNA
ggcgcgccagtcctacggtccagaggacttggatgaggaagaggaagaggaggaggatgcacccgctgcggggtactgacgcctccgtgatgtgtttttagatgcagcaagccccggaccccgccataagggcggcgctgcaaagccagccgtccggtctagcatcggacgactgggaggccgcgatgcgactcggaccgatg

SEQ ID NO: 4399 - DNA, 203 bp, Homo sapiens
  source 1..203: mol_type = other DNA
ggcgcgccagtccttcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaacgactcggaccgatg

SEQ ID NO: 4400 - DNA, 203 bp, Homo sapiens
  source 1..203: mol_type = other DNA
ggcgcgccagtcctcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgccgactcggaccgatg

SEQ ID NO: 4401 - DNA, 203 bp, Homo sapiens
  source 1..203: mol_type = other DNA
ggcgcgccagtcctcttgaaacgccccaggaactagacgcagctgcgcttagtcatgtgtaaataaagttgtacaataaaagtctatgtgacgcatgcaaggtgtggtttatgactcatgggcggggcttagtcctatataagtggcaacacctgggcacttgggcacagaccttcagggagttcctgcgactcggaccgatg

SEQ ID NO: 4402 - DNA, 203 bp, Homo sapiens
  source 1..203: mol_type = other DNA
ggcgcgccagtcctgcgccggggccgctcgctcgttctgcccaccgtgcgctaccaccccagcatcctttaattcgtgtgctgtgatactgttgcagagagatggctctcacttgccgcctgcgcatccccgtcccgaattaccgaggaagatcccgccgcaggagaggcatggcaggcagcggcctgcgactcggaccgatg

SEQ ID NO: 4403 - DNA, 203 bp, Homo sapiens
  source 1..203: mol_type = other DNA
ggcgcgccagtcctgccgccgatgctattgaaagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcgactcggaccgatg

SEQ ID NO: 4404 - DNA, 203 bp, Homo sapiens
  source 1..203: mol_type = other DNA
ggcgcgccagtcctctcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagccgactcggaccgatg

SEQ ID NO: 4405 - DNA, 203 bp, Homo sapiens
  source 1..203: mol_type = other DNA
ggcgcgccagtcctggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgccgactcggaccgatg

SEQ ID NO: 4406 - DNA, 203 bp, Homo sapiens
  source 1..203: mol_type = other DNA
ggcgcgccagtcctgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaacgactcggaccgatg

SEQ ID NO: 4407 - DNA, 203 bp, Homo sapiens
  source 1..203: mol_type = other DNA
ggcgcgccagtcctaccaatcgcggccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacacgggtctcccccagccgactcggaccgatg

SEQ ID NO: 4408 - DNA, 203 bp, Homo sapiens
  source 1..203: mol_type = other DNA
ggcgcgccagtcctgctctgttccacaagtactgcgcgctcactcttaaagactaacgcgcgcccacccggaaaaaaggcgggaattacctcatcgccaccatgagcaaggagattcccaccccttacatgtggagctatcagccccagatgggcctggccgcgggcgcctcccaagactactccacacgactcggaccgatg

SEQ ID NO: 4409 - DNA, 203 bp, Homo sapiens
  source 1..203: mol_type = other DNA
ggcgcgccagtcctgtggccccctaccaaggaaaacatggttgggttttctttggcttttgtgatcatggcctgctttatgtcaggtctgctggtaggagctctagtgtggttcctgaaacgcaagcccaggtatggaaatgaggagaaggaaaaattgctataaattctttttcttttcacagcacccgactcggaccgatg

SEQ ID NO: 4410 - DNA, 203 bp, Homo sapiens
  source 1..203: mol_type = other DNA
ggcgcgccagtccttctagtgtggttcctgaaacgcaagcccaggtatggaaatgaggagaaggaaaaattgctataaattctttttcttttcacagcaccatgaatactttgaccagtgtcgtgctgctctctcttcttgtagcttttagtcaggcaggaattattaacttaaatgtatcatggggacgactcggaccgatg

SEQ ID NO: 4411 - DNA, 203 bp, Homo sapiens
  source 1..203: mol_type = other DNA
ggcgcgccagtcctaattccctcagctactgtggcaatcgtggtgggagtgattgcgggctttgtaactctgatcattgtcttcatatgctacatctgctgccgcaagcgtcccaggtcatacaatcatatggtagacccactactcagcttctcttactgaaactcagtcactctcatttcagaacccgactcggaccgatg

SEQ ID NO: 4412 - DNA, 203 bp, Homo sapiens
  source 1..203: mol_type = other DNA
ggcgcgccagtcctccgcaagcgtcccaggtcatacaatcatatggtagacccactactcagcttctcttactgaaactcagtcactctcatttcagaaccatgaaggctttcacagcttgcgttctgattagcatagtcacacttagttcagctgcaatgattaatgttaatgtcactagaggtggtcgactcggaccgatg

SEQ ID NO: 4413 - DNA, 203 bp, Homo sapiens
  source 1..203: mol_type = other DNA
ggcgcgccagtcctccccacctacctcctctttgccctgctcacctgcacctgcgtctgcagcattgtctgcgtggtcatcaccttcctgcagctcatcgactggtgctgcgcgcgctataattatctccaccacagtcccgaatacagggacgagaacgtagccagaatcttaaggctcatctgacccgactcggaccgatg

SEQ ID NO: 4414 - DNA, 203 bp, Homo sapiens
  source 1..203: mol_type = other DNA
ggcgcgccagtcctctggtgctgcgcgcgctataattatctccaccacagtcccgaatacagggacgagaacgtagccagaatcttaaggctcatctgaccatgcagactctgctcatgctgctatccctcctatcccctgccctcgccacttctgctgactctaaatgcaaattcgcggagatatggcgactcggaccgatg

SEQ ID NO: 4415 - DNA, 203 bp, Homo sapiens
  source 1..203: mol_type = other DNA
ggcgcgccagtcctgaaatcagttcccactgattcagtacttagaagagccccctccccggcccccttccactgttagctactttcacataaccggcggcgatgactgaccaccacctggacctcgagatggacggccaggcctccgagcagcgcatcctgcaactgcgcgtccgtcagcagcaggagcgactcggaccgatg

SEQ ID NO: 4416 - DNA, 203 bp, Homo sapiens
  source 1..203: mol_type = other DNA
ggcgcgccagtcctattctgattccgcgcgtagccataggggtagacggggttgaagtcatcttccacccggagcctctttgacatctgagagggaagacaatgaaaattgtggaccaggaatttgacatccctttcaaggtgtggaggaagttcgccgcccgccggggactggaataccagagctggcgactcggaccgatg

SEQ ID NO: 4417 - DNA, 203 bp, Homo sapiens
  source 1..203: mol_type = other DNA
ggcgcgccagtcctaaaaatcacttacttgaaatctgaaagtatgtctctggtgtagttgttcagcagcacctcgttaccctcctcccagctctggtattccagtccccggcgggcggcgaacttcctccacaccttgaaagggatgtcaaattcctggtccacaattttcattgtcttccctctcagcgactcggaccgatg

SEQ ID NO: 4418 - DNA, 203 bp, Homo sapiens
  source 1..203: mol_type = other DNA
ggcgcgccagtcctcgagctcagggcggagggcagaaccttattgaatcttgttgttttgaacacgctgcaggtggtggagcagcaggatctgtttctattatgaaggtctgcctgattatgaaagtggagggggcactgtgggagcttttccacatgtgcggagtggacttacaccaacaatttgtacgactcggaccgatg

SEQ ID NO: 4419 - DNA, 203 bp, Homo sapiens
  source 1..203: mol_type = other DNA
ggcgcgccagtcctgcggagccagctccgagtaacgaatgctgtttctgccctccgtaggagccatataccgcggaggcacaaacggaacctccagggtcgcctgcgccatcacgctctcgtacgagggaggaggagaggaagacaccaccgcacgcctcatctctaacaaggaagagaacgcacgctcgactcggaccgatg

SEQ ID NO: 4420 - DNA, 203 bp, Homo sapiens
  source 1..203: mol_type = other DNA
ggcgcgccagtccttttcgattgcggtgtttttttcgcgaatttccgcgtccgtgtcaaagtccggtgtttatgtcacagatcagctgatccgcagggtatttaaaccagtcgagtccgtcaagaggccactcttgagtgccagcgagtagagatttctctgagctccgctcccagagaccgagaaaacgactcggaccgatg

SEQ ID NO: 4421 - DNA, 203 bp, Homo sapiens
  source 1..203: mol_type = other DNA
ggcgcgccagtcctcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagcgactcggaccgatg

SEQ ID NO: 4422 - DNA, 203 bp, Homo sapiens
  source 1..203: mol_type = other DNA
ggcgcgccagtcctacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctcgactcggaccgatg

SEQ ID NO: 4423 - DNA, 203 bp, Homo sapiens
  source 1..203: mol_type = other DNA
ggcgcgccagtcctaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggcgactcggaccgatg

SEQ ID NO: 4424 - DNA, 203 bp, Homo sapiens
  source 1..203: mol_type = other DNA
ggcgcgccagtcctaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatcccgactcggaccgatg

SEQ ID NO: 4425 - DNA, 203 bp, Homo sapiens
  source 1..203: mol_type = other DNA
ggcgcgccagtccttggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagacgactcggaccgatg

SEQ ID NO: 4426 - DNA, 203 bp, Homo sapiens
  source 1..203: mol_type = other DNA
ggcgcgccagtcctgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatcgactcggaccgatg

SEQ ID NO: 4427 - DNA, 203 bp, Homo sapiens
  source 1..203: mol_type = other DNA
ggcgcgccagtccttatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcgactcggaccgatg

SEQ ID NO: 4428 - DNA, 203 bp, Homo sapiens
  source 1..203: mol_type = other DNA
ggcgcgccagtccttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatcgactcggaccgatg

SEQ ID NO: 4429 - DNA, 203 bp, Homo sapiens
  source 1..203: mol_type = other DNA
ggcgcgccagtccttgcgtcgacctccttatcttctagggtagaggtggtggcaggactgggcggtggaatgcttaagctctgctccttttcctcgtcgctgaggacgagatgtgatggcactcgtggcgatgttgacagcaatggctgagtttccatgtctgttgtttctctgcctaggagaacacacgactcggaccgatg

SEQ ID NO: 4430 - DNA, 203 bp, Homo sapiens
  source 1..203: mol_type = other DNA
ggcgcgccagtcctgaggacgagatgtgatggcactcgtggcgatgttgacagcaatggctgagtttccatgtctgttgtttctctgcctaggagaacacaatggccagccgcgaaggaaatcagttaagcgaccgccacagggagcacacccccgaacgcggaaggggttctgccagtcatccgcctcgactcggaccgatg

SEQ ID NO: 4431 - DNA, 203 bp, Homo sapiens
  source 1..203: mol_type = other DNA
ggcgcgccagtcctaccccctatttgattttggctggaatgctcccaatgcacatgatcatccacaagacccagaggaacacattcccctacaaaacatgcaacatccaatagcgctaatagattacgaaagtgaaccacaacccccactactccctgctattagttacttcaacctaaccggcggagcgactcggaccgatg

SEQ ID NO: 4432 - DNA, 203 bp, Homo sapiens
  source 1..203: mol_type = other DNA
ggcgcgccagtccttcagaacgattagatgcgatggagttttgattacaactgaagccagcattcttttgaccaacttaagagtgtggttgtacttgaactatcacacggaacacgctaagcggcaggatagaaggcgaagaagagtgtgttctgccagggccgcgttttgctatacaaaatacgagacgactcggaccgatg

SEQ ID NO: 4433 - DNA, 203 bp, Homo sapiens
  source 1..203: mol_type = other DNA
ggcgcgccagtccttgtacttttccctggtgacgcagtttcggggtgtgtgttgggtttggcgggattttttacactttactcccattacgtcagtttagggcttgtgtatatatatattgtggagaggttggagagtcactttagagcttgtgctttgtgtgcccgctgtactttgtctggtaagcccgactcggaccgatg

SEQ ID NO: 4434 - DNA, 203 bp, Homo sapiens
  source 1..203: mol_type = other DNA
ggcgcgccagtccttgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtccgactcggaccgatg

SEQ ID NO: 4435 - DNA, 203 bp, Homo sapiens
  source 1..203: mol_type = other DNA
ggcgcgccagtcctctaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatcgactcggaccgatg

SEQ ID NO: 4436 - DNA, 203 bp, Homo sapiens
  source 1..203: mol_type = other DNA
ggcgcgccagtccttgactcttaaagagtagcccttgcccgcgctcattttgaaaacggcgggaatcacgtcacccttggcacctgtcctttgcccttgtcatgagtaaagagattcccacgccttacatgtggagctatcagccccaaatggggttggcagcaggcgcttcccaggactactccacccgactcggaccgatg

SEQ ID NO: 4437 - DNA, 203 bp, Homo sapiens
  source 1..203: mol_type = other DNA
ggcgcgccagtcctttctcctatgattagtcgtccccatatggctctgaatgaaatctaagatctttttttttttctcttacagtatggtgaacatcaatcatgatccctagaaatttcttcttcaccatactcatctgtgcttttaatgtctgtgctactttcacagcagtagccactgcaagcccacgactcggaccgatg

SEQ ID NO: 4438 - DNA, 203 bp, Homo sapiens
  source 1..203: mol_type = other DNA
ggcgcgccagtccttcctgctgacgcagtttcggggtgtgtgttgggcttggcggtatttttttttcactttactcccattacgtcagtttagggcttgtgtatatattgtggagaggttggagagtgtttttagagcttctttagagcttgtgctttgtgcgcccgctgtactttgcctggtaagcccgactcggaccgatg

SEQ ID NO: 4439 - DNA, 203 bp, Homo sapiens
  source 1..203: mol_type = other DNA
ggcgcgccagtcctctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggcgactcggaccgatg

SEQ ID NO: 4440 - DNA, 203 bp, Homo sapiens
  source 1..203: mol_type = other DNA
ggcgcgccagtcctactgtagctaggccttagcgtgccttggatactgcctgatagggcgacggcctagtcgtgtcggttctataggtagcacatacaaatatgcagaactctcatttttctttcgatacagcctctggcacctttgaagatgtaaccggaacaaaagtcaagatcgttgaatacccccgactcggaccgatg

SEQ ID NO: 4441 - DNA, 203 bp, Homo sapiens
  source 1..203: mol_type = other DNA
ggcgcgccagtcctggcttttaaagcgctacagtgatgtctctcagtattgacgtgacgagtcttccttctattccttcaactatatataagaatgaatcgtcttcaacaacgtcaactctttctggaaaatctattggtaggagtgaacagtacatttcaccagatgcagaagcattcaataaataccgactcggaccgatg

SEQ ID NO: 4442 - DNA, 203 bp, Homo sapiens
  source 1..203: mol_type = other DNA
ggcgcgccagtcctggctattaaagctgtacaatggggaagtacaatctaatcttgtcagaatatctatcatttatatataattcacaatctgcagttcaaattccaatatattactcttccaacagtgaattagaaaatagatgtattgaatttcattccaagtgtttagagaactcaaagaatgggcgactcggaccgatg

SEQ ID NO: 4443 - DNA, 203 bp, Homo sapiens
  source 1..203: mol_type = other DNA
ggcgcgccagtcctggcttttaaagcagtaccagtagtgtgttttacctctgatggtgtaaacatgaaagtactagctttaagacacagtgtggctcaagtgtatgcagacactcaagtctacgttcatgatgatacaaaagatagttatgaaaacgcttttttaatctctaatcttacgacccataacgactcggaccgatg

SEQ ID NO: 4444 - DNA, 203 bp, Homo sapiens
  source 1..203: mol_type = other DNA
ggcgcgccagtcctctgttttacgtatgtccatctgcccttccgaggacgaccagtaaccttaccatcatgcttaattgatattaataatcaatgggccattctaggccgagatgtcctccagcaatgccaaagttccctttaccttgcagaccaaccctctcgcgttctaccaatccagacacctagcgactcggaccgatg

SEQ ID NO: 4445 - DNA, 203 bp, Homo sapiens
  source 1..203: mol_type = other DNA
ggcgcgccagtcctttccgtggcgtctcctgaaacgaggtgcatgcccaagacccggagacagcgtaaccaccgaatcaaaacacaaagaccttcaactccatgggtaagtctagtctctttatttgcctcttttgctcatacatggctagtctctttgtccctggcgaccccagtcggtgcacacttcgactcggaccgatg

SEQ ID NO: 4446 - DNA, 203 bp, Homo sapiens
  source 1..203: mol_type = other DNA
ggcgcgccagtcctccttggcgaaatgctccgagcctgtcaggcttggacaccaaaggataagaccaaagttctagtagttcagccccgtaaaacccctccaacacaaccgtgcttccggtgtggaaaggtgggacactggagccgagactgcactcagcctcgcccccctccggggccctgccccctcgactcggaccgatg

SEQ ID NO: 4447 - DNA, 203 bp, Homo sapiens
  source 1..203: mol_type = other DNA
ggcgcgccagtcctcttccgtagggctcccgtgtcccttccctcatgtctaattgacaccaagaatgagtggaccatcatcggccgggacgtcctgcagcaatgccagggggccctttacttaccggaggacctcccggccccgacccagttatccccggtgaccacccctgcagtcatcggcttagacgactcggaccgatg

SEQ ID NO: 4448 - DNA, 203 bp, Homo sapiens
  source 1..203: mol_type = other DNA
ggcgcgccagtcctaccagcgatggaaagggcccgtacaatctctccaggaagcagcaggagcagctctccttcaagtcagtgacggctcgccccagtggatcccttggcggctcctgaagaagactgtatgcccaaaacccgacgaccccgaacccgcagggcacgtcgaaacagaccaccaacacccgactcggaccgatg

SEQ ID NO: 4449 - DNA, 203 bp, Homo sapiens
  source 1..203: mol_type = other DNA
ggcgcgccagtccttcccttggcggctcctgaagaagactgtatgcccaaaacccgacgaccccgaacccgcagggcacgtcgaaacagaccaccaacaccatgggtaacgtactcttcttaactttattggccaccctgggcatcccagtacttcaggccagccggtgtacaatcacggtaggtatccgactcggaccgatg

SEQ ID NO: 4450 - DNA, 203 bp, Homo sapiens
  source 1..203: mol_type = other DNA
ggcgcgccagtcctcagtaggcgcccgtccccccgggggaaacatacaagtgggggctcgtccgggatctgttccgctctcgccgttccccccctcccactatgggtcagacccacacatccagtcccgtccctaaggcccccagggggctctccacccaccactggcttaatttcctgcaggcggctcgactcggaccgatg

SEQ ID NO: 4451 - DNA, 203 bp, Homo sapiens
  source 1..203: mol_type = other DNA
ggcgcgccagtccttaaccacatgccaataatgctgcctaactgtcccctgtaaatgtgtcccttccccaaaatattgttgtatatagttggaatagtaaaatggatgcacagccttctgcaaagcggcgcaaaagggacactgtagaaaatatatatagacattgtgtggggtcaggtacatgtccacgactcggaccgatg

SEQ ID NO: 4452 - DNA, 203 bp, Homo sapiens
  source 1..203: mol_type = other DNA
ggcgcgccagtcctttgaaaaggaggagcaggaagagcaggataagtgtccttaccgggtggtgacagaatgtggggtttgtcataagggattgtgtatgtatgtgttggccacggacgaaggaatcagagggtttgagcaacagctgtgtggagaccttgacattgtgtgtcctgcctgtgccaagccgactcggaccgatg

SEQ ID NO: 4453 - DNA, 203 bp, Homo sapiens
  source 1..203: mol_type = other DNA
ggcgcgccagtccttggctacgtatggggtgatcataaacacgcccaggaagtgacgtatgtcagccaatcagcatcgagcatataacctatataaaccgatgcacttccgcatttcgtcagactgcatccggtctccggcgagtgaacatctctgggaagagctccacacttgtggtgagtcaaattcgactcggaccgatg

SEQ ID NO: 4454 - DNA, 203 bp, Homo sapiens
  source 1..203: mol_type = other DNA
ggcgcgccagtccttgcacttccgcatttcgtcagactgcatccggtctccggcgagtgaacatctctgggaagagctccacacttgtggtgagtcaaattatggctttcaatccacctgttattagagcattctcttcacctgcttttacttatgtcttcaaatttccatatccatcatggaaagaacgactcggaccgatg

SEQ ID NO: 4455 - DNA, 203 bp, Homo sapiens
  source 1..203: mol_type = other DNA
ggcgcgccagtcctttcctgcaactccaccaaattctcctggcagctctgtgagtacttctgccttctttgataattggtgcgcacaaccgcgagacgaagatgagctcagggaatacgaaagacaagcatcgcgcctacaaaagaaaagggagtccagggagagacgagaggaaacgcccatggcaacgactcggaccgatg

SEQ ID NO: 4456 - DNA, 203 bp, Homo sapiens
  source 1..203: mol_type = other DNA
ggcgcgccagtcctcaggtaacctgggggatacggacggagaggactccaagtcagaagcatcggaagtggattattgtccacccaagaaaaggcgtgtgatttcagcaactccaccaaacagtccagtaagtggtccaagcctttctacctttttagatacttggcaatcacaacctagagacgacgcgactcggaccgatg

SEQ ID NO: 4457 - DNA, 203 bp, Homo sapiens
  source 1..203: mol_type = other DNA
ggcgcgccagtcctagtccgtggagtgagcttctattagagtcgttaacacgtttgaataatttctactgaaaggagtagaagaaaggagattcattcccaatggcaacaaaggggatgaataagtctcgggctcgatcccgaggcgtcaatatggtagcggctagagtgaagaacctagccgttaaacgactcggaccgatg

SEQ ID NO: 4458 - DNA, 203 bp, Homo sapiens
  source 1..203: mol_type = other DNA
ggcgcgccagtcctctttgctcactcagcacaggatctgatcaggagatttgtctccggtgctttacaccggagcacaaatttaaaaattgcccaaggcctggcaaataacctaggggactaggttttcttttaatttacacgtctgtcaatatgggtgcaaacaatagcaaggagtctgtgtcaagccgactcggaccgatg

SEQ ID NO: 4459 - DNA, 203 bp, Homo sapiens
  source 1..203: mol_type = other DNA
ggcgcgccagtcctgtggtgacccagcccctctgcttcggcaggggggctttcgctcgctcagcacgagatctgatcaggagcccctcccagtgtgctttacacctggcgaggggttaaaaattgcccaaggcctggcaaaacaacctaggggactaggttttccttttattaataatatctgtcattcgactcggaccgatg

SEQ ID NO: 4460 - DNA, 203 bp, Homo sapiens
  source 1..203: mol_type = other DNA
ggcgcgccagtcctaggaatgcctcgagatgccatgtggacgagggcgtgcccacggtgtatcttaacccaggcgggggccgcttgggtgaaatagggttgttatacaagcctttgggagtacagcctgatagggtgttgcagagacctgctacaccactagtataaaaactctgctgtacatggcaccgactcggaccgatg

SEQ ID NO: 4461 - DNA, 203 bp, Homo sapiens
  source 1..203: mol_type = other DNA
ggcgcgccagtcctctggagaagcattgccagggttacgtcgcggcagaacccggttcgcagacggccgcggcgagcgagcccccttttttcttttgccagatgcatcccgtcctgcgccaaatgcgtcccacccccccggcgaccaccgcaaccgcggccgtagcaggcgccggcgctgtacaacagcgactcggaccgatg

SEQ ID NO: 4462 - DNA, 203 bp, Homo sapiens
  source 1..203: mol_type = other DNA
ggcgcgccagtcctggggcgccgccagcggcgaagagtcccactttgacatgggggcggacctgcattggcagccgagcccgcgcgccttggaggccgcctacggtccagaggacttggatgaggatgaggaagaggaggaggatgcacccgctgcggggtactgacgcctccgtgatgtgtttttagcgactcggaccgatg

SEQ ID NO: 4463 - DNA, 203 bp, Homo sapiens
  source 1..203: mol_type = other DNA
ggcgcgccagtccttgcagcccagactggggcaacggatgttttgaatgcataaaataaaactcaccaaggccatagcgtgcgttctcttccttgttagagatgaggcgcgcggtggtgtcctctcctcctccctcgtacgagagcgtgatggcgcaggcaaccctggaggttccgtttgtgcctccgcgactcggaccgatg

SEQ ID NO: 4464 - DNA, 203 bp, Homo sapiens
  source 1..203: mol_type = other DNA
ggcgcgccagtcctgacgcccgtcgccgcacctgtccctacgtctacaaggccctgggcatagtcgcgccgcgcgtgctctccagtcgcaccttctagaaaatgtccattctcatctcgcccagcaataacaccggctggggtcttactaggcccagcaccatgtacggaggagccaagaagcgctcccgactcggaccgatg

SEQ ID NO: 4465 - DNA, 203 bp, Homo sapiens
  source 1..203: mol_type = other DNA
ggcgcgccagtcctgcgccagggccgctcgtttgttctgcccaccgtgcgctaccaccccagcatcctttaatccgtgtgctgtaatactgttgcagagagatggctctcacttgccgcctgcgcattcccgtcccgaattaccgaggaagatcccgccgcaggagaggcatggcaggcagcggcctacgactcggaccgatg

SEQ ID NO: 4466 - DNA, 203 bp, Homo sapiens
  source 1..203: mol_type = other DNA
ggcgcgccagtccttatcgtgggcctgggagtgaaaagtctgaagcgccgccgatgctattaagagaggaaagaggacactaaagggagagcttaacttgtatgtgccttaccgccagagaacgcgcgaagatggccaccccctcgatgatgccgcagtgggcgtacatgcacatcgccgggcaggaccgactcggaccgatg

SEQ ID NO: 4467 - DNA, 203 bp, Homo sapiens
  source 1..203: mol_type = other DNA
ggcgcgccagtccttagccatgctccagcccagcgttggtttccttctgttcatcctgtgggggttctagacgagccggctcttccaagcccaggtcctgcttgattttgggttgctcgtgggtggttaagttctcctcctcctgctcctgcttacgcggctgctcctccatcttcccctaggaaacacgactcggaccgatg

SEQ ID NO: 4468 - DNA, 203 bp, Homo sapiens
  source 1..203: mol_type = other DNA
ggcgcgccagtcctaatcggtctctgcgctcgctcacccgcagttgcttgtaccacaaaaacgaagatcagctgcagcgcactcttgaagacgccgaggctttgttccacaagtactgcgcgcttactcttaaagactaacgcgcgcccacccggaaaaaaggcgggaattacctcatcgccagcacccgactcggaccgatg

SEQ ID NO: 4469 - DNA, 203 bp, Homo sapiens
  source 1..203: mol_type = other DNA
ggcgcgccagtcctttgttccacaagtactgcgcgcttactcttaaagactaacgcgcgcccacccggaaaaaaggcgggaattacctcatcgccagcaccatgagcaaggagattcccacaccttacatgtggagctatcagccccagatgggcctagccgcgggcgcctcccaggactactccacccgactcggaccgatg

SEQ ID NO: 4470 - DNA, 203 bp, Homo sapiens
  source 1..203: mol_type = other DNA
ggcgcgccagtcctcccttttcaggctccccaggcctctaccccgacgagttcataccgaacttcgacgcagttagagaagcggtcgacggctacgactgaatgtcctatggtgactcggctgagcttgctcggttaaggcatctggaccactgccgccgcctgcgctgctttgcccgggagagctgccgactcggaccgatg

SEQ ID NO: 4471 - DNA, 203 bp, Homo sapiens
  source 1..203: mol_type = other DNA
ggcgcgccagtcctttcggaggtgagctaaggcttcccccttgtaaggagggggttagcccatacaaggtggtcgggtatttaattttaggggcggtcctgggtgggtgcatagcggtgctagcccaactgccttgctgggtggaaatcaatctttatctgctgggttagatattgcggggaggaacccgactcggaccgatg

SEQ ID NO: 4472 - DNA, 203 bp, Homo sapiens
  source 1..203: mol_type = other DNA
ggcgcgccagtcctaggccagtaatcgggaatcctcagcctttccaagtggaagggggtctaaggaatcttcttttttctttttcagtatggtgatcagccatgattcctaggttcttcctatttaacatcctcttctgtctttttaacgtgtgcgctgcctttgcggccgtttcgcacacctcaccccgactcggaccgatg

SEQ ID NO: 4473 - DNA, 203 bp, Homo sapiens
  source 1..203: mol_type = other DNA
ggcgcgccagtcctgccattccccacctaccttctctttgccctgctcacctgcacctgcgtctgcagcattgtctgcctggtcattaccttcctgcagcttatcgactggtgctgcgcgcgctacaattatcttcaccacagtcccgaatacagggacaagaacgtagccaaactcttaaggcttatcgactcggaccgatg

SEQ ID NO: 4474 - DNA, 203 bp, Homo sapiens
  source 1..203: mol_type = other DNA
ggcgcgccagtcctcctgttttgatctcggctggaactctgttggggcatttacatacacactacaaaacagttcaccagccttcacaccgcctccccgcagaaatcagttccccctgattcagtacttagaagagccccctccccggcccccttccactgttagttactttcacataaccgccggcgcgactcggaccgatg

SEQ ID NO: 4475 - DNA, 203 bp, Homo sapiens
  source 1..203: mol_type = other DNA
ggcgcgccagtcctctggatgtgaccgaggagctgcgaccagaccacctggtgatggcctgtaccgggaccgagttcagctccagtggggaggacacagattagaggtaggtttaagtagtgggcgtggctaaggtaagtataaaggcgggtgtcttacaagggtctttttgcttttctgcagacatccgactcggaccgatg

SEQ ID NO: 4476 - DNA, 203 bp, Homo sapiens
  source 1..203: mol_type = other DNA
ggcgcgccagtcctaccgccgctgccgccaggagcgcgtccgcgacaccgcttctaaaagcgcaccgcggcacggtcgtggccccgcgcagctacgggctcatgcaatgcgtggacacggccaccaactcacccgtggagatcaagtaccatctgcatcttaagcacgccctctcccgcctctacgagcgactcggaccgatg

SEQ ID NO: 4477 - DNA, 203 bp, Homo sapiens
  source 1..203: mol_type = other DNA
ggcgcgccagtccttattgtttacttgtttgttggtttcataccattaaattacaaggtcttagaaactctcaactttattttgacactcaatacagcaaaatgggagctcaagtatcaacgcagaagactggggcacatgagactagcttgaacgccaacgggagttcggtcattcactacaccaaccgactcggaccgatg

SEQ ID NO: 4478 - DNA, 203 bp, Homo sapiens
  source 1..203: mol_type = other DNA
ggcgcgccagtccttgttataaaaccatttcctcgtgccttgacctttaacacatttgtgaacttctttaaatcccttttattagtccttaaatactaagaatgggtgcacaagtatccacacaaaaatccggatctcatgaaactggcacttatgccacaggtggatcaacaattaattacacaaatcgactcggaccgatg

SEQ ID NO: 4479 - DNA, 203 bp, Homo sapiens
  source 1..203: mol_type = other DNA
ggcgcgccagtcctgtttacatccagatccaagatcaagagtggcttggaaataaggggcacttgttctttgtctcaaaggacttacaaaaacaagggtgatgaagattaagaaaaagcctccttcagttgcaaggagctaattcttaaaacttcatctagactaaggataaatcgattccaatcacgcgactcggaccgatg

SEQ ID NO: 4480 - DNA, 203 bp, Homo sapiens
  source 1..203: mol_type = other DNA
ggcgcgccagtccttcttatgccacagcttatattaagaaaaagaacttgatgaagattaaggcaaccagtggtgctatcttcatctctttgatttgagtcttaagtgaatacacaggttctaatactgttcttctgtccaacggtataattcagccaggcctaagacagtagctaatcacagtcatccgactcggaccgatg

SEQ ID NO: 4481 - DNA, 203 bp, Homo sapiens
  source 1..203: mol_type = other DNA
ggcgcgccagtcctcatgtaagtattgtctcaccccaagatgatccctggacaccaacaaccccctaacctccccaagttgtcattaagaaaaaatatatgatgaagattaaaaccttcatcagagctatttcttctacgcttggttaggaccagtattcacaaactattttacaatccctacccaatcgactcggaccgatg

SEQ ID NO: 4482 - DNA, 203 bp, Homo sapiens
  source 1..203: mol_type = other DNA
ggcgcgccagtcctcccacatcccattacctcttccaccccctcccgtccaacgcccgcaccatcgtcgagcgtgaggctgactgggatggctgtgatctagaaaagaaatggctcgacctcgtcatagaggacgatgccaagttccttctggagaacggctctctcccgtttggctccacccttgcccgactcggaccgatg

SEQ ID NO: 4483 - DNA, 203 bp, Homo sapiens
  source 1..203: mol_type = other DNA
ggcgcgccagtcctagtccctggaggttggctgactttcttcctatttctcttttcactgcgaattgtgtggattggtattctttagagcttgggagttgtctcatattgaattcatatattttactctatactacactcaaacacggctctctggtcagttaagaaaatcatttatagaataataaacgactcggaccgatg

SEQ ID NO: 4484 - DNA, 203 bp, Homo sapiens
  source 1..203: mol_type = other DNA
ggcgcgccagtccttaacaacaaacataaagataaggggggatgttttaagtgtggaaaacggggtcattttgcaaaagactgtcgtgaacatataaataagcccgtagaagcaaaaactccaggactctgccctaggtgtaaaagaggaaagcattgggctaatgaatgtaaatctaaaactgacagcgactcggaccgatg

SEQ ID NO: 4485 - DNA, 203 bp, Homo sapiens
  source 1..203: mol_type = other DNA
ggcgcgccagtcctacctgttaatctctggggccgcgacttactttctcaaatgaaactcatgatgtgtagtccaaatgatatagtcacggcacaaatgttagcacaaggttattgtcccggaaaaggactaggaaaaaaggaaaatggtattctgcagccccttcaaaatcaaggacaatgtgataacgactcggaccgatg

SEQ ID NO: 4486 - DNA, 203 bp, Homo sapiens
  source 1..203: mol_type = other DNA
ggcgcgccagtcctgttgttgatcccgcgggacgggacatctggcgcccaacgtggggcttggatacgagggaatttgtgaggaagacggcgcagggaccggccggcgattaaaaagcgaaagtacattgtcttagccgccgcgggagcctgccgcgtcggactcagaggtaagtggtgcgctcggaacgactcggaccgatg

SEQ ID NO: 4487 - DNA, 203 bp, Homo sapiens
  source 1..203: mol_type = other DNA
ggcgcgccagtcctggtggtgaaccaaccacttggtggtcgtaatgagcaattctgggacggaaccgactactttggggtgtccgtgtttcttttgttcatattaaactgttttatggtcacaacacaacttggtacgatttgtgattattcactgctcacttgtcacagtaaatatacacaatcatccgactcggaccgatg

SEQ ID NO: 4488 - DNA, 203 bp, Homo sapiens
  source 1..203: mol_type = other DNA
ggcgcgccagtccttacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatcgactcggaccgatg

SEQ ID NO: 4489 - DNA, 203 bp, Homo sapiens
  source 1..203: mol_type = other DNA
ggcgcgccagtcctaggggggcctctagtactagatctatactgcctgatagggtcgcggctggccgaccatgacctgtatagtcagttgatttgagcaatatggttttctttttcgcttctaccaagactaatgagactgctgaatccaaagacaaggtgcccaagcctcgcctcatgtcccaaggccgactcggaccgatg

SEQ ID NO: 4490 - DNA, 203 bp, Homo sapiens
  source 1..203: mol_type = other DNA
ggcgcgccagtcctacctagccaggggcaatgggactgctttgcatatccctaatgaagtattgagatttctctgctcattacccggtgatggttgtgtggggggggccccatacactagatccatactgcctgatagggtcgcggctggccgaccataacctgtatagtcagttgaattcagccaagcgactcggaccgatg

SEQ ID NO: 4491 - DNA, 203 bp, Homo sapiens
  source 1..203: mol_type = other DNA
ggcgcgccagtcctggggggccccatacactagatccatactgcctgatagggtcgcggctggccgaccataacctgtatagtcagttgaattcagccaagatgtgtttctttttccacacaaagaccaacgatattagcccaatgacaagaaagacttctgttgaacgcctcatgtccccagggcctcgactcggaccgatg

SEQ ID NO: 4492 - DNA, 203 bp, Homo sapiens
  source 1..203: mol_type = other DNA
ggcgcgccagtccttcccacccagtgattgttgttgtgacaagaaaattacatagatcatgttttacaacagtattctcatggaatgtgtcggtctggaggatgttgtaccttcctgacggtcgggccatggtgggtcagccttttgtgtgggattttgtctgggtttgtcccgtgggtctcctgatgcgactcggaccgatg

SEQ ID NO: 4493 - DNA, 203 bp, Homo sapiens
  source 1..203: mol_type = other DNA
ggcgcgccagtcctaacatcgatccgctcagatcggcacaaccgaacacggcccccgaagtcgggcatcccaaaaccagacaccaccgcaaagaggacctagacaaagggccaccacagttcaaggcctgcatcaggagacccacgggacaaacccagacaaaatcccacacaaaaggctgacccacccgactcggaccgatg

SEQ ID NO: 4494 - DNA, 203 bp, Homo sapiens
  source 1..203: mol_type = other DNA
ggcgcgccagtccttcaactctcaagatccttcctcttcttactttgttccgctcctcgcctagtcccaacacagcaatcaccaaccagatcgaagaaaccgcggcaggtcgacccaactgagcaacatcgactgcaacttcacacaagcctccaactggcctccaacagataccgcaaagaacccaacgactcggaccgatg

SEQ ID NO: 4495 - DNA, 203 bp, Homo sapiens
  source 1..203: mol_type = other DNA
ggcgcgccagtcctacggcatatcagccaatcaacacagcccaacacaaaggagacacccgacgggacacaaatccaagggtcaggtgatcccgccccaaacacaggactcaaagcccaccagaagggcacaccccagagactccacaggccatccctctccaaaagacccgagacgaactacacggccgactcggaccgatg

SEQ ID NO: 4496 - DNA, 203 bp, Homo sapiens
  source 1..203: mol_type = other DNA
ggcgcgccagtcctcacaggactcaaagcccaccagaagggcacaccccagagactccacaggccatccctctccaaaagacccgagacgaactacacggcatggacaaagtgacggatgccatcatgactgggcgattatcactcgacacaatccctggctttcaatgctctgcgccgacctccaggcgactcggaccgatg

SEQ ID NO: 4497 - DNA, 203 bp, Homo sapiens
  source 1..203: mol_type = other DNA
ggcgcgccagtcctttgctttaccaataacatcgagcttacatactcctcttgaaaatcaagagaggctgagttttgccacgggtgcagaaccgggacaagatggtgcccacctacccgtacagcagcctattagattggagaccaccaccaaacaccctaccatggatcctcaaccttgtggtctttcgactcggaccgatg

SEQ ID NO: 4498 - DNA, 203 bp, Homo sapiens
  source 1..203: mol_type = other DNA
ggcgcgccagtccttaagcatcaatataacttatctgcatctaatccaatctgcttcccagtacttcttatatacttgaaataaagcaatgatgaatattaagaaaaaactaggctagtattgtatagtcttgaccttcttgaaacaaggtagcctagcttgcttaaccggctcttaaagggatcgagcgactcggaccgatg

SEQ ID NO: 4499 - DNA, 203 bp, Homo sapiens
  source 1..203: mol_type = other DNA
ggcgcgccagtcctagaaaaaactaggctagtattgtatagtcttgaccttcttgaaacaaggtagcctagcttgcttaaccggctcttaaagggatcgagatggctgctggtccactaagagccaaagaatgggcaaggagacaattggacaatacaatcagtcatccagttggtccacggccttcgcgactcggaccgatg

SEQ ID NO: 4500 - DNA, 203 bp, Homo sapiens
  source 1..203: mol_type = other DNA
ggcgcgccagtccttagacaatcctgaccgggcaataggactgcattgcatatccttaggtggtattgagaaacctctgccacccaccggcgtggatctctatggggggggccccatagactgggtctatactgcctgatagggtcgcggctggtcgaccactgactgtataaccagttgtactcaaccgactcggaccgatg

SEQ ID NO: 4501 - DNA, 203 bp, Homo sapiens
  source 1..203: mol_type = other DNA
ggcgcgccagtcctgagggaatgggaaaccctccatggccgaatgcagggtgacagcctgccggcggatgcctgttgttagtataatccgttgtttgccacatggattccacagtctcttttccagcatacaccacctactttcctcaccgtatggcaagaatgcacagaatcgccactagtgtacagcgactcggaccgatg

SEQ ID NO: 4502 - DNA, 203 bp, Homo sapiens
  source 1..203: mol_type = other DNA
ggcgcgccagtcctacatgtgtatccgtggaggatcgcccgggactggattccatatcccattgccatcccaacaaacggagggtatacccaccacgtgcgcgtttgcagtgggaatctgcaaatttagtcatactgcctgatagggtgtgggcctgcactttggggtactcaggctgttcatataatcgactcggaccgatg

SEQ ID NO: 4503 - DNA, 203 bp, Homo sapiens
  source 1..203: mol_type = other DNA
ggcgcgccagtcctctactggattggtgattaccaatctgtactagtgttgtattaagacttgttgtgtggagaaaatggactctttcaagaagatttttgatgaagctgcaattgaatctggattttctggcattctcgacccccggctccgcgaaccctattccacttgcttttggcgtttctggtcgactcggaccgatg

SEQ ID NO: 4504 - DNA, 203 bp, Homo sapiens
  source 1..203: mol_type = other DNA
ggcgcgccagtcctagagtagcttaaaacgtatatagacggcctacatattatagaatgcgtatccggaacgccaagcccggacaagtccctgatatatagatgcactgctacataagcctgcaggaggttccatatactatggagataataaaaacagtgtgtgcaagtgttcttaggaaaactccacgactcggaccgatg

SEQ ID NO: 4505 - DNA, 203 bp, Homo sapiens
  source 1..203: mol_type = other DNA
ggcgcgccagtcctaaaccccagccttgagatgctacgtggacgagggcatgcccaagacacaccttaacctggacgggggtcgtccaggtgaaagtacccatctttgggtgctgggagtacagcctgatagggcgctgcagaggcccactgacaggctagtataaaaatctctgctgtacatggaaccgactcggaccgatg

SEQ ID NO: 4506 - DNA, 203 bp, Homo sapiens
  source 1..203: mol_type = other DNA
ggcgcgccagtcctaggaccacgctccgtaatcgagcccaagtactcaaaccccagcacccctgggtcacgccctacgccgcccttttaacgcttcggctaatagggtctatccggcgggttgacaaagggcgcagggttacctggtactacgagcttgggtgtccctgggagtaatcccagggtgcccgactcggaccgatg

SEQ ID NO: 4507 - DNA, 203 bp, Homo sapiens
  source 1..203: mol_type = other DNA
ggcgcgccagtcctatagggtctatccggcgggttgacaaagggcgcagggttacctggtactacgagcttgggtgtccctgggagtaatcccagggtgccatgctgcagcgcaggcgggcgagggtggtgcctcggcctaggggaagagcgcaagtgaccccgtgctgcataaatccccccccttttcgactcggaccgatg

SEQ ID NO: 4508 - DNA, 203 bp, Homo sapiens
  source 1..203: mol_type = other DNA
ggcgcgccagtcctgccggggaccagctgattacttgtcctgcgagttcctcttgagactggccgaaaggcagccacggggccaccaaggcggcgcagcgctgcatgcggcaaggggaaaaatccttcgggtgacccctggtggcaatcccttcccttaggagcatgagtgtggtcgacacattcacccgactcggaccgatg

SEQ ID NO: 4509 - DNA, 203 bp, Homo sapiens
  source 1..203: mol_type = other DNA
ggcgcgccagtcctttgatccagcaaaagataataaatggccatatttagaaagtagggtgacggtatttacatttccacatgcatttccatttgataaaaatggtaatccagtatatgaaataaatgataaaaattggaaatgtttttttgaaaggacatggtccagattagatttgcacgaggacgcgactcggaccgatg

SEQ ID NO: 4510 - DNA, 203 bp, Homo sapiens
  source 1..203: mol_type = other DNA
ggcgcgccagtcctccttgaccatgccttctactgctgcatcctcttacagtaatgttacagtaccattaacatctgcatgggatgtacctatatatactggcccggacattatattgccatcccatactcctatgtggcctagtacatctcctaccaatgcttccaccaccacctatataggtattccgactcggaccgatg

SEQ ID NO: 4511 - DNA, 203 bp, Homo sapiens
  source 1..203: mol_type = other DNA
ggcgcgccagtcctgcccggacattatattgccatcccatactcctatgtggcctagtacatctcctaccaatgcttccaccaccacctatataggtattcatggcacacaatattatttatggccatggtattattattttcctaaaaaacgtaaacgtattccctatttttttgcagatggctttgcgactcggaccgatg

SEQ ID NO: 4512 - DNA, 203 bp, Homo sapiens
  source 1..203: mol_type = other DNA
ggcgcgccagtcctgtaaccacaaccgaaaccaacgatcatccggtgctggtgactcacgcgctgtcaataccgtgacacagagtgccacgtcctccacagatgaatcctcttcagctgttacagccgcttccggcggagatcaaagggactaaattgttagcccactgggattcaggggcaacaatacgactcggaccgatg

SEQ ID NO: 4513 - DNA, 203 bp, Homo sapiens
  source 1..203: mol_type = other DNA
ggcgcgccagtcctttgttggccaattggtccaggagagggtggctaggcctgcttctttgagacctcgttggcataaaccgtctactgtacttaaggtgttgaatccaaggactgttgttattttggaccatcttggcaacaacagaactgtaagtatagataatttaaaacctacttctcatcagacgactcggaccgatg

SEQ ID NO: 4514 - DNA, 203 bp, Homo sapiens
  source 1..203: mol_type = other DNA
ggcgcgccagtcctttgaaagggggcgctagggtctcacccctaacatgccaacgacagtccctgcattgcactccacacttacgttgtgcgtacgcggggcccgatggaccatcgttcacccacctacagctggactcacgacaccgcgtggccattttagctggattgtgcggacgaacaccgcttcgactcggaccgatg

SEQ ID NO: 4515 - DNA, 203 bp, Homo sapiens
  source 1..203: mol_type = other DNA
ggcgcgccagtcctacccgaaacccgcctttcataagttttaccgtctgtcccgacgttaaagggaggtaaccacaagcatactgccgccttccccggcgttaacgggatgcaaccgtaagacacaccttcatccggaagtgaaacggctgcgtcacatagttttgcccgttttcacgagaaatgggacgactcggaccgatg

SEQ ID NO: 4516 - DNA, 203 bp, Homo sapiens
  source 1..203: mol_type = other DNA
ggcgcgccagtcctcacactggtgacaggctaaggatgcccttcaggtaccccgaggtaacacgcgacactcgggatctgagaaggggactggggcttctataaaagcgctcggtttaaaaagcttctatgcctgaataggtgaccggaggtcggcacctttcctttacaattaatgaccctatgaatcgactcggaccgatg

SEQ ID NO: 4517 - DNA, 203 bp, Homo sapiens
  source 1..203: mol_type = other DNA
ggcgcgccagtcctgtcctggtatttgttccatacgaccaagagccactcaatgaagggtggaaggccagcgttcagcgaaagctcaagggagctgggcaatccagcccagcgaccggttcacagaaccaatctggcaacactggcagcataattaacaactactatatgcagcagtaccaaaactcccgactcggaccgatg

SEQ ID NO: 4518 - DNA, 203 bp, Homo sapiens
  source 1..203: mol_type = other DNA
ggcgcgccagtcctgcactttttgattgggttccttcacaaaattttggacacatgcacaaggttgttctgccccacgaaccaaaaggtgtttacgggggtctcgtcaagtcatacgcgtacatgcgcaatggctgggacgtcgaggtgaccgctgttggaaaccagttcaacggcggttgcctcctgcgactcggaccgatg

SEQ ID NO: 4519 - DNA, 203 bp, Homo sapiens
  source 1..203: mol_type = other DNA
ggcgcgccagtcctgtcatggttgtcgcgccactcaccacaaacacagcaggtgcccaacagatcaaagtgtatgccaacatagccccaaccaacgtgcacgtggcgggtgagctcccctccaaggaggggatcttccccgttgcgtgttctgacggttacggcaacatggtgacaactgacccgaaacgactcggaccgatg

SEQ ID NO: 4520 - DNA, 203 bp, Homo sapiens
  source 1..203: mol_type = other DNA
ggcgcgccagtcctgaggctgcccactgcatacacgcagaatgggacactggtctgaactccaagttcacgttttcaatcccgtacatctcggccgctgactacgcgtacaccgcgtcccacgaggctgaaacaacatgtgtacaggggtgggtctgtgtgtaccaaatcactcacggcaaggcagaccgactcggaccgatg

SEQ ID NO: 4521 - DNA, 203 bp, Homo sapiens
  source 1..203: mol_type = other DNA
ggcgcgccagtcctgccgacgcgctcgtcgtctccgcatcagcggggaaagactttgagctccggctacctgtggacgctagacaacaaactacgaccactggtgaatctgctgaccccgtcaccactaccgttgagaactacggaggagagactcaggtccaacgtcgccaccacaccgacgttgcccgactcggaccgatg

SEQ ID NO: 4522 - DNA, 203 bp, Homo sapiens
  source 1..203: mol_type = other DNA
ggcgcgccagtcctggtgcaccagtttctgcacttaacaacacaaccaatcccactgcctaccacaagggcccggtgactcgactggctctcccatacaccgcgccacaccgtgtgttggctacggcgtacactggcactacgacctacaccgccagtgcacgcggggatttggctcacctaacgacgcgactcggaccgatg

SEQ ID NO: 4523 - DNA, 203 bp, Homo sapiens
  source 1..203: mol_type = other DNA
ggcgcgccagtcctacgcatgctcggcatttgccgacatcgttcaactttggtgcagttaaagcagaaacaatcactgagttgctcgtgcgcatgaagcgtgctgaactctattgtcctaggccgattcttccgattcagccaacgggcgatagacacaagcaaccgctcgtcgcacctgcaaaacaacgactcggaccgatg

SEQ ID NO: 4524 - DNA, 203 bp, Homo sapiens
  source 1..203: mol_type = other DNA
ggcgcgccagtcctgaggaactggccagtggagtgaaagccatcaggaccggtctcgatgaggccaaaccctggtacaagcttattaagctcctgagccgcttgtcgtgcatggccgctgtagcagcgcggtcaaaggacccagtccttgtggccatcatgctggctgacaccggtctcgagattctgcgactcggaccgatg

SEQ ID NO: 4525 - DNA, 203 bp, Homo sapiens
  source 1..203: mol_type = other DNA
ggcgcgccagtcctgacagcacgtttgtcgtgaagaagatctccgactcgctctccagtctctttcacgtgccggcccccgccttcagcttcggagccccgattctgttggccgggttggtcaaggtcgcctcgagtttcttccggtccacacccgaagaccttgagagagcagagaaacaactcaaacgactcggaccgatg

SEQ ID NO: 4526 - DNA, 203 bp, Homo sapiens
  source 1..203: mol_type = other DNA
ggcgcgccagtcctgcacgtgacatcaacgacatcttcgccattctcaagaacggcgagtggctggtcaagctgatccttgccatccgcgactggattaaggcatggatcgcctcagaagagaagtttgtcaccatgacagacctggtgcctggtatccttgaaaaacagcgggacctcaacgacccacgactcggaccgatg

SEQ ID NO: 4527 - DNA, 203 bp, Homo sapiens
  source 1..203: mol_type = other DNA
ggcgcgccagtcctcttgcgaacgtgcttgcacaagcaatctccacccacctcaccggcaggaccgattctgtttggtactgcccgcctgaccctgaccacttcgacggttacaaccagcagaccgttgttgtgatggacgatttgggccagaaccctgacggcaaggacttcaagtacttcgcccaacgactcggaccgatg

SEQ ID NO: 4528 - DNA, 203 bp, Homo sapiens
  source 1..203: mol_type = other DNA
ggcgcgccagtcctgccaaggacgggtacaaaatcaacaacaaattggacatcatcaaagcacttgaagacacccacaccaatccagtggcaatgtttcagtacgactgtgcccttctcaacggcatggctgttgaaatgaagagattgcaacaggatatgttcaagcctcaaccacccctccagaaccgactcggaccgatg

SEQ ID NO: 4529 - DNA, 203 bp, Homo sapiens
  source 1..203: mol_type = other DNA
ggcgcgccagtccttccattaaggaggaactccggcccctcatccaacaaacttcatttgtgaaacgtgcttttaagcgcctgaaggagaactttgaaattgttgcactgtgcctaacacttttggccaacattgtcatcatgatccgcgagactcacaagagacagaagatggtggatgatgcggtgcgactcggaccgatg

SEQ ID NO: 4530 - DNA, 203 bp, Homo sapiens
  source 1..203: mol_type = other DNA
ggcgcgccagtcctcaaccgcaagctgaaggaccctacgccgggccactcgagcgtcagagacctctgaaagtgagagccaagctcccgcgacaagagggaccttacgcgggtccgatggagagacagaagccgctgaaagtgaaagcaagagccccggtcgtcaaggaaggaccttatgaaggaccgcgactcggaccgatg

SEQ ID NO: 4531 - DNA, 203 bp, Homo sapiens
  source 1..203: mol_type = other DNA
ggcgcgccagtcctgtgaagaagcctgtcgctttgaaagtgaaagctaagaatttgattgtcactgagagtggtgcccccccgactgacctgcaaaagatggtcatgggcaacacgaagcctgttgagctcatcctcgacgggaagacagtagccatctgctgtgctactggagtgttcggcactgcccgactcggaccgatg

SEQ ID NO: 4532 - DNA, 203 bp, Homo sapiens
  source 1..203: mol_type = other DNA
ggcgcgccagtcctgctaccaaggctggctactgtggaggagccgttcttgctaaggacggagctgacaccttcatcgttggcactcactctgctggaggcaatggagttgggtactgctcatgcgtgtccaggtccatgcttctcaaaatgaaggcacacatcgaccctgaaccgcaccacgaggggcgactcggaccgatg

SEQ ID NO: 4533 - DNA, 203 bp, Homo sapiens
  source 1..203: mol_type = other DNA
ggcgcgccagtcctttgatcgttgataccagagatgtggaagagcgcgtccatgtaatgcgcaaaaccaagcttgcacccaccgtcgcgcacggtgtgttcaatcctgagttcgggcctgccgccttgtctaacaaggacccacgtctgaacgaaggtgttgtcctcgatgaagtcattttctccaagcgactcggaccgatg

SEQ ID NO: 4534 - DNA, 203 bp, Homo sapiens
  source 1..203: mol_type = other DNA
ggcgcgccagtcctcataaaggagacacaaagatgtctgcggaggacaaagcgctgttccgccgctgcgctgctgactacgcgtcacgcctgcacagtgtgctgggtacggcaaatgccccactgagcatttacgaggcaatcaagggcgttgacggactcgacgccatggagccagacaccgcacctcgactcggaccgatg

SEQ ID NO: 4535 - DNA, 203 bp, Homo sapiens
  source 1..203: mol_type = other DNA
ggcgcgccagtcctcccttccagggcctctttgagattccaagctacagatcactttacctgcgttgggtgaacgccgtgtgcggcgacgcataatcccccaaacatcacaattggcacaatgattttggggcgcgcgacgccgtgggagtgaaaagcccgaaagggctttcccggcttccttaatcccgactcggaccgatg

SEQ ID NO: 4536 - DNA, 203 bp, Homo sapiens
  source 1..203: mol_type = other DNA
ggcgcgccagtcctaccacaaacactccagtttgttacactccgctaggaatgctcctggagcaccccccctagcagggcgtgggggatttcccctgcccgtctgcagaagggtggagccaaccaccttagtatgtaggcggcgggactcatgacgctcgcgtgatgacaagcgccaagcttgacttgcgactcggaccgatg

SEQ ID NO: 4537 - DNA, 203 bp, Homo sapiens
  source 1..203: mol_type = other DNA
ggcgcgccagtccttcctgtgtccattaaaacatctgttgaaaggggacaacgagcaaagcgcaaagtccagcgcgatgctcggcctcgtaattacaaaattgctggtatccatgatggcttgcagacattggctcaggctgctttgccagctcatggttggggacgccaagaccctcgccataagtccgactcggaccgatg

SEQ ID NO: 4538 - DNA, 203 bp, Homo sapiens
  source 1..203: mol_type = other DNA
ggcgcgccagtccttcgcaatcttggaatccttctggattaccctttggggtggattggtgatgttacaactcacacacctctagtaggcccgctggtggcaggagcggtcgttcgaccagtctgccagatagtacgcttgctggaggatggagtcaactgggctactggttggttcggtgtccacctcgactcggaccgatg

SEQ ID NO: 4539 - DNA, 203 bp, Homo sapiens
  source 1..203: mol_type = other DNA
ggcgcgccagtcctttgttttgggcgcgcttctggttaccctttgcgtcctgtgctcccatcccagtcgtatctccaagctggctgggatgttttgtctaaagctcaagtagctccttttgctttgattttcttcatctgttgctatctccgctgcaggctacgttatgctgcccttttagggtttgtcgactcggaccgatg

SEQ ID NO: 4540 - DNA, 203 bp, Homo sapiens
  source 1..203: mol_type = other DNA
ggcgcgccagtcctgcccatggctgcgggcttgcccctaactttctttgttgcagcagctgctgcccaaccagattatgactggtgggtgcgactgctagtggcagggttagttttgtgggccggccgtgaccgtggtcaccgcatagctctgcttgtaggtccttggcctctggtagcgcttttaaccgactcggaccgatg

SEQ ID NO: 4541 - DNA, 203 bp, Homo sapiens
  source 1..203: mol_type = other DNA
ggcgcgccagtcctcctcttgcatttggttacgcctgcttcagcttttgacaccgagataattggagggctgacaataccacctgtagtagcattagttgtcatgtctcgttttggcttctttgctcacttgttacctcgctgtgctttagttaactcctatctttggcaacgttgggagaattggttcgactcggaccgatg

SEQ ID NO: 4542 - DNA, 203 bp, Homo sapiens
  source 1..203: mol_type = other DNA
ggcgcgccagtcctggtgcgtctcggaaagtgccatgcttggtattctcattatgttcttaagtttttcctcttagtgtttggtgagaatggtgtgtttttctataagcacttgcatggtgatgtcttgcctaatgattttgcctcgaaactaccattgcaagagccatttttcccttttgaaggcaacgactcggaccgatg

SEQ ID NO: 4543 - DNA, 203 bp, Homo sapiens
  source 1..203: mol_type = other DNA
ggcgcgccagtcctggcaagggtctataggaatgaaggaagacgcttggcgtgtggggacacggttgatggtttgcccgttgttgcgcgtctcggcgaccttgttttcgcagggttagctatgccgccagatgggtgggccattaccgcaccttttacgctgcagtgtctctctgaacgtggcacgctcgactcggaccgatg

SEQ ID NO: 4544 - DNA, 203 bp, Homo sapiens
  source 1..203: mol_type = other DNA
ggcgcgccagtcctcccaataaccgttgacgcggctaatgaccaggacatctatcaaccaccatgtggagctgggtcccttactcggtgctcttgcggggagaccaaggggtatctggtaacacgactggggtcattggttgaggtcaataaatccgatgacccttattggtgtgtgtgcggggccctcgactcggaccgatg

SEQ ID NO: 4545 - DNA, 203 bp, Homo sapiens
  source 1..203: mol_type = other DNA
ggcgcgccagtccttcccatggctgttgccaagggttcttcaggtgccccgattctgtgctcctccgggcatgttattgggatgttcaccgctgctagaaattctggcggttcagtcagccagattagggttaggccgttggtgtgtgctggataccatccccagtacacagcacatgccactcttgacgactcggaccgatg

SEQ ID NO: 4546 - DNA, 203 bp, Homo sapiens
  source 1..203: mol_type = other DNA
ggcgcgccagtcctggacggcgctgacgcctgtcctggcccagagcccagcgaggtgaccagataccaaatgtgcttcactgaagtcaatacttctgggacagccgcactcgctgttggcgttggagtggctatggcttatctagccattgacacttttggcgccacttgtgtgcggcgttgctggtccgactcggaccgatg

SEQ ID NO: 4547 - DNA, 203 bp, Homo sapiens
  source 1..203: mol_type = other DNA
ggcgcgccagtccttattacatcagtccctaccggtgctactgtcgccccagtggttgacgaagaagaaatcgtggaggagtgtgcatcattcattcccttggaggccatggttgctgcaattgacaagctgaagagtacaatcaccacaactagtcctttcacattggaaaccgcccttgaaaaactcgactcggaccgatg

SEQ ID NO: 4548 - DNA, 203 bp, Homo sapiens
  source 1..203: mol_type = other DNA
ggcgcgccagtcctctttattgccactcgtgacatccgcaggaagatactgggcattctggaggcatctaccccctggagtgtcatatcagcttgcatccgttggctccacaccccgacggaggatgattgcggcctcattgcttggggtctagagatttggcagtacgtgtgcaatttctttgtgatcgactcggaccgatg

SEQ ID NO: 4549 - DNA, 203 bp, Homo sapiens
  source 1..203: mol_type = other DNA
ggcgcgccagtcctttgctttaatgtccttaaagctggagttcagagcatggttaacattcctggttgtcctttctacagctgccagaaggggtacaagggcccctggattggatcaggtatgctccaagcacgctgtccatgcggtgctgaactcatcttttctgttgagaatggttttgcaaaactcgactcggaccgatg

SEQ ID NO: 4550 - DNA, 203 bp, Homo sapiens
  source 1..203: mol_type = other DNA
ggcgcgccagtcctagtatcctctccaaatgtctgtttcacccaggtgcccccaaccttgagagctgcagtggccgtggacggcgtacaggttcagtgttatctaggtgagcccaaaactccttggacgacatctgcttgctgttacggtcctgacggtaagggtaaaactgttaagcttcccttccgcgactcggaccgatg

SEQ ID NO: 4551 - DNA, 203 bp, Homo sapiens
  source 1..203: mol_type = other DNA
ggcgcgccagtcctcgttgacggtcacacacctggtgtgcgcatgcaacttaatttgcgtgatgcacttgagacaaatgactgtaattccacaaacaacactcctagtgatgaagccgcagtgtccgctcttgttttcaaacaggagttgcggcgtacaaaccaattgcttgaggcaatttcagctggcgactcggaccgatg

SEQ ID NO: 4552 - DNA, 203 bp, Homo sapiens
  source 1..203: mol_type = other DNA
ggcgcgccagtccttgcttctaaagttctgtctgcaactcgggccatcactagtggtttcctcaaacaaagatcattggtgtatgtgactgagccgcgggatgcggagcttagaaaacaaaaagtcactattaatagacaacctctgttccccccatcataccacaagcaagtgagattggctaaggacgactcggaccgatg

SEQ ID NO: 4553 - DNA, 203 bp, Homo sapiens
  source 1..203: mol_type = other DNA
ggcgcgccagtcctagatgcgtacgggtttgtagatccacgtacccgtgtcaagcgtctgttgtcgatgtggtcacccgatgcagtcggagccacatgcgatacagtgtgttttgacagtaccatcacacccgaggatatcatggtggagacagacatctactcagcagctaaactcagtgaccaacacgactcggaccgatg

SEQ ID NO: 4554 - DNA, 203 bp, Homo sapiens
  source 1..203: mol_type = other DNA
ggcgcgccagtcctccgagctggcattcacaccattgcgaggcagttatacgctggaggaccgatgatcgcttatgatggccgagagatcggatatcgtaggtgtaggtcttccggcgtctatactacctcaagttccaacagtttgacctgctggctgaaggtaaatgctgcagccgaacaggctggcgactcggaccgatg

SEQ ID NO: 4555 - DNA, 203 bp, Homo sapiens
  source 1..203: mol_type = other DNA
ggcgcgccagtcctcatgaagaaccctcgcttccttatttgcggcgatgattgcaccgtaatttggaaaagcgccggagcagatgcagacaaacaagcaatgcgtgtctttgctagctggatgaaggtgatgggtgcaccacaagattgtgtgcctcaacccaaatacagtttggaagaattaacatccgactcggaccgatg

SEQ ID NO: 4556 - DNA, 203 bp, Homo sapiens
  source 1..203: mol_type = other DNA
ggcgcgccagtcctatgctcatcaaatgttacctctggaattaccaaaagtggcaagccttactactttcttacaagagatcctcgtatcccccttggcaggtgctctgccgagggtctgggatacaaccccagtgctgcgtggattgggtatctaatacatcactacccatgtttgtgggttagccgcgactcggaccgatg

SEQ ID NO: 4557 - DNA, 203 bp, Homo sapiens
  source 1..203: mol_type = other DNA
ggcgcgccagtccttgtgttggctgtccatttcatggagcagatgctctttgaggacaaacttcccgagactgtgacctttgactggtatgggaaaaattatacggtgcctgtagaagatctgcccagcatcattgctggtgtgcacggtattgaggctttctcggtggtgcgctacaccaacgctgacgactcggaccgatg

SEQ ID NO: 4558 - DNA, 203 bp, Homo sapiens
  source 1..203: mol_type = other DNA
ggcgcgccagtcctgcaggatttcactcaagacccgggcaagttcacagaaccagtaaaagatatcatgattaaatcactaccagctctcaactcccccacagtagaggagtgcggatacagtgacagggtgagatcaatcacattaggtaactccaccataacgactcaggaatgcgccaacgtggtcgactcggaccgatg

SEQ ID NO: 4559 - DNA, 203 bp, Homo sapiens
  source 1..203: mol_type = other DNA
ggcgcgccagtcctagagaaggtcaactctatggaagcataccagatacctgtgagatccaatgaaggatctggaacgcaagtattcggctttccactgcaaccagggtactcgagtgtttttagtcggacgctcctaggagagatcttgaactattatacacattggtcaggcagcataaagcttaccgactcggaccgatg

SEQ ID NO: 4560 - DNA, 203 bp, Homo sapiens
  source 1..203: mol_type = other DNA
ggcgcgccagtcctgcaaaactttttccagggcccagtggaagacgcgataacagccgctatagggagagttgcggataccgtgggtacagggccaaccaactcagaagctataccagcactcactgctgctgagacaggtcacacgtcacaagtagtgccgggtgacaccatgcagacacgccacgtcgactcggaccgatg

SEQ ID NO: 4561 - DNA, 203 bp, Homo sapiens
  source 1..203: mol_type = other DNA
ggcgcgccagtcctgttcgacctggagctgacgtttgtcataacaagtactcaacagccctcaaccacacagaaccaagacgcacagatcctaacacaccaaattatgtacgtaccaccaggtggacctgtaccagataaagttgattcatacgtgtggcaaacatctacgaatcccagtgtgttttgcgactcggaccgatg

SEQ ID NO: 4562 - DNA, 203 bp, Homo sapiens
  source 1..203: mol_type = other DNA
ggcgcgccagtcctgaccgagggaaacgccccgccgcgcatgtccataccgtttttgagcattggcaacgcctattcaaatttctatgacggatggtctgaattttccaggaacggagtttacggcatcaacacgctaaacaacatgggcacgctatatgcaagacatgtcaacgctggaagcacgggcgactcggaccgatg

SEQ ID NO: 4563 - DNA, 203 bp, Homo sapiens
  source 1..203: mol_type = other DNA
ggcgcgccagtcctggtgtcacaatattacggaatccctatggctgaacgccaaaacaatagctggcttaagaaatttactgaaatgacgaatgcttgcaagggtatggaatggatagctgtcaaaattcagaaattcattgaatggctcaaagtaaaaattttgccagaggtcagggaaaaacacgacgactcggaccgatg

SEQ ID NO: 4564 - DNA, 203 bp, Homo sapiens
  source 1..203: mol_type = other DNA
ggcgcgccagtcctattcctgaacagacttaaacaactccccttattagaaagtcagatcgccacaatcgagcagagcgcgccatcccaaagtgaccaggaacaattattttccaatgtccaatactttgcccactattgcagaaagtacgctcccctctacgcagctgaagcaaagagggtgttctccgactcggaccgatg

SEQ ID NO: 4565 - DNA, 203 bp, Homo sapiens
  source 1..203: mol_type = other DNA
ggcgcgccagtcctcttagaactgacactactcaaattgaaccggaatgagaagttcagagacatcagaggcttcttagccaaggaggaagtggaggttaatgaggcagtgctagcaattaacaccagcaagtttcccaacatgtacattccagtaggacaggtcacagaatacggcttcttaaacctcgactcggaccgatg

SEQ ID NO: 4566 - DNA, 203 bp, Homo sapiens
  source 1..203: mol_type = other DNA
ggcgcgccagtcctaggtggcacacccaccaagagaatgcttatgtacaacttccccacaagagcaggccagtgtggtggagtgctcatgtccaccggcaaggtactgggtatccatgttggtggaaatggccatcagggcttctcagcagcactcctcaaacactacttcaatgatgagcaaggtgacgactcggaccgatg

SEQ ID NO: 4567 - DNA, 203 bp, Homo sapiens
  source 1..203: mol_type = other DNA
ggcgcgccagtccttggtaccagtattttcaactcaatgattaacaatatcataattaggacactaatgctaaaagtgtacaaagggattgacttggaccaattcaggatgatcgcatatggtgatgatgtgatcgcatcgtacccatggcctatagatgcatctttactcgctgaagctggtaagggcgactcggaccgatg

SEQ ID NO: 4568 - DNA, 203 bp, Homo sapiens
  source 1..203: mol_type = other DNA
ggcgcgccagtcctaaagaacacccaagatcacgtgcgctcactgtgtctattagcttggcataacggggagcacgaatatgaggagttcatccgtaaaattagaagcgtcccagtcggacgttgtttgaccctccccgcgttttcaactctacgcaggaagtggttggactccttttagattagagacgactcggaccgatg

SEQ ID NO: 4569 - DNA, 203 bp, Homo sapiens
  source 1..203: mol_type = other DNA
ggcgcgccagtcctagcgtcccagtcggacgttgtttgaccctccccgcgttttcaactctacgcaggaagtggttggactccttttagattagagacaatttgaaataatttagattggcttaaccctactgtgctaaccgaaccagataacggtacagtaggggtaaattctccgcattcggtgcgcgactcggaccgatg

SEQ ID NO: 4570 - DNA, 203 bp, Homo sapiens
  source 1..203: mol_type = other DNA
ggcgcgccagtccttaagcagagccttaagcaggacccagacaagtttgcaaatcctgtcaaagacatcttcactgaaatggcagcgccattaaaatctccatctgccgaggcatgtggttacagcgatcgggtggcacaattaactattggcaattctaccatcactacgcaagaagcagcaaacatcgactcggaccgatg

SEQ ID NO: 4571 - DNA, 203 bp, Homo sapiens
  source 1..203: mol_type = other DNA
ggcgcgccagtcctcatagttggctatggtgagtggccttcctactgttcggactctgatgctactgcagtggacaaaccaacgcgcccagatgtttcggtgaataggttttacacattggacacaaaattgtgggagaaatcatccaaggggtggtactggaaattcccggatgtgttaactgaaaccgactcggaccgatg

SEQ ID NO: 4572 - DNA, 203 bp, Homo sapiens
  source 1..203: mol_type = other DNA
ggcgcgccagtccttatggctaccggcaagatgctcatagcatacacaccaccaggaggccccttacccaaggaccgggcgaccgccatgttgggcacggacgtcatctgggactttgggctgcaatcgtctgtcactcttgtaataccatggatcagcaacactcattacagagcgcacgctcgagacgactcggaccgatg

SEQ ID NO: 4573 - DNA, 203 bp, Homo sapiens
  source 1..203: mol_type = other DNA
ggcgcgccagtccttggtgtgtttgactactacactacaggtttggttagcatatggtaccagacgaattatgtggttccaattggagcacccaatacagcctatataatagcattggcggcagcccagaagaacttcaccatgaagttgtgtaaggatgctagtgatatcctacagacaggcactatcgactcggaccgatg

SEQ ID NO: 4574 - DNA, 203 bp, Homo sapiens
  source 1..203: mol_type = other DNA
ggcgcgccagtcctccagggagatagggtggcagatgtgattgagagttctataggggacagcgtgagcagagccctcacccgagctctaccggcacctaccggccaagacacacaggtaagcagccatcgattagatactggtaaaggtccagcactccaagccgctgaaattggagcatcatcaaacgactcggaccgatg

SEQ ID NO: 4575 - DNA, 203 bp, Homo sapiens
  source 1..203: mol_type = other DNA
ggcgcgccagtccttgctagtgatgagagtatgattgagacacggtgtgttcttaattcacatagcacagctgagaccactcttgatagcttcttcagcagagcaggattagttggagagatagacctccctcttgaaggcacaaccaacccgaatgggtacgcaaactgggacatagacataacaggcgactcggaccgatg

SEQ ID NO: 4576 - DNA, 203 bp, Homo sapiens
  source 1..203: mol_type = other DNA
ggcgcgccagtccttacgttctcagtgcggactgtaggcacctcgaagtccaagtgcccattggtgatcaggatttacatgaggatgaagcacgtcagggcgtggatacctcgcccaatgcgtaaccagaactatctattcaaagccaacccaaattatgctggtaattctattaaaccaactggtgccgactcggaccgatg

SEQ ID NO: 4577 - DNA, 203 bp, Homo sapiens
  source 1..203: mol_type = other DNA
ggcgcgccagtcctcagtcgcacagcaattaccactctcgggaaatttggacagcagtccggagctatctacgtgggcaactttagagtggttaaccgccatcttgctactcataatgactgggcaaaccttgtttgggaagacagctcccgcgacttgctcgtatcatctaccactgctcaaggttgcgactcggaccgatg

SEQ ID NO: 4578 - DNA, 203 bp, Homo sapiens
  source 1..203: mol_type = other DNA
ggcgcgccagtcctggattgcggtggcattcttagatgccaacatggcgtcgtagggatagtttccaccgggggaaatggcctggtggggttcgccgatgtgagggatcttctgtggttggatgatgaagccatggagcagggcgtgtctgattacattaaagggcttggagatgcttttggcatgggcgactcggaccgatg

SEQ ID NO: 4579 - DNA, 203 bp, Homo sapiens
  source 1..203: mol_type = other DNA
ggcgcgccagtcctgtgccacgggagcccttgggcctgggttaagtcgaagacagcatcaattttgggcataccgatggctcagaagcagaatgcctcttggttaaagaaattcaacgatgcggcgaatgccgcgaaggggcttgagtggatctccaacaaaatcagtaaatttatcgattgggtcaacgactcggaccgatg

SEQ ID NO: 4580 - DNA, 203 bp, Homo sapiens
  source 1..203: mol_type = other DNA
ggcgcgccagtccttatagatcttcacacaagtgcaggatatccatacagtgcactaggcatcaagaaaaaggacattttggatccaacaactcgcgatgtcagcaagatgaaattctacatggacaagtatgggttggatctaccgtactctacttatgttaaagatgaacttagggccatcgacaacgactcggaccgatg

SEQ ID NO: 4581 - DNA, 203 bp, Homo sapiens
  source 1..203: mol_type = other DNA
ggcgcgccagtccttctggagttggcaagaacaggcaaggagtatggtctaactatgacccctgccgacaagtcaccctgctttaatgaggttacgtgggagaatgccactttcttgaagagaggattcttgcctgattatcaattcccgtttctcatccaccctacgatgccaatgagggagattcacgactcggaccgatg

SEQ ID NO: 4582 - DNA, 203 bp, Homo sapiens
  source 1..203: mol_type = other DNA
ggcgcgccagtcctgtttccccggtgaggccgcatagactgttcccacggttgaaagtggccgatccgttatccgctcatgtacttcgagaagcctagtatcgctctggaatcttcgacgcgttgcgctcagcactcaaccccggagtgtagcttgggccgatgagtctggacagtccccactggcgacgactcggaccgatg

SEQ ID NO: 4583 - DNA, 203 bp, Homo sapiens
  source 1..203: mol_type = other DNA
ggcgcgccagtcctgcaagattactcacaggatccatcaaaattcaccgagccactaaaggacgtgctcataaaaacagctccagcactcaattcaccaaatgtggaagcgtgtgggtatagtgatagagtgttgcaactcactttaggcaattccactattactacacaggaggcagcaaattcagtcgactcggaccgatg

SEQ ID NO: 4584 - DNA, 203 bp, Homo sapiens
  source 1..203: mol_type = other DNA
ggcgcgccagtcctagtggcttacggacgttggcctgagtttattagagatgacgaagcaaacccggtggaccaaccaactgaaccagatgtggctacatgcagattctacacactagacactgtaatgtggggtaaggagtcgaaaggctggtggtggaagttacctgacgcactgagagacatgggcgactcggaccgatg

SEQ ID NO: 4585 - DNA, 203 bp, Homo sapiens
  source 1..203: mol_type = other DNA
ggcgcgccagtcctcatgattcctctcaatttggagagcaccaagagaaacacaatggacatgtacagagttactctgagcgacagtgccgatctatcgcaaccaattttgtgcttgtcactatccccagcatctgatccgcgcttgtcacacaccatgcttggggaagtactgaactattatactcacgactcggaccgatg

SEQ ID NO: 4586 - DNA, 203 bp, Homo sapiens
  source 1..203: mol_type = other DNA
ggcgcgccagtcctgcgagacaccactcacatttcacaatctgcgcttccacagggtattgaagatttgatttctgaagttgcacagggcgccctaactttgtcactcccgaagcaacaggatagcttacctgatactaaggccagtggcccggcgcattccaaggaggtacctgcactcactgcagtcgactcggaccgatg

SEQ ID NO: 4587 - DNA, 203 bp, Homo sapiens
  source 1..203: mol_type = other DNA
ggcgcgccagtcctgaatagagacctcttggttgttgaatcaaaagctcaaggtaccgactcaatagcaaggtgcaattgcaatgcaggggtgtactattgtgagtccagaaggaaatactaccctgtgtcgtttgtgggacccaccttccaatacatggaggctaatgactactacccagctagatacgactcggaccgatg

SEQ ID NO: 4588 - DNA, 203 bp, Homo sapiens
  source 1..203: mol_type = other DNA
ggcgcgccagtccttgtacgctggttgtccattcaatccaagagattcgctccattgtacgcacttgaggccaagagaatacaaaagttggaacacaccattaataattacatacagttcaagagcaaacaccgtattgagccagtatgtttgttagtgcatgggagcccaggtacaggaaaatcagtcgactcggaccgatg

SEQ ID NO: 4589 - DNA, 203 bp, Homo sapiens
  source 1..203: mol_type = other DNA
ggcgcgccagtccttgcgactaacctaattgctagagccatagctgagaaagagaacacctccacctactcgctaccaccggacccgtctcactttgatggatacaaacaacaaggtgtggttatcatggacgacctaaaccaaaacccggatggggcagatatgaagctcttttgtcaaatggtgtccgactcggaccgatg

SEQ ID NO: 4590 - DNA, 203 bp, Homo sapiens
  source 1..203: mol_type = other DNA
ggcgcgccagtcctcaatgtgcccaccattagagcagcaaaagtgcaagggcctgggtttgactatgcagtggctatggctaaaagaaacattgttacagcaactactagcaaaggggagttcacaatgctaggagtccacgacaacgtggccattttaccaactcatgcctcacctggtgagagtatcgactcggaccgatg

SEQ ID NO: 4591 - DNA, 203 bp, Homo sapiens
  source 1..203: mol_type = other DNA
ggcgcgccagtccttgtaattgatggcaaagaggttgaaatcctagacgctaaagccctcgaagatcaggcaggcactaatctggaaatcaccataataaccctcaaaagaaatgaaaagttcagagatatcagacaacacatacccactcaaatcaccgagacgaatgatggagttctgattgtgaacgactcggaccgatg

SEQ ID NO: 4592 - DNA, 203 bp, Homo sapiens
  source 1..203: mol_type = other DNA
ggcgcgccagtccttgggaatggttcacatgggtttgcagcggccctgaagcggtcatacttcactcagagccaaggtgaaatccagtggatgagaccatcaaaggaggcagggtatccaattataaacgccccaaccaagaccaagctcgagcccagcgctttccactatgtgtttgaaggagtaaacgactcggaccgatg

SEQ ID NO: 4593 - DNA, 203 bp, Homo sapiens
  source 1..203: mol_type = other DNA
ggcgcgccagtcctggaaccagcagtcctcacaaagaatgatcccagacttaaaacagactttgaagaagcaatcttctctaagtatgtagggaacaagatcactgaggtggatgagtacatgaaagaggcagtggaccattatgctggacaacttatgtcgctggatatcagcacagagcaaatgtgcgactcggaccgatg

SEQ ID NO: 4594 - DNA, 203 bp, Homo sapiens
  source 1..203: mol_type = other DNA
ggcgcgccagtcctagtgacatatgtcaaggacgagctgaggtccaaaacaaaagtggaacagggaaaatccagactgattgaagcttccagtctaaatgactcagtggccatgagaatggcatttggaaacctttatgcagcattccacaggaatccaggggtcgtcactggtagtgcagttggatgcgactcggaccgatg

SEQ ID NO: 4595 - DNA, 203 bp, Homo sapiens
  source 1..203: mol_type = other DNA
ggcgcgccagtcctcgatccagacctattctggagcaagatcccagtgttgatggaagaaaagctatttgcctttgattacacaggatacgacgcatcacttagcccagcttggtttgaggcactcaagatggtgttagagaaaattggttttggagatagagtggattacatagactaccttaaccacgactcggaccgatg

SEQ ID NO: 4596 - DNA, 203 bp, Homo sapiens
  source 1..203: mol_type = other DNA
ggcgcgccagtcctttcacaccacttgtacaaaaacaagatatattgtgttaagggcggcatgccatctggctgctccggcacttcaatttttaattcaatgattaacaatttgatcattaggacgcttttactgaaaacctacaagggcatagatttggaccacttaaaaatgattgcctatggtgacgactcggaccgatg

SEQ ID NO: 4597 - DNA, 203 bp, Homo sapiens
  source 1..203: mol_type = other DNA
ggcgcgccagtcctgcggcgggccgtcaagcccgtgcgctgtatagcgccaggtaaccggacagcggcgtgctggattttcccggtgccattgctctggatggtgtcaccaagctgacaaatgcggagtgaacctcacaaagcgacacgcctgtggtagcgctgcccaaaagggagcggaactccccgcgactcggaccgatg

SEQ ID NO: 4598 - DNA, 203 bp, Homo sapiens
  source 1..203: mol_type = other DNA
ggcgcgccagtcctccgaggcggtcctctctggccaaaagcccagcgttgatagcgccttttgggatgcaggaaccccacctgccaggtgtgaagtggagtgagcggatctccaatttggtctgttctgaactacaccatttactgctgtgaagaatgccctggaggcaagctggttacagccctgaccgactcggaccgatg

SEQ ID NO: 4599 - DNA, 203 bp, Homo sapiens
  source 1..203: mol_type = other DNA
ggcgcgccagtcctcaggccctgcccgtgactctcgaccggcgcagggtcaaaaattgtctaagcagcagcaggaacgcgggagcgtttcttttccttttgtactgacatgatggcggcgtctaaggtgtatagagtttgcgagcagactctgctggcaggtgccgttcgcatgatggacaaattcttcgactcggaccgatg

SEQ ID NO: 4600 - DNA, 203 bp, Homo sapiens
  source 1..203: mol_type = other DNA
ggcgcgccagtccttgtttcggcaaaaccgggacatgcagtattctaccttctcacaagcgagggttggatctgtgttgatgacaagaaaatatacccagaaacacccaaaacagaggatgtacttgtttttgcgccctatgactttgagtcactgggcaaggacccaccaaagctacaccagagatacgactcggaccgatg

SEQ ID NO: 4601 - DNA, 203 bp, Homo sapiens
  source 1..203: mol_type = other DNA
ggcgcgccagtcctactcaagaagatgggcagttttcatgaggttgtcaaagcccaccacctggtcaagaacggctgggatgtggttgtgcaggtgaatccctcatttgctcactccgggccgctgtgtgtagcagcagtgccggagtacgaacacacacatgagaaagcactcaagtggtctgagctcgactcggaccgatg

SEQ ID NO: 4602 - DNA, 203 bp, Homo sapiens
  source 1..203: mol_type = other DNA
ggcgcgccagtccttgaggaaccagcttacacataccaacaactttcagtttttccccaccagttgctaaatttgaggacaaattcatcagtgcatttggtgatgccctacattgggccaggccaaccaacaaatctgactttgcacaacccgtggaccattgttattttaattttgtctgaattgaccgactcggaccgatg

SEQ ID NO: 4603 - DNA, 203 bp, Homo sapiens
  source 1..203: mol_type = other DNA
ggcgcgccagtcctcccaccgcgccaagttcctggccggtttacaaatttcattgatgtggcaaaacagacatattcattttgttccatttctggaaaaccttattttgaggttaccaacacctctggggacgagccactgtttcagatggatgtgtcgctcagtgcggcagagctacatggcacttacgactcggaccgatg

SEQ ID NO: 4604 - DNA, 203 bp, Homo sapiens
  source 1..203: mol_type = other DNA
ggcgcgccagtccttgttggcttgaactcagctttttcttttaatgtaccttatccctcccctgctgacttcatggccgtttattctgcggaacggacggttgtgaatgtctctggatggcttcaagtttatgcactaacagctctaacttcaactgacattgccgtgaacagtaaaggccgtgtgctcgactcggaccgatg

SEQ ID NO: 4605 - DNA, 203 bp, Homo sapiens
  source 1..203: mol_type = other DNA
ggcgcgccagtcctggttgctgtttccgccggcccagacttctcccttcgtcacccggcggacctgcccgacaagcaggttaccaatgtgggagaggatggtgaacccggtgagacagagcctcgtcatgctttgtcacccgtggacatgcacgtgcacacagatgtcagtttcttgcttgaccggttcgactcggaccgatg

SEQ ID NO: 4606 - DNA, 203 bp, Homo sapiens
  source 1..203: mol_type = other DNA
ggcgcgccagtcctctttgatgttgagacacttgagctttcaaatttgacaggttctcctgccacacatgttctggatccgtttggctcgactgcccaactggcttgggcacgtctgctaaacacttgcacctacttcttttctgatttggaattgtcaatccagtttaaatttaccaccactccgtccgactcggaccgatg

SEQ ID NO: 4607 - DNA, 203 bp, Homo sapiens
  source 1..203: mol_type = other DNA
ggcgcgccagtcctctctgttggagagggctttgtgtgggtgaagtggctccctgttggagcaccaaccaagaccacagatgcttggcagttagaaggaggtggaaattcagttagaattcaaaaattggccgttgcagggatgtgccccactgttgtgttcaagattgcaggctcccgttcacaagccgactcggaccgatg

SEQ ID NO: 4608 - DNA, 203 bp, Homo sapiens
  source 1..203: mol_type = other DNA
ggcgcgccagtcctggtggttatgttgattgctgatttcggattggaggtctttgacactgggtttttcttttcctactttcaagagaagttgcagccttatatgaaaactattcctggtaagatttctgatttggtcactgatgcggctacggctgccgcccaaattccaaagggagtgtattctttcgactcggaccgatg

SEQ ID NO: 4609 - DNA, 203 bp, Homo sapiens
  source 1..203: mol_type = other DNA
ggcgcgccagtcctgctctattcagaattggaaaaatatcccttgtacaagttaaaattgaaggaacctgatactcaagaggaagcgcgccagtggtttaaagacatgcagcagcgtgctctcgctgtgaaggacaaaggtctcttttccctcctgcaaattccattagttaacttgccccagagccgcgactcggaccgatg

SEQ ID NO: 4610 - DNA, 203 bp, Homo sapiens
  source 1..203: mol_type = other DNA
ggcgcgccagtccttgttcagccaattgagctttaccttgacaatgaattggttactgactgctctgccttgggtgtttatgacaattcatatttggtgccccttcatttgtttgaatttgattttgataccattgtgcttggtggacgtcattacaagaaagctgagtgtgagaaggtagagtttgacgactcggaccgatg

SEQ ID NO: 4611 - DNA, 203 bp, Homo sapiens
  source 1..203: mol_type = other DNA
ggcgcgccagtccttcaatcatttttgaaagatgagatccgcccacttgagaaagttagggctggaaagacccgcctgattgacgtgccgccgatgccccatgtggtggttggtaggcagctcttgggccggtttgtggcaaaatttcatgaagcaaatggatttgacattggctcagccattggatgcgactcggaccgatg

SEQ ID NO: 4612 - DNA, 203 bp, Homo sapiens
  source 1..203: mol_type = other DNA
ggcgcgccagtcctcatttgctatggggacgactgcctcattgcttctgattttgaaattgatttccaacaactggtgcctgtcttttctagttttggacaggtaataactacagctgacaagactgatttttttaaactgacaacgctttcggaggtgaccttccttaagcgcgcttttgttctgaccgactcggaccgatg

SEQ ID NO: 4613 - DNA, 203 bp, Homo sapiens
  source 1..203: mol_type = other DNA
ggcgcgccagtcctggccttttacaagccagtgatggatgtgaagacccttgaagcaatcttaagctttgttcgcccaggcacacaggctgaaaagctcctgtccgtggcgcagttggcaggccactgcgaaccggagcagtatgagcgcctgtttgagccctttgctgggatgtatttcgtccctaccgactcggaccgatg

SEQ ID NO: 4614 - DNA, 203 bp, Homo sapiens
  source 1..203: mol_type = other DNA
ggcgcgccagtcctagtggatgcattgagtggattgactgtcagggctgtctttaggcttaattccagacctctctgtgcttagggcaaacatcatttggccttaaatgggattctgtgagaggggatccctccattgacagctggactgttctttggggccttatgtggtgtttgcctctgaggtaccgactcggaccgatg

SEQ ID NO: 4615 - DNA, 203 bp, Homo sapiens
  source 1..203: mol_type = other DNA
ggcgcgccagtccttcaggggcatttaggtttttcctcattcttaaataataatgaacatgtctagacaaggtattttccagactgttgggagtggtcttgaccacatcctgtctttggcagacattgaggaagagcaaatgattcaatcagttgataggactgcagtgactggtgcttcttattttacgactcggaccgatg

SEQ ID NO: 4616 - DNA, 203 bp, Homo sapiens
  source 1..203: mol_type = other DNA
ggcgcgccagtcctagttgtatagagggcctttagatctgacaattattattacaggagcaactgatgtagatggcatggcctggttcactccagtaggtcttgccgttgatactccttgggtagagaaggagtcagctttgtctattgactacaaaactgctcttggagctgtcagatttaacacaacgactcggaccgatg

SEQ ID NO: 4617 - DNA, 203 bp, Homo sapiens
  source 1..203: mol_type = other DNA
ggcgcgccagtccttcacagaacaatcagagttttattttcccagagctccattgaactcaaatgccatgttatccactgaatcaatgatgagcagaattgcagctggagacttggagtcatcagtggatgatcctagatcagaggaagataaaagatttgagagtcatatagaatgcaggaagccatcgactcggaccgatg

SEQ ID NO: 4618 - DNA, 203 bp, Homo sapiens
  source 1..203: mol_type = other DNA
ggcgcgccagtcctccaactggttaagagatatttgttctgggatcaccatttttaaaaacttcaaggatgcaatttattggctttatacaaaattaaaggacttttatgaagtgaattatggcaagaagaaggacattttaaatattcttaaagataaccaacaaaaaatagagaaagccattgaggcgactcggaccgatg

SEQ ID NO: 4619 - DNA, 203 bp, Homo sapiens
  source 1..203: mol_type = other DNA
ggcgcgccagtcctttcctaagtttagagatattactcagcattttattaagaaaggggatgtgcctagagctttgaatcgcctggcaacattagtgacaactgtaaatggaacccctatgttaatttctgagggcccactaaagatggaagagaaagctacttatgttcataagaaaaatgatggtacgactcggaccgatg

SEQ ID NO: 4620 - DNA, 203 bp, Homo sapiens
  source 1..203: mol_type = other DNA
ggcgcgccagtcctcaacagttgatttaactgtggatcaggcatggagaggaaaaggcgaaggtcttcctggaatgtgtggtggggccttggtttcatcgaatcaatctatacagaatgcaatcttgggcatccatgttgctggaggaaattcaattcttgttgcaaaattggttactcaagaaatgtcgactcggaccgatg

SEQ ID NO: 4621 - DNA, 203 bp, Homo sapiens
  source 1..203: mol_type = other DNA
ggcgcgccagtccttccaaaatattgataagaaaattgaaagtcagagaattatgaaagtggagtttactcagtgttcaatgaatgtggtctccaaaacgctttttagaaagagtcccatttatcatcacattgataaaaccatgattaattttcctgcagctatgcccttttctaaagctgaaattgcgactcggaccgatg

SEQ ID NO: 4622 - DNA, 203 bp, Homo sapiens
  source 1..203: mol_type = other DNA
ggcgcgccagtcctatccaatggctgtgatgttatctaagtattcattacctattgtagaagaaccagaggattataaagaggcttcaattttttatcaaaataaaatagtgggtaagactcagttagttgatgattttttagatcttgatatggccattacaggggccccaggaattgatgctatcacgactcggaccgatg

SEQ ID NO: 4623 - DNA, 203 bp, Homo sapiens
  source 1..203: mol_type = other DNA
ggcgcgccagtcctctgatagacagtgggatgaattatttaaaacaatgataagattcggagatgttggtcttgatttagatttctctgcttttgatgctagtcttagtccatttatgattagagaagcaggtagaatcatgagtgaactatctggaactccatcccattttggcacagctcttatcacgactcggaccgatg

SEQ ID NO: 4624 - DNA, 203 bp, Homo sapiens
  source 1..203: mol_type = other DNA
ggcgcgccagtcctatactatcatttattccaagcatttgctgtataactgttgttaccatgtctgtggttcaatgccctctgggtctccttgtacagctttgctaaattcaattattaataatgtcaatttgtattatgtgttttccaagatatttggaaagtctccagttttcttttgtcaggcttcgactcggaccgatg

SEQ ID NO: 4625 - DNA, 203 bp, Homo sapiens
  source 1..203: mol_type = other DNA
ggcgcgccagtcctgttgagccccttgttgaagtgtttccctccatcgcgacgtggttggagatctaagtcaaccgactccgacgaaactaccatcatgcctccccgattatgtgatgctttctgccctgctgggtggagcaccctcgggttgagaaaaccttcttcctttttccttggactcgggtccgactcggaccgatg

SEQ ID NO: 4626 - DNA, 203 bp, Homo sapiens
  source 1..203: mol_type = other DNA
ggcgcgccagtcctccccggtctaagccgctcggaatatgacagggttattttcacctcttcttttctactccacagtgttctatactgtggaagggtatgtgttgccccttccttcttggagaacgtgcgcggcggtctttccgtctctcgacaagcgcgcgtgcaacatacagagtaacgcgaagacgactcggaccgatg

SEQ ID NO: 4627 - DNA, 203 bp, Homo sapiens
  source 1..203: mol_type = other DNA
ggcgcgccagtcctaagcagttctcggtctagctctagtgcccacaagaaaacagctgtagcgaccacacaaaggcagcggaacccccctcctggtaacaggagcctctgcggccaaaagccacgtggataagatccacctttgtgtgcggtgcaaccccagcaccctggtttcttggtgacactctacgactcggaccgatg

SEQ ID NO: 4628 - DNA, 203 bp, Homo sapiens
  source 1..203: mol_type = other DNA
ggcgcgccagtcctacacgagcaatcaatctcaaacaatggactggactgacgtaccgctcatacgcgatattgtcatggaaccccagggaaactcctcgtcatctgacaagagtaactcccagtcctcaggaaatgaaggggttattattaacaacttctattccaatcaataccaaaactcaattgcgactcggaccgatg

SEQ ID NO: 4629 - DNA, 203 bp, Homo sapiens
  source 1..203: mol_type = other DNA
ggcgcgccagtccttccttgaattgtgcaagctccccactttccttggtaaccccaacaccaacaacaagcgttacccctatttctctgccaccaattctgtaccagccacttccatggttgattaccaagttgctctctcatgctcttgtatggctaattcaatgcttgctgctgttgctcgtaattcgactcggaccgatg

SEQ ID NO: 4630 - DNA, 203 bp, Homo sapiens
  source 1..203: mol_type = other DNA
ggcgcgccagtccttcacgctcaggatgccgatttcacccaccaagtgggttccacaaggagttgacaatgctgagaaaggtaaagtctccaacgatgatgcttcggttgactttgtcgccgaaccagtcaagctgcccgagaaccaaacccgggtggccttcttctatgacagagctgtccctatagcgactcggaccgatg

SEQ ID NO: 4631 - DNA, 203 bp, Homo sapiens
  source 1..203: mol_type = other DNA
ggcgcgccagtcctgtatgttgaggcccggccaaaatatggaaaccacttttaactaccaagaaaatgattaccgcctcaattgtcttttgctaacccctctcccttccttttgtcctgacagttcttccgggccccaaaaaacaaaggctcccgttcaatggcgatgggtgcgatctggcggcgtcacgactcggaccgatg

SEQ ID NO: 4632 - DNA, 203 bp, Homo sapiens
  source 1..203: mol_type = other DNA
ggcgcgccagtcctcccctaacgcagacttcgggcgtctctggatccagggcaatacctctgcctccgtccggatcaggtacaagaaaatgaaggtcttctgcccccgcccgaccctcttcttcccctggcctacgcccaccaccaccaagatcaatgctgacaacccagtccccattcttgaactcgcgactcggaccgatg

SEQ ID NO: 4633 - DNA, 203 bp, Homo sapiens
  source 1..203: mol_type = other DNA
ggcgcgccagtcctagaatcccgctgctctctaccgcattgatctcttcatcaccttcactgatgagttcatcacctttgattacaaggttcacggacgtcctgtgcttaccttccggatcccaggcttcggcctgaccccggcaggtaggatgctcgtgtgcatgggcgaacaacccgcacatggtccgactcggaccgatg

SEQ ID NO: 4634 - DNA, 203 bp, Homo sapiens
  source 1..203: mol_type = other DNA
ggcgcgccagtcctcgttcacctcctctagatccctctatcatgtcatttttactgctacttgctcttcctttagctttagtatctacaaggggcggtaccgctcctggaaaaagcccatccatgacgagcttgtggatcgtggttacaccactttcggcgagttcttcaaggctgtgcgcggatacccgactcggaccgatg

SEQ ID NO: 4635 - DNA, 203 bp, Homo sapiens
  source 1..203: mol_type = other DNA
ggcgcgccagtcctatgctgactattacagacagagactcatacacgatgtggaaacaaatccaggccctgtgcagtcggtttttcagccacaaggtgcggtgctaactaaatccctagcaccccaggcaggaattcaaaacctccttctacgcctcctcggcatagacggtgactgttcagaagttacgactcggaccgatg

SEQ ID NO: 4636 - DNA, 203 bp, Homo sapiens
  source 1..203: mol_type = other DNA
ggcgcgccagtccttgactggtgtggacctcctcaccaacgattctgtttttgattggctcaaacaaaaattgtcttccttctttcgcacccctcccccagcttgccccaatgttatgcagcctcagggacctctacgcgaggccaatgaaggcttcacctttgctaagaacattgagtgggctatgacgactcggaccgatg

SEQ ID NO: 4637 - DNA, 203 bp, Homo sapiens
  source 1..203: mol_type = other DNA
ggcgcgccagtcctcgaatatggctcacctggaaagaaaaggcactccttttacctctagcttcattgttgctacaacaaatttgcccaaattccgccctgttacggttgcccactaccccgctgttgataggcgaatcacctttgattttactgttactgctggaccccactgcaaaacgcctgctgcgactcggaccgatg

SEQ ID NO: 4638 - DNA, 203 bp, Homo sapiens
  source 1..203: mol_type = other DNA
ggcgcgccagtcctcccgcaagactgaaaatgtgaagaaaatgaatagcctggttgctcagtctccaccagactgggagcactttgagaacatcctcacctgtctccgtcagaacaacgccgctctccaggaccaactcgatgagttacaggaagcgtttgctcaagcgcgcgagcgctctgactttccgactcggaccgatg

SEQ ID NO: 4639 - DNA, 203 bp, Homo sapiens
  source 1..203: mol_type = other DNA
ggcgcgccagtccttggttaaccgccacgttgcagagacagattggaccgctttcaaactcaaggatgtgagacacgagcgccacactgtcgcccttcgctccgtcaatagatcaggagccaagactgacctcacattcataaaagtcacaaagggacctctcttcaaagacaacgttaacaaattttcgactcggaccgatg

SEQ ID NO: 4640 - DNA, 203 bp, Homo sapiens
  source 1..203: mol_type = other DNA
ggcgcgccagtcctgctccaacaaggacgacttcccagcaaggaacgacaccgtcactggaatcatgaacaccggcctggctttcgtgtactctggcaacttcttgattggcaaccaacctgttaacaccacaactggagcctgtttcaaccactgcctccactaccgggctcaaacccgacgtggttcgactcggaccgatg

SEQ ID NO: 4641 - DNA, 203 bp, Homo sapiens
  source 1..203: mol_type = other DNA
ggcgcgccagtcctcaggatctgttgtacatgtccctagaaaaactaaattgaggaggacagtcgcccacgacgtcttccaacccaaattcgaacctgcagttctgtcccgttatgaccctgggaccgataaagatgtggatgttgtagccttctccaaacacactaccaacatggaaagcttgcccccgactcggaccgatg

SEQ ID NO: 4642 - DNA, 203 bp, Homo sapiens
  source 1..203: mol_type = other DNA
ggcgcgccagtcctatcttctgaatttcatcactgctaaaatgacccctcaattggactacgctcattccaaattggtgatcggtgtttatgatgatgttgtttaccaatcatttttgaaagatgaaattcggcctatagaaaagatccatgaagcgaaaacccggatcgttgacgtacccccgtttgcgactcggaccgatg

SEQ ID NO: 4643 - DNA, 203 bp, Homo sapiens
  source 1..203: mol_type = other DNA
ggcgcgccagtcctatgcttcccactccactgcgatgtttgaatgcttaattaacaatttctttacagagcaaaatggatttgacagacgcatcgccgagtatcttagatctctggctgtgtcacgacatgcctatgaggaccgccgtgtccttatacgtgggggcctgccctcgggctgtgctgccacgactcggaccgatg

SEQ ID NO: 4644 - DNA, 203 bp, Homo sapiens
  source 1..203: mol_type = other DNA
ggcgcgccagtcctgacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaattcgactcggaccgatg

SEQ ID NO: 4645 - DNA, 203 bp, Homo sapiens
  source 1..203: mol_type = other DNA
ggcgcgccagtccttccttctggccctgctctcttgcctgactgtgcccgcttcagcctaccaagtgcgcaattcctcggggctttaccatgtcaccaatgattgccctaactcgagtgttgtgtacgaggcggccgatgccatcctgcacactccggggtgtgtcccttgcgttcgcgagggtaacgcgactcggaccgatg

SEQ ID NO: 4646 - DNA, 203 bp, Homo sapiens
  source 1..203: mol_type = other DNA
ggcgcgccagtcctcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttacctcgactcggaccgatg

SEQ ID NO: 4647 - DNA, 203 bp, Homo sapiens
  source 1..203: mol_type = other DNA
ggcgcgccagtcctcccactggggagtcctggcgggcataaagtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagccgactcggaccgatg

SEQ ID NO: 4648 - DNA, 203 bp, Homo sapiens
  source 1..203: mol_type = other DNA
ggcgcgccagtcctagaacatccaactgatcaacaccaacggcagttggcacatcaatagcacggccttgaactgcaatgaaagccttaacaccggctggttagcagggctcttctatcagcacaaattcaactcttcaggctgtcctgagaggttggccagctgccgacgccttaccgattttgccccgactcggaccgatg

SEQ ID NO: 4649 - DNA, 203 bp, Homo sapiens
  source 1..203: mol_type = other DNA
ggcgcgccagtcctctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccacgactcggaccgatg

SEQ ID NO: 4650 - DNA, 203 bp, Homo sapiens
  source 1..203: mol_type = other DNA
ggcgcgccagtcctaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgcgactcggaccgatg

SEQ ID NO: 4651 - DNA, 203 bp, Homo sapiens
  source 1..203: mol_type = other DNA
ggcgcgccagtccttgcagtacttgtacggggtagggtcaagcatcgcgtcctgggccattaagtgggagtacgtcgttctcctgttccttctgcttgcagacgcgcgcgtctgttcctgcttgtggatgatgttactcatatcccaagcggaggcggctttggagaacctcgtaatactcaatgcagcgactcggaccgatg

SEQ ID NO: 4652 - DNA, 203 bp, Homo sapiens
  source 1..203: mol_type = other DNA
ggcgcgccagtcctcatccctggccgggacgcatggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggcgactcggaccgatg

SEQ ID NO: 4653 - DNA, 203 bp, Homo sapiens
  source 1..203: mol_type = other DNA
ggcgcgccagtccttcatcttactcacgtgtgtagtacacccggccctggtatttgacatcaccaaactactcctggccatcttcggacccctttggattcttcaagccagtttgcttaaagtcccctacttcgtgcgcgttcaaggccttctccggatctgcgcgctagcgcggaagatagccggagcgactcggaccgatg

SEQ ID NO: 4654 - DNA, 203 bp, Homo sapiens
  source 1..203: mol_type = other DNA
ggcgcgccagtcctgtcattacgtgcaaatggccatcatcaagttaggggcgcttactggcacctgtgtgtataaccatctcgctcctcttcgagactgggcgcacaacggcctgcgagatctggccgtggctgtggaaccagtcgtcttctcccgaatggagaccaagctcatcacgtggggggcagcgactcggaccgatg

SEQ ID NO: 4655 - DNA, 203 bp, Homo sapiens
  source 1..203: mol_type = other DNA
ggcgcgccagtcctagagcttccaggtggcccacctgcatgctcccaccggcagcggtaagagcaccaaggtcccggctgcgtacgcagccaagggctacaaggtgttggtgctcaacccctctgttgctgcaacactgggctttggtgcttacatgtccaaggcccatggggttgatcctaatatcacgactcggaccgatg

SEQ ID NO: 4656 - DNA, 203 bp, Homo sapiens
  source 1..203: mol_type = other DNA
ggcgcgccagtcctggaccggggtgagaacaattaccactggcagccccatcacgtactccacctacggcaagttccttgccgacgccgggtgctcaggaggtgcttatgacataataatttgtgacgagtgccactccacggatgccacatccatctcgggcatcggcactgtccttgaccaagcagcgactcggaccgatg

SEQ ID NO: 4657 - DNA, 203 bp, Homo sapiens
  source 1..203: mol_type = other DNA
ggcgcgccagtcctagactgcgggggcgagactggttgtgctcgccactgctacccctccgggctccgtcactgtgtcccatcctaacatcgaggaggttgctctgtccaccaccggagagatccccttttacggcaaggctatccccctcgaggtgatcaaggggggaagacatctcatcttctgcccgactcggaccgatg

SEQ ID NO: 4658 - DNA, 203 bp, Homo sapiens
  source 1..203: mol_type = other DNA
ggcgcgccagtcctactcaaagaagaagtgcgacgagctcgccgcgaagctggtcgcattgggcatcaatgccgtggcctactaccgcggtcttgacgtgtctgtcatcccgaccagcggcgatgttgtcgtcgtgtcgaccgatgctctcatgactggctttaccggcgacttcgactctgtgatagcgactcggaccgatg

SEQ ID NO: 4659 - DNA, 203 bp, Homo sapiens
  source 1..203: mol_type = other DNA
ggcgcgccagtcctactgcaacacgtgtgtcactcagacagtcgattttagccttgaccctacctttaccattgagacaaccacgctcccccaggatgctgtctccaggactcaacgccggggcaggactggcagggggaagccaggcatctatagatttgtggcaccgggggagcgcccctccggcacgactcggaccgatg

SEQ ID NO: 4660 - DNA, 203 bp, Homo sapiens
  source 1..203: mol_type = other DNA
ggcgcgccagtcctgactgggcgctgttcagaatgaagtcaccctgacgcacccaatcaccaaatacatcatgacatgcatgtcggccgacctggaggtcgtcacgagcacctgggtgctcgttggcggcgtcctggctgctctggccgcgtattgcctgtcaacaggctgcgtggtcatagtgggcacgactcggaccgatg

SEQ ID NO: 4661 - DNA, 203 bp, Homo sapiens
  source 1..203: mol_type = other DNA
ggcgcgccagtcctaccggctaatagccttcgcctcccgggggaaccatgtttcccccacacactacgtgccggagagcgatgcagccgcccgcgtcactgccatactcagcagcctcactgtaacccagctcctgaggcgactgcatcagtggataagctcggagtgtaccactccatgctccggttcgactcggaccgatg

SEQ ID NO: 4662 - DNA, 203 bp, Homo sapiens
  source 1..203: mol_type = other DNA
ggcgcgccagtcctcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagcgactcggaccgatg

SEQ ID NO: 4663 - DNA, 203 bp, Homo sapiens
  source 1..203: mol_type = other DNA
ggcgcgccagtcctctgagatcactggacatgtcaaaaacgggacgatgaggatcgtcggtcctaggacctgcaagaacatgtggagtgggacgttcttcattaatgcctacaccacgggcccctgtactccccttcctgcgccgaactataagttcgcgctgtggagggtgtctgcagaggaatacgcgactcggaccgatg

SEQ ID NO: 4664 - DNA, 203 bp, Homo sapiens
  source 1..203: mol_type = other DNA
ggcgcgccagtccttggagataaggcgggtgggggacttccactacgtatcgggcatgactactgacaatctcaaatgcccgtgccagatcccatcgcccgaatttttcacagaattggacggggtgcgcctacataggtttgcgcccccttgcaagcccttgctgcgggaggaggtatcattcagagcgactcggaccgatg

SEQ ID NO: 4665 - DNA, 203 bp, Homo sapiens
  source 1..203: mol_type = other DNA
ggcgcgccagtccttaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtcgactcggaccgatg

SEQ ID NO: 4666 - DNA, 203 bp, Homo sapiens
  source 1..203: mol_type = other DNA
ggcgcgccagtcctccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgcgactcggaccgatg

SEQ ID NO: 4667 - DNA, 203 bp, Homo sapiens
  source 1..203: mol_type = other DNA
ggcgcgccagtcctagcgggaggtctccgtacccgcagaaattctgcggaagtctcggagattcgccccagccctgcccgtctgggcgcggccggactacaaccccctgctagtagagacgtggaaaaagcctgactacgaaccacctgtggtccatggctgcccgctaccacctccacggtcccctccgactcggaccgatg

SEQ ID NO: 4668 - DNA, 203 bp, Homo sapiens
  source 1..203: mol_type = other DNA
ggcgcgccagtcctaagtgaaggctaacttgctatccgtagaggaagcttgcagcctggcgcccccacattcagccaaatccaagtttggctatggggcaaaagacgtccgttgccatgccagaaaggccgtagcccacatcaactccgtgtggaaagaccttctggaagacagtgtaacaccaatagcgactcggaccgatg

SEQ ID NO: 4669 - DNA, 203 bp, Homo sapiens
  source 1..203: mol_type = other DNA
ggcgcgccagtcctacactaccatcatggccaagaacgaggttttctgcgttcagcctgagaaggggggtcgtaagccagctcgtctcatcgtgttccccgacctgggcgtgcgcgtgtgcgagaagatggccctgtacgacgtggttagcaagctccccttggccgtgatgggaagctcctacggatcgactcggaccgatg

SEQ ID NO: 4670 - DNA, 203 bp, Homo sapiens
  source 1..203: mol_type = other DNA
ggcgcgccagtcctcctccaacgtgtcagtcgcccacgacggcgctggaaagagggtctactaccttacccgtgaccctacaacccccctcgcgagagccgcgtgggagacagcaagacacactccagtcaattcctggctaggcaacataatcatgtttgcccccacactgtgggcgaggatgataccgactcggaccgatg

SEQ ID NO: 4671 - DNA, 203 bp, Homo sapiens
  source 1..203: mol_type = other DNA
ggcgcgccagtccttgatgacccacttctttagcgtcctcatagccagggatcagcttgaacaggctctcaactgcgagatctacggagcctgctactccatagaaccactggatctacctccaatcattcaaagactccatggcctcagcgcattttcactccacagttactctccaggtgaaattacgactcggaccgatg

SEQ ID NO: 4672 - DNA, 203 bp, Homo sapiens
  source 1..203: mol_type = other DNA
ggcgcgccagtccttccggctggttcacggctggctacagcgggggagacatttatcacagcgtgtctcatgcccggccccgctggttctggttttgcctactcctgcttgctgcaggggtaggcatctacctcctccccaaccgatgaagattgggctaaccactccaggccaataggccattccctcgactcggaccgatg

SEQ ID NO: 4673 - DNA, 203 bp, Homo sapiens
  source 1..203: mol_type = other DNA
ggcgcgccagtccttagtgggagtgaagagggtagtaatgaacttgctagatggcagagggccaatacggtttgtgttggctctcttagctttcttcaggtttacagcacttgccccgaccaaggccttgatgaggcgctggaagagcgtgaacaagacaacggccatgaaacatctgaccagttttacgactcggaccgatg

SEQ ID NO: 4674 - DNA, 203 bp, Homo sapiens
  source 1..203: mol_type = other DNA
ggcgcgccagtcctagaaagaattaggaacactgattgatgtggtgaacaaaaggggcaaaaaacaaaagaaaagaggtggcagtgaaacatccgtgcttatgctcattttcatgctgattggatttgccgctgccttaaagctttccaccttccagggcaagataatgatgactgtgaacgctacggcgactcggaccgatg

SEQ ID NO: 4675 - DNA, 203 bp, Homo sapiens
  source 1..203: mol_type = other DNA
ggcgcgccagtcctacattgctgatgtgatcgccattccaaccccgaagggacccaatcaatgctggattcgagccattgacattggatttatgtgtgatgacaccatcacttatgaatgcccgaaattggaaagtggaaatgaccctgaagacattgactgctggtgtgacaaacaagctgtgtacgcgactcggaccgatg

SEQ ID NO: 4676 - DNA, 203 bp, Homo sapiens
  source 1..203: mol_type = other DNA
ggcgcgccagtccttggagggcgacagttgcatcaccatcatggccgctgacaaacccacccttgacataagaatgatgaacattgaagccaccaatcttgcactggttagaaattactgctatgcagctactgtgtcagacgtttctacggtgtcaaactgtcccactacaggggagtcacacaacacgactcggaccgatg

SEQ ID NO: 4677 - DNA, 203 bp, Homo sapiens
  source 1..203: mol_type = other DNA
ggcgcgccagtcctcgaagcgggcagatcacaattacttgtgcaaacgaggtgtgaccgacagaggctggggtaatggatgtggcttgtttggtaaggggagcattgacacatgcgcaaagttcacctgctctaactcagctgcggggagacttatcttacctgaggacatcaaatatgaagttggggcgactcggaccgatg

SEQ ID NO: 4678 - DNA, 203 bp, Homo sapiens
  source 1..203: mol_type = other DNA
ggcgcgccagtcctaggcctactacgtcatgaccattggaacgaaacactttctagtgcatcgtgagtggttcaatgatttgctcttgccatggacatcacctgcaagcacggaatggaggaatagagaaattctcgtggagtttgaagagccacatgccaccaaacaatcagtggttgccttgggttcgactcggaccgatg

SEQ ID NO: 4679 - DNA, 203 bp, Homo sapiens
  source 1..203: mol_type = other DNA
ggcgcgccagtccttaacatccaccaggggttggcttaaactcagagaggaaaatacctcggagtgtgacagcaccattattgggaccgcagttaagggcaaccatgcagtacacagtgacctttcctactggattgagagtggactcaatgggacatggaaacttgagagagccatttttggagaggcgactcggaccgatg

SEQ ID NO: 4680 - DNA, 203 bp, Homo sapiens
  source 1..203: mol_type = other DNA
ggcgcgccagtcctcaggccttatgatatgcaaccctaacaagaagagaggatggcccgccacagaggtgttaacagcagtgggactgatgttcgccattgttggaggactcgctgagctagacattgattctatgtcagtcccttttaccatagctggcctcatgttagtgtcctatgttatctcggcgactcggaccgatg

SEQ ID NO: 4681 - DNA, 203 bp, Homo sapiens
  source 1..203: mol_type = other DNA
ggcgcgccagtccttaagcgtagctgccatcactccaagggccattttgccatccgcgtttgggtattggctgactctgaagtacacaaaacgagggggtgttttttgggatacgccttccccaaaagtgtatcccaagggggatacgacgccaggagtctaccgaataatggccagaggtatcctggcgactcggaccgatg

SEQ ID NO: 4682 - DNA, 203 bp, Homo sapiens
  source 1..203: mol_type = other DNA
ggcgcgccagtcctgagagggaagagtcattctcagtgtgccgtcagccatcactagtgccagtgctgcccaacggagaggtagagtgggcaggaatccaagtcaaataggagatgagtaccactatggaggcggaaccagtgaggatgacaccatgctggcgcactggactgaagcaaaaattctttcgactcggaccgatg

SEQ ID NO: 4683 - DNA, 203 bp, Homo sapiens
  source 1..203: mol_type = other DNA
ggcgcgccagtccttggacaacatccacctcccaaatggcctagtagctcagctgtacggtcccgaaagagataaaacttacaccatggatggagagtaccgactcagaggcgaagaacgcaagacattcctcgagctcataaaaacagccgatttgccggtgtggcttgcttacaaggtagcgtcaacgactcggaccgatg

SEQ ID NO: 4684 - DNA, 203 bp, Homo sapiens
  source 1..203: mol_type = other DNA
ggcgcgccagtcctggaagtcactaattgaggaaaacgaggtccatatccctccctttgattttttcaccctggatttgaagcctgctactgcttgggctttgtacggaggaagcacagttgtgttgactccactgataaaacatctggtgacatcacagtatgttaccacctcattggcatcaataacgactcggaccgatg

SEQ ID NO: 4685 - DNA, 203 bp, Homo sapiens
  source 1..203: mol_type = other DNA
ggcgcgccagtcctgagcctcggggaacatcgtgcacgcggtgaacatgaccagtcaggtgctcattggaagaatggacaagaagatttggaaaggcccaaaatatgaggaagatgtcaacctgggcagcggcacgagagcagtaggaaaaggtgtgcagcacacggattacaagaggatcaaatccacgactcggaccgatg

SEQ ID NO: 4686 - DNA, 203 bp, Homo sapiens
  source 1..203: mol_type = other DNA
ggcgcgccagtcctctcggaagaggagtccctgccaacaatggagatgaagcccgtgtcagatcgcgaaagcgccacttcgccgaggagtgcaatctgtgaggccccaggaggactgggtaaacaaagccgtaaggcccccgcagcccgggccgggaggaggtgatgcaaaccccggcgaaggactagcgactcggaccgatg

SEQ ID NO: 4687 - DNA, 203 bp, Homo sapiens
  source 1..203: mol_type = other DNA
ggcgcgccagtcctaggttagaggagaccctgcggaagaaatgagtggcccaagctcgccgaagctgtaaggcgggtggacggactagaggttagaggagaccccactctcaaaagcatcaaacaacagcatattgacacctgggaaaagactaggagatcttctgctctattccaacatcagtcacacgactcggaccgatg

SEQ ID NO: 4688 - DNA, 203 bp, Homo sapiens
  source 1..203: mol_type = other DNA
ggcgcgccagtcctgtaaggcgggtggacggactagaggttagaggagaccccactctcaaaagcatcaaacaacagcatattgacacctgggaaaagactaggagatcttctgctctattccaacatcagtcacaaggcaccgagcgccgaacactgtgactgatgggggagaagaccacaggatctcgactcggaccgatg

SEQ ID NO: 4689 - DNA, 203 bp, Homo sapiens
  source 1..203: mol_type = other DNA
ggcgcgccagtcctgcgccagtcctccgatagactgagtcgcccgggtacccgtgtatccaataaatcctcttgctgttgcatccgactcgtggtctcgctgttccttgggagggtctcctcagagtgattgactacccgtctcgggggtctttcatttgggggctcgtccgggatctggagacccctcgactcggaccgatg

SEQ ID NO: 4690 - DNA, 203 bp, Homo sapiens
  source 1..203: mol_type = other DNA
ggcgcgccagtcctacctgggaagctatagcagtagacccccctccctgggtcagacccttcgtgcaccctaaacctcccctctctcttcccccttcagccccctctctcccacctgaacccccactctcgaccccgccccagtcctccctctatccggctctcacttctcctttaaacaccaaacctcgactcggaccgatg

SEQ ID NO: 4691 - DNA, 203 bp, Homo sapiens
  source 1..203: mol_type = other DNA
ggcgcgccagtcctaggcctcaagtccttcctgatagcggaggaccactcattgatctactcacggaggaccctccgccttaccgggacccagggccaccctctcctgacgggaacggcgatagcggagaagtggcccctacagaaggagcccctgacccttccccaatggtatcccgcctgcggggacgactcggaccgatg

SEQ ID NO: 4692 - DNA, 203 bp, Homo sapiens
  source 1..203: mol_type = other DNA
ggcgcgccagtcctagaaaagaaccccccgtggcggattctactacctctcaggcgttcccccttcgcctgggagggaatggacagtatcaatactggccattttcctcctctgacctctataactggaaaaataacaacccctctttctccgaggacccagctaaattgacagctttgatcgagtcccgactcggaccgatg

SEQ ID NO: 4693 - DNA, 203 bp, Homo sapiens
  source 1..203: mol_type = other DNA
ggcgcgccagtcctcccgactgggactacaacacccaacgaggtaggaaccacctagtccactatcgccagttgctcctagcgggtctccaaaacgcgggcagaagccccaccaatttggccaaggtaaaagggataacccagggacctaatgagtctccctcagcctttttagagagactcaaggagcgactcggaccgatg

SEQ ID NO: 4694 - DNA, 203 bp, Homo sapiens
  source 1..203: mol_type = other DNA
ggcgcgccagtcctaaacgagaaaccccggaagaaagagaggaacgtattaggagagaaacagaggaaaaggaagaacgccgtagggcagaggatgtgcagagagagaaggagagggaccgcagaagacatagagaaatgagtaagttgctggctactgtcgttagcgggcagagacaggatagacagcgactcggaccgatg

SEQ ID NO: 4695 - DNA, 203 bp, Homo sapiens
  source 1..203: mol_type = other DNA
ggcgcgccagtccttcaggacaattaacctggaccagactcccgcagggtttcaaaaacagtcccaccctgtttgatgaagccctgcacagggacctcgcagacttccggatccagcacccagacctgattctgctccagtatgtagatgacttactgctggccgccacttctgagcttgactgtcaacgactcggaccgatg

SEQ ID NO: 4696 - DNA, 203 bp, Homo sapiens
  source 1..203: mol_type = other DNA
ggcgcgccagtcctacccctcgacaactaagggagttcctagggacggcaggcttctgtcgcctctggatccctgggtttgcagaaatggcagcccccttgtaccctctcaccaaaacggggactctgtttgagtggggcccagaccagcaaaaggcctaccaagagatcaagcaggctctcttaactcgactcggaccgatg

SEQ ID NO: 4697 - DNA, 203 bp, Homo sapiens
  source 1..203: mol_type = other DNA
ggcgcgccagtcctgcggaggcaaggggcaacaggatggccgaccaagcggcccgagaagtagccactagagaaactccagagacttccacacttctgatagaaaattcagccccctatactcatgaacattttcactatacggtgactgacataaaagatctgactaaactaggggccacttatgaccgactcggaccgatg

SEQ ID NO: 4698 - DNA, 203 bp, Homo sapiens
  source 1..203: mol_type = other DNA
ggcgcgccagtcctgacatcactgagacttgccaagcctgtgcacaggtcaatgccagcaagtctgccgtcaaacaagggactagagttcgagggcaccgacccggcacccactgggaaattgatttcactgaggtaaaacctggcctgtatgggtataaatatcttttagttttcatagacactttccgactcggaccgatg

SEQ ID NO: 4699 - DNA, 203 bp, Homo sapiens
  source 1..203: mol_type = other DNA
ggcgcgccagtccttctggatgggtagaagctttcccaaccaagaaagaaactgccaaagttgtaaccaagaagctactagaagaaatcttccccagattcggcatgccacaggtattgggaaccgacaatgggcctgccttcgtctccaaggtaagtcagacagtagccgatttactgggggttgatcgactcggaccgatg

SEQ ID NO: 4700 - DNA, 203 bp, Homo sapiens
  source 1..203: mol_type = other DNA
ggcgcgccagtcctccggtagtgcctcaccctttccgagtcggtgacacagtgtgggtccgcagacaccaaactaaaaatctagaaccccgctggaaaggaccttataccgtcctactgactacccccaccgctctcaaagtggacggcattgcagcgtggatccacgctgcccacgtaaaggctgcccgactcggaccgatg

SEQ ID NO: 4701 - DNA, 203 bp, Homo sapiens
  source 1..203: mol_type = other DNA
ggcgcgccagtcctgacaccaggattgagccaccatcggaatcgacatggcgtgttcaacgctctcaaaatcccctaaagataagattgacccgcgggacctcctaatccccttaattctcttcctgtctctcaaaggggccagatccgcagcacccggctccagccctcaccaggtctacaacattacgactcggaccgatg

SEQ ID NO: 4702 - DNA, 203 bp, Homo sapiens
  source 1..203: mol_type = other DNA
ggcgcgccagtcctcctgggaagtgaccaatggggatcgggagacagtatgggcaatatcaggcaaccaccctctgtggacttggtggccagtcctcaccccagatttgtgtatgttagctctcagtgggccgccccactgggggctagagtatcaggccccctattcctcgcccccggggcccccttcgactcggaccgatg

SEQ ID NO: 4703 - DNA, 203 bp, Homo sapiens
  source 1..203: mol_type = other DNA
ggcgcgccagtccttaggaacagtcccaaaaactcaccaggccctgtgcaacactacccttaaggcaggcaaagggtcttactatctagttgcccccacaggaactatgtgggcatgtaacactggactcactccatgcctatctgccaccgtgcttaatcgcaccactgactattgcgttctcgtggcgactcggaccgatg

SEQ ID NO: 4704 - DNA, 203 bp, Homo sapiens
  source 1..203: mol_type = other DNA
ggcgcgccagtcctcccagcagtttcagcagctccatgctgccgtacaagatgatctcaaagaagtcgaaaagtcaattactaacctagaaaagtctcttacttcgttgtctgaggttgtactgcagaatcgacgaggcctagacctgttgttcctaaaagagggaggactgtgtgctgccctaaaagcgactcggaccgatg

SEQ ID NO: 4705 - DNA, 203 bp, Homo sapiens
  source 1..203: mol_type = other DNA
ggcgcgccagtcctcattcaggaagtgcttccttctgctcggggtgatacatgagtatacagtagtttgaatcctgtgtgctggtgttgtcttctcggctttttgtgacatcataaataacacctagaagtaatatttttaagaggcttacacctcaggaaggagtgtggctaatgctggtaaggcaccgactcggaccgatg

SEQ ID NO: 4706 - DNA, 203 bp, Homo sapiens
  source 1..203: mol_type = other DNA
ggcgcgccagtcctgactatctctaactcccggagattgtattacatgggactcagcagtcgctactctgttcattagaacatatggacaatatccattacatcagcttggaaatgtgttaaaaggaatagctgatcaagaaggagtagcaacagcatatactctagggatgatgctttctggacaaacgactcggaccgatg

SEQ ID NO: 4707 - DNA, 203 bp, Homo sapiens
  source 1..203: mol_type = other DNA
ggcgcgccagtcctccccaaaatagcacaatgaatacacctgtttatcctgttcctaaaccagatggaaggtggagaatggttttagattatagagaagtaaataaaactatacctttaacagcggcccaaaaccaacattctgctggtatattggccactattgtaagacaaaaatataaaactactcgactcggaccgatg

SEQ ID NO: 4708 - DNA, 203 bp, Homo sapiens
  source 1..203: mol_type = other DNA
ggcgcgccagtcctggtcgtggcctaacggatacttttaaaacaaaattattaaatgttacaccacccaaagatttaaaacaattacagagcatactgggattgttaaattttgctagaaattttatacctaattttgcagaattggtacaaacgttgtataatttaatagcttcatctaagggaaaacgactcggaccgatg

SEQ ID NO: 4709 - DNA, 203 bp, Homo sapiens
  source 1..203: mol_type = other DNA
ggcgcgccagtcctaaaggatatcctaaacaatatacatattatttagaagatggcaaagtaaaagtttccagacctgaaggggttaaaataatacccccacagtcggatcgacaaaaaattgtacttcaagcccacaatttggctcataccggacgtgaagccactcttttaaaaattgccaatcttcgactcggaccgatg

SEQ ID NO: 4710 - DNA, 203 bp, Homo sapiens
  source 1..203: mol_type = other DNA
ggcgcgccagtcctggatatctatatgttttagtaattgttgatggaatgacaggttttacatggttatacccaactaaggctccttctacaagcgcaactgttaaatctctcaatgtactcactagtattgcaattccaaaggtgattcactctgatcaaggtgcagcattcacttcttcaacctttcgactcggaccgatg

SEQ ID NO: 4711 - DNA, 203 bp, Homo sapiens
  source 1..203: mol_type = other DNA
ggcgcgccagtcctaataatacttatagccctgtattaaaatatactccacatcaactcttatttggtatagattcaaatactccatttgcaaaccaagatacacttgatttgacgagagaagaagaactttctcttttacaggaaattcgtgcctctttataccaaccatccacccctcctgcctcccgactcggaccgatg

SEQ ID NO: 4712 - DNA, 203 bp, Homo sapiens
  source 1..203: mol_type = other DNA
ggcgcgccagtccttcacgttcctggtctcctgttgtaggccaattggtccaggagagggtggctaggcctgcatccttgcgaccacgttggcataaaccttccactgttcttgaagtattgaatcctaggactgttgttattttggaccatcttggcaacaacagaactgtaagtattgacaatttacgactcggaccgatg

SEQ ID NO: 4713 - DNA, 203 bp, Homo sapiens
  source 1..203: mol_type = other DNA
ggcgcgccagtcctcactcagagggctgtttatcaacccttgcaaaccagaaggattgcacgttctcttagaatgcaacacccagttccaaaatatatagaggtaaacatgaccagtatcccacaaggtgtatattatgaacctcatccagaacctatagtggtcacggagagggtcttaggtctttccgactcggaccgatg

SEQ ID NO: 4714 - DNA, 203 bp, Homo sapiens
  source 1..203: mol_type = other DNA
ggcgcgccagtcctaaaatgctaccaagaattcgcgcattgctatctggtaaaatataaaactccaaagtcctggccaactgaaggtctcattgcagatcaatgtcccttgccaggatatcatgcaggacttagttataagccacaatcaatatgggattattatataaaagtagaaattacaaggcccgactcggaccgatg

SEQ ID NO: 4715 - DNA, 203 bp, Homo sapiens
  source 1..203: mol_type = other DNA
ggcgcgccagtccttaaattagataaccttacaactgggtcatctctattaaaaaagagagccctgcctaaggaatggagctcacaaggtaaaaatgccttgtttaaggaaattaatgtattggatgtttgcagtaaacctgaattagtaatattgttaaatacttcatattattcattctctttatgcgactcggaccgatg

SEQ ID NO: 4716 - DNA, 203 bp, Homo sapiens
  source 1..203: mol_type = other DNA
ggcgcgccagtccttactgttttattctccctaaaaaattttcttaatcacacaggtaggcctgtaaatgaaatgcctaatgctagagcctttgtgggcctagtagatcctaagtttcccccttcctatcccaatgtaacccgagaacattatacttcttgtaacaataggaaaagaagaagtactgacgactcggaccgatg

SEQ ID NO: 4717 - DNA, 203 bp, Homo sapiens
  source 1..203: mol_type = other DNA
ggcgcgccagtcctaaaacaaacctacaattcacccactgctacggcttgggaaattgggttatattatgaattgactatacctaaacatgtttacttaaacaattggaatgttgtcaatataggtcatttggttcaatcagctggacaattgactcatgtaactatagctcatccatatgaaataatcgactcggaccgatg

SEQ ID NO: 4718 - DNA, 203 bp, Homo sapiens
  source 1..203: mol_type = other DNA
ggcgcgccagtcctaagattaccacatttggttggaattattgcaaaaatcaaggggctaaaaatagaagtcacatcctctggagagagtataaaagaccaaattgaaagagcaaaggctgagcttcttcgactggatatccacgaaggagacactccagcctggatacagcaactagctgcagcaaccgactcggaccgatg

SEQ ID NO: 4719 - DNA, 203 bp, Homo sapiens
  source 1..203: mol_type = other DNA
ggcgcgccagtcctgattcctaccaagaagaagagccagtagcctctacctctggacttcaggacctgcagactcttagtgagcttgttggccctgaaaatgccggagagggagatctggtcattgcagaagaacctgaagaaaacccccgacgccccagaagatacaccaagagagatgttaaatgtcgactcggaccgatg

SEQ ID NO: 4720 - DNA, 203 bp, Homo sapiens
  source 1..203: mol_type = other DNA
ggcgcgccagtcctgtttcttaccatgcttataaagagcttgaggacaaacatcctcaccacattaagctccaagactggattcctaaacctgaagaaatgagtaagtcaatttgtaaaagacttattttatgtggattatatagtggagaaaaggctagagaaatcttaaaaaagccttttacagtacgactcggaccgatg

SEQ ID NO: 4721 - DNA, 203 bp, Homo sapiens
  source 1..203: mol_type = other DNA
ggcgcgccagtcctaaacatcaaaagaactgttctcttgttaaaccttctactagttgcccagaaggtccaaaaccaagacgtaggcacgatcctgtccttcgatgtgacatgtttgaaaagcatcacaagcctcggccgaaacgatccaggaaacgatccatcgatcatgagtcatgtgcttccagtcgactcggaccgatg

SEQ ID NO: 4722 - DNA, 203 bp, Homo sapiens
  source 1..203: mol_type = other DNA
ggcgcgccagtcctggtgacaccgtggccaatgagtcaggaccactatgcaccaacactttttggactcctggaccggtattacaagggctacttggagaatccagcaaccttccagacctggaagttcacatgtcaggaggacccttctggaaagaggtatatggggactcaattctgggtcccccccgactcggaccgatg

SEQ ID NO: 4723 - DNA, 203 bp, Homo sapiens
  source 1..203: mol_type = other DNA
ggcgcgccagtccttctgggtcaggtgaacattcagttttataaaaattaccagattgtaacttgctgccaggccctagatccttttgctaatattttccatggcaccgaggaagaaatgtatgatattgattctgggcctgatgtttggtgcaccccctctttgtgtttcaaagtaatctatgagggcgactcggaccgatg

SEQ ID NO: 4724 - DNA, 203 bp, Homo sapiens
  source 1..203: mol_type = other DNA
ggcgcgccagtcctgggctgtaaggcaggctgtttggcttcgccagtgcttaatttcaaagctctgcagttccatagaactttaatggcagaccttaccaaccctaaaattggacaaggctaccttgcccatggttatcacgctgctatggaagcttatggacctcagagaggaagtagcgaggagagcgactcggaccgatg

SEQ ID NO: 4725 - DNA, 203 bp, Homo sapiens
  source 1..203: mol_type = other DNA
ggcgcgccagtcctttcaaaaccacagacagtaaaagtgtggtaacactttaagcaatattatctttgtcagaatattagaagctttcacatgctcagcagctgtttcgcaactaccaaaataagaatgatgtaataataggaagtagcttacaataggttaagtatgtttactgaagtagataatcccgactcggaccgatg

SEQ ID NO: 4726 - DNA, 203 bp, Homo sapiens
  source 1..203: mol_type = other DNA
ggcgcgccagtcctacctttctatcagtacaatcaagcccattcctccccatgttctcagggtgtgtgcggcgtaagatcgaatccccacacacctgggaacttgattattgcataatattttgttagtcatatagaaaagtaatataggataagttatagggattaaactatgaggtgtgtggctcacgactcggaccgatg

SEQ ID NO: 4727 - DNA, 203 bp, Homo sapiens
  source 1..203: mol_type = other DNA
ggcgcgccagtcctctagtgaacccctgaatggcgatcttaagcgcctctgtagggaagccaggaatgtccaggaggtaccccttccgctcggaagggatctgacctggagacacatcacatgtgctttacacctgtgcttgtgtttaaaaattgtcgcagcttccccaaaccaagtggtcttggtttcgactcggaccgatg

SEQ ID NO: 4728 - DNA, 203 bp, Homo sapiens
  source 1..203: mol_type = other DNA
ggcgcgccagtcctactttaatcagtaccgtggttcactgaattttcttttcgttttcactggtgctgcaatggttaagggcaagtttctcatagcctacaccccgcctggtgcgggaaagcccaccacccgggaccaagctatgcaggctacctacgccatttgggacttgggcttgaattccagctcgactcggaccgatg

SEQ ID NO: 4729 - DNA, 203 bp, Homo sapiens
  source 1..203: mol_type = other DNA
ggcgcgccagtcctccaatggtgccaacttcccactcatgaccaaacaggactacgccttcctctgcttttcccctttcacctactacaagtgtgaccttgaagttaccgttagtgctatgggagcaggcaccgtttcttctgttctgcgctgggcacccaccggggcgcccgcggatgtcactgacccgactcggaccgatg

SEQ ID NO: 4730 - DNA, 203 bp, Homo sapiens
  source 1..203: mol_type = other DNA
ggcgcgccagtcctagctgatcggctatactcctagtcttggtgaaacacgtaacccccacatgtggatcgttggctctggaaattctcaaatttcttttgtcgtaccttacaattcccctctgtccgtcttacccgctgcttggttcaatggatggtccgactttggaaacaccaaggattttggagcgactcggaccgatg

SEQ ID NO: 4731 - DNA, 203 bp, Homo sapiens
  source 1..203: mol_type = other DNA
ggcgcgccagtcctttgagaatcccgcttctctctaccgcattgatcttttcatcacctttactgatgagctcataacttttgactacaaggtccacggacgtcctgtgctcaccttccggattccaggcttcggtctgacaccggcaggcagaatgctcgtgtgcatgggcgagaagcccgcacacacgactcggaccgatg

SEQ ID NO: 4732 - DNA, 203 bp, Homo sapiens
  source 1..203: mol_type = other DNA
ggcgcgccagtcctgtccgttcacctcgtctaaatctctataccatgttatcttcacttccacttgcaattccttcagctttaccatctataaaggacgctaccgctcctggaagaagcccatccacgatgagcttgtggatcgtggttacaccactttccgcgagttcttcaaggctgtgcgcggatcgactcggaccgatg

SEQ ID NO: 4733 - DNA, 203 bp, Homo sapiens
  source 1..203: mol_type = other DNA
ggcgcgccagtcctttagtaaagcaatcacagttgtcactgacttggttgctgcatgggaaaaagcaaaaaccactctggtctctcctgaattttggtcagaacttatattaaaaactaccaagttcattgctgcttccgtgctctaccttcacaaccctgacttcactaccactgtttgtctctcatcgactcggaccgatg

SEQ ID NO: 4734 - DNA, 203 bp, Homo sapiens
  source 1..203: mol_type = other DNA
ggcgcgccagtccttgatgactggtgtagacctcctcaccaatgattctgtttttgattggcttaagagcaaattgtcctccttctttcgtactcctcccccagcttgccccaatgtcatgcaacctcaggggcctctacgcgaggccaatgagggttttacctttgccaagaatattgaatgggccacgactcggaccgatg

SEQ ID NO: 4735 - DNA, 203 bp, Homo sapiens
  source 1..203: mol_type = other DNA
ggcgcgccagtcctaatctgtttctaagatggcctttggccgtcagtctgtttattctatgccccccgattcggaatattttgatggctatgaaaatcaattttctgtgattatggatgatctaggacaaaatcccgatggtgaagatttcaccgtcttttgtcaaatggtttctagcacaaattttccgactcggaccgatg

SEQ ID NO: 4736 - DNA, 203 bp, Homo sapiens
  source 1..203: mol_type = other DNA
ggcgcgccagtcctccacaggatctgtcgtacatgtccccagaaagaccaaactgaggagaacagtcgctcatgacgttttccaacccaaattcgaacctgcagttctgtcccgttatgaccctgggaccgacaaggatgtagatgttgtagccttctccaaacacactactaacatggaaagcttgccgactcggaccgatg

SEQ ID NO: 4737 - DNA, 203 bp, Homo sapiens
  source 1..203: mol_type = other DNA
ggcgcgccagtcctctccaatctttgacattgtctgcggtgaatacgctaaccgtgttttcaccatccttggtaaagacaacggtctcttaaccgttgaacaggctgtgcttggcttgtcgggcatggaccccatggagaaggacacctcccctggattgccctacactcaacaaggactcagacgaacgactcggaccgatg

SEQ ID NO: 4738 - DNA, 203 bp, Homo sapiens
  source 1..203: mol_type = other DNA
ggcgcgccagtcctaatgtagtcttatgcaatactcttgtagtcttgcaacatgcttatgtaacgatgagttagcaacatgccttataaggaaagaaaaagcaccgtgcatgccgattggtggaagtaaggtggtatgatcgtggtatgatcgtggtatgatcgtgccttattaggaaggcaacagaccgactcggaccgatg

SEQ ID NO: 4739 - DNA, 203 bp, Homo sapiens
  source 1..203: mol_type = other DNA
ggcgcgccagtcctgggtctaacacggattggacgaaccactgaattccgcattgcagagatattgtatttaagtgcctagctcgatacaataaacgccatttgaccattcaccacattggtgtgcacctgggttgatggcgggaccgttgattccctgacgactacgagcacatgcatgaagcagaacgactcggaccgatg

SEQ ID NO: 4740 - DNA, 203 bp, Homo sapiens
  source 1..203: mol_type = other DNA
ggcgcgccagtcctggcttcatttggtgaccccgacgtgatcgttagggaatagtggtcggccacaggcggcgtggcgatcctgtcctcatccgtctcgcttattcggggagcggacgatgaccctagtagagggggctgcggcttaggagggcagaagctgagtgacgtcggagggagctccacggccgactcggaccgatg

SEQ ID NO: 4741 - DNA, 203 bp, Homo sapiens
  source 1..203: mol_type = other DNA
ggcgcgccagtcctccgcccctctcgcccagctgccgctccaacctggccgccgcctcctgcttcccttccaccgccgaccagctggagatggtgacggagctgctcgggggggacatggtcaaccagagctccatctgcgacccggacgacgaatccttcgtcaaatccatcatcatccgggactgccgactcggaccgatg

SEQ ID NO: 4742 - DNA, 203 bp, Homo sapiens
  source 1..203: mol_type = other DNA
ggcgcgccagtcctaggcaacagacgggtctaacacggattggacgaaccactgaattccgcattgcagagatattgtatttaagtgcctagctcgatacaataaacgccatttgaccattcaccacattggtgtgcacctgggttgatggcgggaccgttgattccctgacgactacgagcacatgccgactcggaccgatg

SEQ ID NO: 4743 - DNA, 203 bp, Homo sapiens
  source 1..203: mol_type = other DNA
ggcgcgccagtccttcgcttaatcggggagcggacgatgaccctagcagagggggctgcggcttaggagggcagaagctgagtgacgtcggagggagctccacggccgggggccaagataacctaccgagaactcagagagtcgttggaagacgggaaggaagcccaacgactgagcagtccaccccacgactcggaccgatg

SEQ ID NO: 4744 - DNA, 203 bp, Homo sapiens
  source 1..203: mol_type = other DNA
ggcgcgccagtccttcccccaggtccggagtgcatcgagaaaccagcaacggagcggcgaatcgacaagggagaaacaactgtgcagcgagatacgaagatggcgccggaggaaacggccacacctaaaaccgttggcacatcctgctatcattgcggaacagctattggctgtaattgcgccacagccgactcggaccgatg

SEQ ID NO: 4745 - DNA, 203 bp, Homo sapiens
  source 1..203: mol_type = other DNA
ggcgcgccagtcctctccccgctgctgccgcatgacgtcacgaatccaatgagagttattttaggacccgccccacatgccttatggatggacgcttgggctgcgtcaggtcagttgcaccggccccaaccccaggaacacaccagcaccagcgctgcagcggggacctggcggctcactcaggcttccgactcggaccgatg

SEQ ID NO: 4746 - DNA, 203 bp, Homo sapiens
  source 1..203: mol_type = other DNA
ggcgcgccagtcctggagtcgcggcacaggctgccccactgctctgcagccccatcccaccaggatcacagtgccatgggctttgggccggagctgtggtgcccgaaggggcacactgagctgctgcggctgcaggacagcgagttgcgcctcctggagctgatgaagaagtggatgtcacagcgtgccgactcggaccgatg

SEQ ID NO: 4747 - DNA, 203 bp, Homo sapiens
  source 1..203: mol_type = other DNA
ggcgcgccagtccttaagagcgaccgggagtacgcggggatgctgcaccacatgttctctcagctggagaaacaggagggcctgggacatctccgtgccaccgaccacagcagccagatcggggagtcgtggtgggttctggcaagccagactgagacactgagccagacgctgcggcggcacgcggacgactcggaccgatg

SEQ ID NO: 4748 - DNA, 203 bp, Homo sapiens
  source 1..203: mol_type = other DNA
ggcgcgccagtcctgagcagcaaggagcagcgggtgtgggagctgcaggttgagctgcggggcgaggagctggcactcagccctggggagcgggtgcacttgctgggcaagcggcaggggctgcgggaggcccagcagcagctgcagggcttggtctgtgctcaggccaagctgcaggcacagcgggacgactcggaccgatg

SEQ ID NO: 4749 - DNA, 203 bp, Homo sapiens
  source 1..203: mol_type = other DNA
ggcgcgccagtcctacctcccgtgcccctcatcccggaggtgcagaagccgctgtgccagcaggcctggtaccacggggccatcccgcgctcggaggtgcaggagctgctgaaatacagcggagacttcctggtgcgggagagccaggggaagcaggagtatgtgctcagcgtgctgtgggatgggcacgactcggaccgatg

SEQ ID NO: 4750 - DNA, 203 bp, Homo sapiens
  source 1..203: mol_type = other DNA
ggcgcgccagtccttcccaacatcgtccggctcatcggcgtctgcacccagaagcagcccatttacatcgtcatggagctggtgcagggaggggacttcctgagcttcctgcgcagcaaggggccccgcctgaagatgaagaagctgatcaagatgatggagaatgccgcggcgggcatggagtacctcgactcggaccgatg

SEQ ID NO: 4751 - DNA, 203 bp, Homo sapiens
  source 1..203: mol_type = other DNA
ggcgcgccagtcctggaaagcaagcactgcatccacagggacctggctgcccgcaactgcctggtgacagaaaagaacaccctgaaaatcagcgactttgggatgtcgcggcaggaggaggatggtgtctatgcctccacggggggcatgaagcagatccccgtgaaatggactgcccccgaggctctcgactcggaccgatg

SEQ ID NO: 4752 - DNA, 203 bp, Homo sapiens
  source 1..203: mol_type = other DNA
ggcgcgccagtcctgaattacggctggtacagctcggagagcgacgtgtggagctttgggatcctgctgtgggaagccttcagcctgggcgccgtgccctacgccaacctcagcaaccagcagacgcgcgaggccatcgagcagggcgtgcggctggagcccccggagcagtgccccgaggacgtgtacgactcggaccgatg

SEQ ID NO: 4753 - DNA, 203 bp, Homo sapiens
  source 1..203: mol_type = other DNA
ggcgcgccagtcctgaagcggaaggcttcattgatgttgccagttagtcatcattgccacttagtcatcattacataagacagtctaaagtcctaaaaaggaaaaacaagacatctcggatgtcattggctgcaaccagtaaggaagtagtggcgtgaggatcacccgatgggtgtaacccagaaggccgactcggaccgatg

SEQ ID NO: 4754 - DNA, 203 bp, Homo sapiens
  source 1..203: mol_type = other DNA
ggcgcgccagtcctggcaagggtcagggaggagcttgcgagtactggtccgcccgtggtggccatgcctgtagtgattaagacagagggacccgcttggacccctctggagccaaaattgatcacaagactggctgatacggtcaggaccaagggcttacgatccccgattactatggcagaagtggacgactcggaccgatg

SEQ ID NO: 4755 - DNA, 203 bp, Homo sapiens
  source 1..203: mol_type = other DNA
ggcgcgccagtcctaggagagataattaaatatgtgctagacaggcagaagactgcccctcttacggatcaaggcatagccgcggccatgtcgtctgctatccagcccttaattatggcagtagtcaatagagagagggatggacaaactgggtcgggtggtcgtgcccgagggctctgctacacttgcgactcggaccgatg

SEQ ID NO: 4756 - DNA, 203 bp, Homo sapiens
  source 1..203: mol_type = other DNA
ggcgcgccagtccttggatccccgggacattatcaggcgcagtgcccgaaaaaacggaagtcaggaaacagccgtgagcgatgtcagttgtgtaacgggatgggacacaacgctaaacagtgtaggaagcgggatggcaaccagggccaacgcccaggaaaaggtctctcttcggggccgtggcccggcgactcggaccgatg

SEQ ID NO: 4757 - DNA, 203 bp, Homo sapiens
  source 1..203: mol_type = other DNA
ggcgcgccagtcctccctgagccacctgccgtctcgttagcgatgacaatggaacataaagatcgccccttggttagggtcattctgactaacactgggagtcatccggtcaaacagcgttcggtgtatatcaccgcgctgttggactctggagcggacatcactattatttcagaggaggattggcccgactcggaccgatg

SEQ ID NO: 4758 - DNA, 203 bp, Homo sapiens
  source 1..203: mol_type = other DNA
ggcgcgccagtcctttagtggaaaaagaattacagttaggacatatagaaccttcacttagttgttggaacacacctgtcttcgtgatccggaaggcttccgggtcttaccgcttactgcatgatttgcgcgctgttaacgccaagcttgttccttttggggccgtccaacagggggcgccagttctccgactcggaccgatg

SEQ ID NO: 4759 - DNA, 203 bp, Homo sapiens
  source 1..203: mol_type = other DNA
ggcgcgccagtcctactatttcgcctgataaggtccagagggagcccggagtacaatatcttgggtacaagttaggcagtacgtatgtagcacccgtaggcctggtagcagaacccaggatagccaccttgtgggatgttcaaaagctggtggggtcacttcagtggcttcgcccagcgttaggaatccgactcggaccgatg

SEQ ID NO: 4760 - DNA, 203 bp, Homo sapiens
  source 1..203: mol_type = other DNA
ggcgcgccagtcctccgccacgactgatgggccccttctatgagcagttacgagggtcagatcctaacgaggcgagggaatggaatctagacatgaaaatggcctggagagagatcgtacggcttagcaccactgctgccttggaacgatgggaccctgccctgcctctggaaggagcggtcgctagacgactcggaccgatg

SEQ ID NO: 4761 - DNA, 203 bp, Homo sapiens
  source 1..203: mol_type = other DNA
ggcgcgccagtccttgtgaacagggggcaataggggttttgggacagggactgtccacacacccaaggccatgcttgtggttattctccacccaacccaccaaggcgtttactgcttggttagaagtgctcacccttttgattactaagctacgtgcttcggcagtgcgaacctttggcaaggaggtccgactcggaccgatg

SEQ ID NO: 4762 - DNA, 203 bp, Homo sapiens
  source 1..203: mol_type = other DNA
ggcgcgccagtcctgatatcctcctgttgcctgcatgctttcgggaggaccttccgctcccagaggggatcctgttagcccttaaggggtttgcaggaaaaatcaggagtagtgacacgccatctatttttgacattgcgcgtccactgcatgtttctctgaaagtgagggttaccgaccaccctgtgcgactcggaccgatg

SEQ ID NO: 4763 - DNA, 203 bp, Homo sapiens
  source 1..203: mol_type = other DNA
ggcgcgccagtcctacagaaggacccccggttaaaatacgaatagagacaggggagtgggaaaaaggatggaacgtgctggtctggggacgaggttatgccgctgtgaaaaacagggacactgataaggttatttgggtaccctctcgaaaagttaaaccggacatcacccaaaaggatgaggtgactcgactcggaccgatg

SEQ ID NO: 4764 - DNA, 203 bp, Homo sapiens
  source 1..203: mol_type = other DNA
ggcgcgccagtcctgtgtgaggttacgggggtaagagctgatgttcacttactcgagcagccagggaacctttggattacatgggccaaccgtacaggccaaacggatttctgcctctctacacagtcagccacctccccttttcaaacatgtttgataggtatcccgtctcctatttccgaaggtgacgactcggaccgatg

SEQ ID NO: 4765 - DNA, 203 bp, Homo sapiens
  source 1..203: mol_type = other DNA
ggcgcgccagtcctttttaagggatatgtttctgatacaaattgctccactgtgggaactgaccggttagtcttgtcagccagcattaccggcggccctgacaacagcaccaccctcacttatcgaaaggtttcatgcctgctgttaaagctgaacgtctccatgtgggatgagccacctgaactgcacgactcggaccgatg

SEQ ID NO: 4766 - DNA, 203 bp, Homo sapiens
  source 1..203: mol_type = other DNA
ggcgcgccagtcctgctgctaggttcccagtctctccctaacgttactaacattactcaggtctctggcgtggccgggggatgtgtatatttcgccccaagggccactggcctgtttttaggttggtctaaacaaggtctctcgcggttcctcctccgtcacccctttacctccacctctaactccaccgactcggaccgatg

SEQ ID NO: 4767 - DNA, 203 bp, Homo sapiens
  source 1..203: mol_type = other DNA
ggcgcgccagtcctggaaccgttcacggtggtgacagcggatagacacaatctttttatggggagtgagtactgtggtgcatatggctacagattttgggaaatatataactgctcacagactaggaatacttaccgctgtggagacgtgggaggtactggcctccctgaaacctggtgcagaggaaacgactcggaccgatg

SEQ ID NO: 4768 - DNA, 203 bp, Homo sapiens
  source 1..203: mol_type = other DNA
ggcgcgccagtcctcctcggggacttattggatgatgtcacgagtattcgacacgcggtcctgcagaaccgagcggctattgacttcttgcttctagctcacggccatggctgtgaggacgttgccggaatgtgttgtttcaatctgagtgatcacagtgaatctatacagaagaagttccagctaatcgactcggaccgatg

SEQ ID NO: 4769 - DNA, 203 bp, Homo sapiens
  source 1..203: mol_type = other DNA
ggcgcgccagtcctgaagaaacatgtcaataagatcggcgtggacagcgacccaatcggaagttggctgcgagggatattcgggggaataggggaatgggccgttcatctgctaaaaggactgcttttggggcttgtagttattttattgctactggtgtgcctgccttgccttttacaatttgtgtccgactcggaccgatg

SEQ ID NO: 4770 - DNA, 203 bp, Homo sapiens
  source 1..203: mol_type = other DNA
ggcgcgccagtccttgtaacgcgcttaggaagtcccctcgaggtatggcagatatgctcttgcatagggggaaaaaatgtagtcttaatattgtctgtgtgctgcaggagctaagctgactctgctggtggcctcgcgtaccactgtggccaggcggtagctgggacgtgcagccgaccaccatggggcgactcggaccgatg

SEQ ID NO: 4771 - DNA, 203 bp, Homo sapiens
  source 1..203: mol_type = other DNA
ggcgcgccagtcctttctggggcttcaacacttctgacaccgtcacgtcgccgcagcgtgccggggcactggctggcggcgtcaccactttcgtggctctctacgactacgagtcctggactgaaacggacttgtccttcaagaaaggagaacgcctgcagattgtcaacaacacggaaggtgactggcgactcggaccgatg

SEQ ID NO: 4772 - DNA, 203 bp, Homo sapiens
  source 1..203: mol_type = other DNA
ggcgcgccagtccttggctggctcattccctcactacaggacagacgggctacatccccagtaactatgtcgcgccctcagactccatccaggctgaagagtggtactttgggaagatcactcgtcgggagtccgagcggctgctgcttaaccccgaaaacccccggggaaccttcttggtccggaagcgactcggaccgatg

SEQ ID NO: 4773 - DNA, 203 bp, Homo sapiens
  source 1..203: mol_type = other DNA
ggcgcgccagtcctaagggagagatgggcaagtacctgcggctgccacagctcgtcgatatggctgctcagattgcatccggcatggcctatgtggagagaatgaactacgtgcaccgagacctgcgggcggccaacatcctggtgggggagaacctggtgtgcaaggtggctgacttcgggctggcacgactcggaccgatg

SEQ ID NO: 4774 - DNA, 203 bp, Homo sapiens
  source 1..203: mol_type = other DNA
ggcgcgccagtcctcgcctcatcgaggacaacgagtacacagcacggcaaggtgccaagttccccatcaagtggacagcccccgaggcagccctctatggccggttcaccatcaagtcggatgtctggtccttcggcatcctgctgactgagctgaccaccaagggccgggtgccatacccagggatgcgactcggaccgatg

SEQ ID NO: 4775 - DNA, 203 bp, Homo sapiens
  source 1..203: mol_type = other DNA
ggcgcgccagtcctgtcaacagggaggtgctggaccaggtggagaggggctaccgcatgccctgcccgcccgagtgccccgagtcgctgcatgacctcatgtgccagtgctggcggaaggaccctgaggagcggcccacctttaagtacctgcaggcccagctgctccctgcttgtgtgttggaggtccgactcggaccgatg

SEQ ID NO: 4776 - DNA, 203 bp, Homo sapiens
  source 1..203: mol_type = other DNA
ggcgcgccagtccttaggaatcccctcaggacaattctgcttggaatatgatggcgtcttccctgttttgcccttagactattcgagttgcctctgtggattagggctggaggcagcacggatagtctgatggccaaataaggcaggcaagacagctatttgtaactgcgaaatacgcttttgcatagcgactcggaccgatg

SEQ ID NO: 4777 - DNA, 203 bp, Homo sapiens
  source 1..203: mol_type = other DNA
ggcgcgccagtcctgggatcccatcactgcggcgctctcccagcgggcaatggtacttgggaaatcgggagagttaaaaacctggggattggttttgggggcattgaaggcggctcgagaggaacaggttacatctgagcaagcaaagttttggttgggattagggggagggagggtctctcccccagcgactcggaccgatg

SEQ ID NO: 4778 - DNA, 203 bp, Homo sapiens
  source 1..203: mol_type = other DNA
ggcgcgccagtcctgtccggagtgcatcgagaaaccagcaacggagcggcgaatcgacaaaggggaggaagtgggagaaacaactgcgcagcgagatgcgaagatggcgccggagaaaatggccacacctaaaaccgttggcacatcctgctatcagtgcggaacagctactggctgtaattgcgccacgactcggaccgatg

SEQ ID NO: 4779 - DNA, 203 bp, Homo sapiens
  source 1..203: mol_type = other DNA
ggcgcgccagtcctcatctgagtcctttgttgattttgccaatcggcttataaaggcggttgaggggtcagatctcccgccttccgcgcgggctccggtgatcattgactgctttaggcagaagtcacagccagatattcagcagcttatacgggcagcaccctccacgctgaccaccccaggagagacgactcggaccgatg

SEQ ID NO: 4780 - DNA, 203 bp, Homo sapiens
  source 1..203: mol_type = other DNA
ggcgcgccagtccttaatcaaatatgtgctagacaggcagaagattgcccctcttacggatcaaggcatagccgcggccatgtcgtctgctatccagcccttagttatggcagtagtcaatagagagagggatggacaaactgggtcgggtggtcgtgcccgagggctctgctacacttgtggatccccgactcggaccgatg

SEQ ID NO: 4781 - DNA, 203 bp, Homo sapiens
  source 1..203: mol_type = other DNA
ggcgcgccagtcctaaaagaattacagttaggacatatagaaccttcacttagttgttggaacacacctgtctttgtgatccggaaggcttccgggtcttatcgcttattgcatgacttgcgcgctgttaacgccaagcttgttccttttggggccgtccaacagggggcgccagttctctccgcgctcgactcggaccgatg

SEQ ID NO: 4782 - DNA, 203 bp, Homo sapiens
  source 1..203: mol_type = other DNA
ggcgcgccagtcctgcctgataagatccagagggaacccggagtacaatatcttgggtacaagttaggcagtacgtatgtagcacccgtaggcctggtagcagaacccaggatagccaccttgtgggatgttcaaaagctggtggggtcacttcagtggcttcgcccagcgttaggaatcccgccacgcgactcggaccgatg

SEQ ID NO: 4783 - DNA, 203 bp, Homo sapiens
  source 1..203: mol_type = other DNA
ggcgcgccagtcctgggggcaataggggtcctgggacagggactgtccacacacccaaggccatgtttgtggttattctccacccaacccaccaaggcgtttactgcttggttagaagtgctcacccttttgattactaagctacgcgcttcggcagtgcgaacctttggcaaggaggttgatatcctcgactcggaccgatg

SEQ ID NO: 4784 - DNA, 203 bp, Homo sapiens
  source 1..203: mol_type = other DNA
ggcgcgccagtcctcgtggcagatagccaagccacctttcaagcgtatcccttgagagaggctaaagatcttcatactgctctccatattggaccccgcgcgctatccaaagcgtgtaatatatctatgcagcaggctagggaggttgttcagacctgcccgcattgtaattcagcccctgcgttggacgactcggaccgatg

SEQ ID NO: 4785 - DNA, 203 bp, Homo sapiens
  source 1..203: mol_type = other DNA
ggcgcgccagtcctttacgggggtaagagctgatgtccacttactcgagcagccagggaacctttggattacatgggccaaccgtacaggccaaacggatttttgcctctctacacagtcagccacctccccttttcaaacatgtttgataggtatcccgtcccctatttccgaaggtgattttaaggcgactcggaccgatg

SEQ ID NO: 4786 - DNA, 203 bp, Homo sapiens
  source 1..203: mol_type = other DNA
ggcgcgccagtcctcccagtctctccctaacattactaatattgctcagatttccggtataaccgggggatgcgtaggtttcagaccacaaggggttccttggtatctaggttggtctagacaggaggccacgcggtttctccttagacacccctctttctctaaatccacggaaccgtttacggtggcgactcggaccgatg

SEQ ID NO: 4787 - DNA, 203 bp, Homo sapiens
  source 1..203: mol_type = other DNA
ggcgcgccagtccttggatgatgtcacgagtattcgacacgcggtcctgcagaaccgagcggctattgacttcttgcttctggctcacggccatggctgtgaggacgttgccggaatgtgttgtttcaatctgagtgatcacagtgagtctatacagaagaagttccagctaatgaaggaacatgtcacgactcggaccgatg

SEQ ID NO: 4788 - DNA, 203 bp, Homo sapiens
  source 1..203: mol_type = other DNA
ggcgcgccagtcctttcagctcgtgtagctcattagctccgagctccccaacctacagcctgagaggcactggctcggttgggtagccagcctttcgggtaataaaggcttgttggcattcggcatctacccgtgcctcctgtcttgtcttactcgagcgaacccacaactccgtcctgctgagctcacgactcggaccgatg

SEQ ID NO: 4789 - DNA, 203 bp, Homo sapiens
  source 1..203: mol_type = other DNA
ggcgcgccagtcctaatatattaggggtcattacagcaaacctagtacaggaagaaattaaactcctcttgaatagtacacccaagtggagattagatgtacaacttatagaatcaaaagtaagagagaaagaaaatgcccacagaacgtggaaacagcatcatccagaagccccaaaaacagatgaacgactcggaccgatg

SEQ ID NO: 4790 - DNA, 203 bp, Homo sapiens
  source 1..203: mol_type = other DNA
ggcgcgccagtcctataaatagattagtggcagcccttgaaggtatggcggctccagaaaccacaaaagaatacttactccaacatctatctattgatcatgccaatgaagactgccagtctattctaagacctttgggacccaacaccccaatggagaaaaaattagaagcatgtagggtagtgggacgactcggaccgatg

SEQ ID NO: 4791 - DNA, 203 bp, Homo sapiens
  source 1..203: mol_type = other DNA
ggcgcgccagtcctggaagacccacgtagagtggagatttaaggataagactgggataattgatgtcttgttctcagatactcctgtaaacctttttgggagatctcttctacgtagcatagtgacttgcttcaccctacttgttcacacagaaaaaatcgaacccctacccgtcaaggtaaggggaccgactcggaccgatg

SEQ ID NO: 4792 - DNA, 203 bp, Homo sapiens
  source 1..203: mol_type = other DNA
ggcgcgccagtcctaagaaacagcactacaagtagctctctgcattttacagctaatccagagatatacagttcttcacttacatagtgacaacgggccgtgctttactgcacacaggatagaaaatctatgtaagtatctggggatcacaaaaactacgggaataccctacaacccacaatcccaggcgactcggaccgatg

SEQ ID NO: 4793 - DNA, 203 bp, Homo sapiens
  source 1..203: mol_type = other DNA
ggcgcgccagtcctgagttgtagaaagagcccacagagatctaaaagacagattggcagcttatcagggagattgtgaaaccgtagaagcagcccttagcctcgcattagtttctttaaataaaaaaagagggggaatagggggccatacaccatatgaaatatacctagaatcagaacataccaaatcgactcggaccgatg

SEQ ID NO: 4794 - DNA, 203 bp, Homo sapiens
  source 1..203: mol_type = other DNA
ggcgcgccagtcctagctggaacacacaccactgaagaaataggtcacttagatctcttttggcttaggtactgttcatgtccgcatgagatgcccccgtggctagacttccttagaggcaccctcaatctacgcatttcctgtcgacgcgctcttcaagcgtcagtgttgactagcacccctagacacgactcggaccgatg

SEQ ID NO: 4795 - DNA, 203 bp, Homo sapiens
  source 1..203: mol_type = other DNA
ggcgcgccagtcctctccctccaacgcttagctgcacttcagctgtgcactaacgcatgtctctgttggtacccgttaggacgcatcaacgacaccaccccgttgtggttgaacttttcgtctgggaaggaaccaacgatccaacaactgagtggccacccctaactcgtcgtaacattcatagattgcgactcggaccgatg

SEQ ID NO: 4796 - DNA, 203 bp, Homo sapiens
  source 1..203: mol_type = other DNA
ggcgcgccagtccttggcaatatgcccggaccttgggtggcgatgataatgttgccacagcccaaagaaagctttggaggaaagccaattggctggcttttctggaacacgtgcaaaggacctaggcgggactgtccacattgttgttgtcccatatgtagttggcattgtcagctttgctttttgcacgactcggaccgatg

SEQ ID NO: 4797 - DNA, 203 bp, Homo sapiens
  source 1..203: mol_type = other DNA
ggcgcgccagtcctgaaaaatctaggaatcaactatggatcaggacctagacggcgcggaacgcggggaaaggggaggaggatccgaagaactgcttcaggaggagatcaacgaagggaggctgacagccagagaagctttacaaacatggatcaataacggtgagatccacccttgggtcctggcagcgactcggaccgatg

SEQ ID NO: 4798 - DNA, 203 bp, Homo sapiens
  source 1..203: mol_type = other DNA
ggcgcgccagtcctgtcattccttctcaaaacaggcctctgcccggtggattcttgtaaaggtccccagctatgggtttgtggtagtaaatgacacagatacaccaccatccctccgcatccgaaagcctcgagcagtcggactagcaatattcctgcttgtgctggctatcatggccatcacatcctcgactcggaccgatg

SEQ ID NO: 4799 - DNA, 203 bp, Homo sapiens
  source 1..203: mol_type = other DNA
ggcgcgccagtcctttatcttctcagctgattgtggttaggccgattactggaaactagacaacctgattcattagtggttaagattatgcataagtgctcgcaatgatgtagctgcttacgcttgcttactccgccctgaaacgcctaccttaacacgcaacacgcccacctgtaagaatatataaacgactcggaccgatg

SEQ ID NO: 4800 - DNA, 203 bp, Homo sapiens
  source 1..203: mol_type = other DNA
ggcgcgccagtcctgaagcgttctcctcctgagaccctagtgctcagctctcggtcctgagctctcttgctcccgagaccttctggtcggctatccggcagcggtcaggtaaggcaaaccacggtttggagggtggttctcggctgagaccgccgcgagctctatctccggtcctctgaccgtctccacgactcggaccgatg

SEQ ID NO: 4801 - DNA, 203 bp, Homo sapiens
  source 1..203: mol_type = other DNA
ggcgcgccagtcctcgtggactctctctcttgcctcctgaccccgcgctccaagggcgtctggcttgcacccgcgtttgtttcctgtcttactttctgtttctcgcggcccgcgctctctccctcggcgccctctagcggccaggagagaccggcaaacaattgggggctcgtccgggattgatcacccgactcggaccgatg

SEQ ID NO: 4802 - DNA, 203 bp, Homo sapiens
  source 1..203: mol_type = other DNA
ggcgcgccagtcctccggaaccctaacgatcctctggacccaccccctcggcggcgttttgggtctttcctttaaattatatcatgggaaattccccctcctataacccccccgctggtatctccccctcagactggctcaaccttcgtcaaagcgcgcaaaggctcaatccgcgaccctctcctagccgactcggaccgatg

SEQ ID NO: 4803 - DNA, 203 bp, Homo sapiens
  source 1..203: mol_type = other DNA
ggcgcgccagtcctgcaatcttacaggccgaccctactcctgctgacctagaacaactttgccaatatattgcttccccggtcgatcaaacggcccacatgaccagcctaacggcagcaatagccgccgctgaagcggccaataccctccagggttttaatccccaaaatgggaccctgacccaacaacgactcggaccgatg

SEQ ID NO: 4804 - DNA, 203 bp, Homo sapiens
  source 1..203: mol_type = other DNA
ggcgcgccagtcctcacaccccagggcccaagatgcccgggcctcggcaaccggcccccaaaaggccccccccgggaccatgctatcgatgcctcaaagaaggccattgggcccgggactgtcccaccaagaccaccggcccccctccgggaccttgtcccatatgtaaagatccttcccattggaaacgactcggaccgatg

SEQ ID NO: 4805 - DNA, 203 bp, Homo sapiens
  source 1..203: mol_type = other DNA
ggcgcgccagtcctcgagactgtccaaccctcaaatcaaaaaactaatagaggggggacttagcgccccccaaaccgtaacccctataacagatcctcttagtgaggccgaattagaatgcctactttctattcctctggctcgcagccgtccctccgtggctgtatacctgtctggcccctggctgccgactcggaccgatg

SEQ ID NO: 4806 - DNA, 203 bp, Homo sapiens
  source 1..203: mol_type = other DNA
ggcgcgccagtcctagccctctcagaatcaagcccttatgctcgtggacaccggggctgaaaatacggtcctcccacaaaattggctggttcgagattacccacggatccccgccgcggtgctcggagcagggggagtctcccggaacagatacaattggctacaaggccctctgaccctggctctaacgactcggaccgatg

SEQ ID NO: 4807 - DNA, 203 bp, Homo sapiens
  source 1..203: mol_type = other DNA
ggcgcgccagtcctcctccctacccccgggggactccaacctcacagacgctttgcctggcgggtcctacctcaaggcttcattaacagcccagctcttttcgaacgggcactacaggaaccccttcgccaagtttccgccgccttctcccagtctcttctggtgtcctatatggacgatatccttatcgactcggaccgatg

SEQ ID NO: 4808 - DNA, 203 bp, Homo sapiens
  source 1..203: mol_type = other DNA
ggcgcgccagtcctcgcttcgcctacagaagaacaacggtcacaatgttatcaagccctggctgcccgcctccgggacctagggtttcaggtggcgtctgaaaagactcgccagacgccttcgcccgtccccttcttgggacaaatggtccataaccagattgtcacctatcagtccctacctaccttcgactcggaccgatg

SEQ ID NO: 4809 - DNA, 203 bp, Homo sapiens
  source 1..203: mol_type = other DNA
ggcgcgccagtcctgcagatctcatccccaatttctcttcaccaattacaggcggtcttgggagacctccagtgggtctctaggggcacacccactacccgccggcccctgcaacttctctactcttcccttaaaggcatcgatgaccctagggccatcatccagctttccccggaacagctacaaggcgactcggaccgatg

SEQ ID NO: 4810 - DNA, 203 bp, Homo sapiens
  source 1..203: mol_type = other DNA
ggcgcgccagtcctcattgcagagcttcgacaagccctgtcccataacgcaagatctagatataacgagcaagaacccctgctggcctacgtacacctaacccgggcagggtccaccctggtactcttccaaaagggcgctcaatttcccctggcctactttcagacccccttgactgacaaccaagccgactcggaccgatg

SEQ ID NO: 4811 - DNA, 203 bp, Homo sapiens
  source 1..203: mol_type = other DNA
ggcgcgccagtcctctcaccttggggcctccttctcctgctgggatgccaatacctgcagactcaggccttaagctcttatgccaagcccatactcaaatactatcacaatcttcctaaaacctctctcgacaattggattcaatcatctgaggaccctcgagttcaggagttgttgcaattgtggcccgactcggaccgatg

SEQ ID NO: 4812 - DNA, 203 bp, Homo sapiens
  source 1..203: mol_type = other DNA
ggcgcgccagtcctctccaaaacctttgtcaggttttgccagcagttcggaatttccctttctcatcacgttccctacaaccccacaagttcagggttggtagagcggacaaatggactgctcaaacttcttttgtctaaatatcacctagacgaaccccaccttcccatgactcaggccctttctcgcgactcggaccgatg

SEQ ID NO: 4813 - DNA, 203 bp, Homo sapiens
  source 1..203: mol_type = other DNA
ggcgcgccagtcctcagcccatccagacttggagatgctccctgtccctaggaaatcaacaatggatgacaacatataaccaagaggcaaaattttccatctccattgaccaaatattagaggctcacaatcaatcacctttctgtcccaggtctcccagatacaccttggacttcgtaaatggttatcgactcggaccgatg

SEQ ID NO: 4814 - DNA, 203 bp, Homo sapiens
  source 1..203: mol_type = other DNA
ggcgcgccagtcctttattcctgcatctcaaacaatgtcatggaattttcactctaacctgggaaatatggggatatgatcccctgatcaccttttctttacataaaattcctgatccccctcaacccgacttccctcagctgaacagtgactgggttccctctgtcagatcatgggccctgcttttacgactcggaccgatg

SEQ ID NO: 4815 - DNA, 203 bp, Homo sapiens
  source 1..203: mol_type = other DNA
ggcgcgccagtcctaatcaaacggcacgggccttcccagactgtgctatatgttgggaaccttcccctccctgggctcccgaaatattagtatataacaaaaccatctccggctctggacccggtctcgccctcccggacgcccaaatcttctgggtcaacacgtccttgtttaacaccacccaaggacgactcggaccgatg

SEQ ID NO: 4816 - DNA, 203 bp, Homo sapiens
  source 1..203: mol_type = other DNA
ggcgcgccagtccttggcaccacccttcccagaggttgttgttcaatgtttctcaaggcaacgccttattattaccccctatctccctggttaatctctctacggtttcctccgcccctcctacccgggtcagacgcagtcccgtcgcagccctgaccttaggcctagccctgtcagtggggctcactcgactcggaccgatg

SEQ ID NO: 4817 - DNA, 203 bp, Homo sapiens
  source 1..203: mol_type = other DNA
ggcgcgccagtcctcggctgggttttcaaagcctatgtcccacaatcaatgaaccttgctgtttcctacgcattcaaaatgactccattatccgcctcggtgatctccagcctctctcgcaaagagtctctacagactggcagtggccctggaattgggatctggggctcaccgcctgggtgcgagaacgactcggaccgatg

SEQ ID NO: 4818 - DNA, 203 bp, Homo sapiens
  source 1..203: mol_type = other DNA
ggcgcgccagtccttcagcaccagagatctactctcacctctcccccaccaaacccgattacatcaaccttcgaccctgcccttgacacccccgtgtttcacgcaccctcaggctgtggtggggcactggcttagtggaatagtcagtgtaccatcacaagcctcttcttgctgccagcaccgagttccgactcggaccgatg

SEQ ID NO: 4819 - DNA, 203 bp, Homo sapiens
  source 1..203: mol_type = other DNA
ggcgcgccagtcctgaacacagccctaccctgagcctctctgagtacatgactgagtgtagcgcagagaggttgtcgcttctgcgtgtcactcagtcattttttatagccgattggggttcgcgccctcccattgcctgtgacacggttaagacctctctcacttctgcttcaccatccccctgccagcgactcggaccgatg

SEQ ID NO: 4820 - DNA, 203 bp, Homo sapiens
  source 1..203: mol_type = other DNA
ggcgcgccagtcctcgttggtctagtggaaagaactaacgctgacgggggcgatttcttgcagctgtgctaagcgagaggctctggtgctggggataagatgcggcccctagcaccacagtctctgcgccttttgggttcgaatcttccccatgcagcttccgctttttacgccctgttgcacaccctcgactcggaccgatg

SEQ ID NO: 4821 - DNA, 203 bp, Homo sapiens
  source 1..203: mol_type = other DNA
ggcgcgccagtcctagtgtgcacaatatctcttccaaaaggtcctgatgaacatcttcccatgtaacaagccccagcagagacattccagccacatccagcagcatttgggccgccttctctaacagtgcccataaagtcccttccgtttccacaacggctgcctctgcatcttctatttccacctcgcgactcggaccgatg

SEQ ID NO: 4822 - DNA, 203 bp, Homo sapiens
  source 1..203: mol_type = other DNA
ggcgcgccagtcctgcccccttccggccgttcgcgctcagcccggcccggtttcactttcccccttcgagcagtcccccttccagccctaccaatgccaattgccctcggcctctagcgacggttgccccatcatcgggcacggccttcttccctggaacaacttagtaacgcatcctgtcctcggaacgactcggaccgatg

SEQ ID NO: 4823 - DNA, 203 bp, Homo sapiens
  source 1..203: mol_type = other DNA
ggcgcgccagtcctaagtccttatattaaatcaaatggccaatttttccttactcccccccttcgataccctccttgtagaccccctccggctgtccgtctttgccccggacactaggggagccatacgttatctctccacccttttgacgctatgcccagttacttgtattctacccctaggcgagccgactcggaccgatg

SEQ ID NO: 4824 - DNA, 203 bp, Homo sapiens
  source 1..203: mol_type = other DNA
ggcgcgccagtcctgtcctcaggccttacaacgcttcctccatgaccctacgctcacctggtcagaattggttgctagcgggaaactaagacttgattcacccttaaaattacagctgttagaaaatgaatggctctcccgccttttttgagggggagtcatttgtatgaaagatcatgcaggcctagcgactcggaccgatg

SEQ ID NO: 4825 - DNA, 203 bp, Homo sapiens
  source 1..203: mol_type = other DNA
ggcgcgccagtcctttagcggcaccagaagcgttctcctcctgagaccctagtgctcagctctcggtcctgagctctcttgctcccgagaccttctggtcggctatccggcagcggtcaggtaaggcaaaccacggtttggagggtggttctcggctgagaccgccgcgagctctatctccggtcctccgactcggaccgatg

SEQ ID NO: 4826 - DNA, 203 bp, Homo sapiens
  source 1..203: mol_type = other DNA
ggcgcgccagtcctctcccgagaccttctggtcggctatccggcagcggtcaggtaaggcaaaccacggtttggagggtggttctcggctgagaccgccgcgagctctatctccggtcctctgaccgtctccacgtggactctctctcttgcctcctgaccccgcgctccaagggcgtctggcttgcacgactcggaccgatg

SEQ ID NO: 4827 - DNA, 203 bp, Homo sapiens
  source 1..203: mol_type = other DNA
ggcgcgccagtccttctgtttccccggtgaagttgcatagactgtacccacggttgaaagcgatgaatccgttacccgcttaggtacttcgagaagcctagtatcatcttggaatcttcgatgcgttgcgatcagcactctaccccgagtgtagcttgggtcgatgagtctggacaccccacaccggccgactcggaccgatg

SEQ ID NO: 4828 - DNA, 203 bp, Homo sapiens
  source 1..203: mol_type = other DNA
ggcgcgccagtcctgtccaataccactacctgtataggagtgggttcctgtgccacgtacaatgcaatgctacaaaatttcaccaaggtactcttctaatagtggctatcccagaacaccaaattggaaagaaaggaacaggtacgtcagcaagctttgctgaagtcatgaaaggggctgaaggtggacgactcggaccgatg

SEQ ID NO: 4829 - DNA, 203 bp, Homo sapiens
  source 1..203: mol_type = other DNA
ggcgcgccagtcctattccggtatgtccattggcaggaggtactggcaacacaaacacctatgtgccaattaccatctccattgctcccatgtgtgctgaatacaatgggcttagaaatgccattacacaaggagtgcccacttgcctgttgccaggctccaaccaatttttgactactgatgaccaccgactcggaccgatg

SEQ ID NO: 4830 - DNA, 203 bp, Homo sapiens
  source 1..203: mol_type = other DNA
ggcgcgccagtcctttaggcagatctgcacttgtgtgtatgcgatcatttgagtacaagaatcactcaacaagtacctcatccattcaaaagaatttcttcatctggactttgaacaccagagaacttgtccaaattaggaggaagatggaattgtttacttacctaaggtttgacactgaaataactcgactcggaccgatg

SEQ ID NO: 4831 - DNA, 203 bp, Homo sapiens
  source 1..203: mol_type = other DNA
ggcgcgccagtcctctaacagttagggtatatatgaagcctaagcatattaaggcctgggcacctagggcgcctcgcaccatgccctataccaacatcctcaacaacaattatgcaggtcggtcagctgcacccaatgctcccacagccatagtgtcccataggagtaccataaagacaatgcccaaccgactcggaccgatg

SEQ ID NO: 4832 - DNA, 203 bp, Homo sapiens
  source 1..203: mol_type = other DNA
ggcgcgccagtcctctcttagtctgctcacatggagtgataggactcgtcaccgcaggcggtgagggaatagttgctttcacagacattagaaatctcctgtggttagaggatgatgccatggaacaaggtataacagattacatccagaaccttggtagcgcctttgggactggatttactgagacccgactcggaccgatg

SEQ ID NO: 4833 - DNA, 203 bp, Homo sapiens
  source 1..203: mol_type = other DNA
ggcgcgccagtcctatcagtgaaaaggctaaagagattcagaacatgctagttggagaggacagtttattggaaaagcttcttaaagcattaatcaaaatagtatctgcaatggtgattgtgattaggaattcagaagatctagttacagtcactgcaacacttgccctcctagggtgcaatgactcacgactcggaccgatg

SEQ ID NO: 4834 - DNA, 203 bp, Homo sapiens
  source 1..203: mol_type = other DNA
ggcgcgccagtcctccatgggcgtttcttaaacagaaagtttgctcatatcttggcatcccatacacaataagacagagtgattcttggctcaagaagttcacagaggcatgcaatgcattgagaggcctggattggctagcacaaaagattgacaagtttatcaactggcttaaaacaaagattctccgactcggaccgatg

SEQ ID NO: 4835 - DNA, 203 bp, Homo sapiens
  source 1..203: mol_type = other DNA
ggcgcgccagtccttcttactcactcccacctgatccaaaatattttgatgggtataaacaacagacagtggtcctgatggatgacttaatgcaaaatccagatggtaatgatattgctatgttttgtcagatggtatctactgtagactttataccaccaatggccagtcttgaggaaaagggaacccgactcggaccgatg

SEQ ID NO: 4836 - DNA, 203 bp, Homo sapiens
  source 1..203: mol_type = other DNA
ggcgcgccagtcctaacccagaaaagtgcagaccaaccaactataaaaagtgttgtccactgatttgtggaaaggccattcagtttagagacaagagaacgaacgtcaggtactcagtagatatgttagtaactgaaatgatcaaggaatataggatcagaaacagcacacaagataaattggaggctcgactcggaccgatg

SEQ ID NO: 4837 - DNA, 203 bp, Homo sapiens
  source 1..203: mol_type = other DNA
ggcgcgccagtcctcagcgttggtatactgcccctacccgcgggccggctgctaattgccggcgttccgcactgcgcgggctccccgctgctgaccgcacttactgcttcgacgggttttctggctgtaactttcccgccgagactggcgtcgccctctattctctccatgatatgtcaccatctgatcgactcggaccgatg

SEQ ID NO: 4838 - DNA, 203 bp, Homo sapiens
  source 1..203: mol_type = other DNA
ggcgcgccagtcctcgatcgatcttcggcccgggtggtaccccctccctatttccaacctcatgctccactaagtcgaccttccatgctgtccctgcccatatctgggaccgtctcatgttgttcggggccaccctagatgaccaagccttttgctgctcccgcctaatgacttacctccgtggcattcgactcggaccgatg

SEQ ID NO: 4839 - DNA, 203 bp, Homo sapiens
  source 1..203: mol_type = other DNA
ggcgcgccagtcctagctacaaggttactgtgggcacccttgttgccaatgaaggctggaacgcctctgaggtcgctcttacagctgtcatcactgccgcctaccttaccatctgccaccagcggtacctccgcactcaggctatatctaaggggatgcgccgtctggagcgggagcatgctcagaagcgactcggaccgatg

SEQ ID NO: 4840 - DNA, 203 bp, Homo sapiens
  source 1..203: mol_type = other DNA
ggcgcgccagtccttttataacacgcctctacagttggctctttgagaagtccggccgtgattatatccccggccgtcagttggagttctacgctcagtgtaggcgctggctctcggccggctttcatcttgacccacgggtgttggtttttgatgagtcggccccctgccactgtaggactgcgattcgactcggaccgatg

SEQ ID NO: 4841 - DNA, 203 bp, Homo sapiens
  source 1..203: mol_type = other DNA
ggcgcgccagtcctccccggtcagcccctggcgaggtcaccgccttttgttctgccctatacaggtttaatcgcgaggcccagcgcctttcgctcaccggtaatttttggttccatcctgaggggctccttggcccctttgccccgttttcccccgggcatgtttgggagtcggctaatccattctgtcgactcggaccgatg

SEQ ID NO: 4842 - DNA, 203 bp, Homo sapiens
  source 1..203: mol_type = other DNA
ggcgcgccagtcctccggcgcgtggtgagccggctcctggcgctaccgcccgggccccggccataacccaccaggcggcccggcatcgccgcctgctctttacctacccggatggctctaaggtattcgccggctcgctgtttgagtcgacatgtacctggctcgttaacgcgtctaatgttgaccaccgactcggaccgatg

SEQ ID NO: 4843 - DNA, 203 bp, Homo sapiens
  source 1..203: mol_type = other DNA
ggcgcgccagtcctcgccctggcggtgggctctgtcatgcattttaccaaaggtaccccgcatcctttgatgctgcctcttttgtgatgcgcgacggcgcggccgcctatacattaaccccccggccaataattcacgccgtcgctcctgattataggttggaacataacccaaagatgcttgaggctcgactcggaccgatg

SEQ ID NO: 4844 - DNA, 203 bp, Homo sapiens
  source 1..203: mol_type = other DNA
ggcgcgccagtcctgcctaccgggagacttgctcccgcctcggtaccgctgcatacccactcctcgggaccggcatataccaggtgccgatcggtcccagttttgacgcctgggagcggaatcaccgccccggggatgagttgtaccttcctgagcttgctgccagatggttcgaggccaataggccgcgactcggaccgatg

SEQ ID NO: 4845 - DNA, 203 bp, Homo sapiens
  source 1..203: mol_type = other DNA
ggcgcgccagtcctacctgcccaactctcactataactgaggatgttgcacggacagcaaatctggctatcgaacttgactcagccacagacgtcggccgggcctgtgccggctgtcgagtcacccccggcgttgtgcagtaccagtttaccgcaggtgtgcctggatccggcaagtcccgctctattcgactcggaccgatg

SEQ ID NO: 4846 - DNA, 203 bp, Homo sapiens
  source 1..203: mol_type = other DNA
ggcgcgccagtcctcagcgggccgccaccgtccaccttcttggtgacccgaatcagatcccagccatcgactttgagcacgccgggctcgttcccgccatcaggcccgatttggcccccacctcctggtggcatgtgacccatcgctgccctgcggatgtatgtgagctgatccgtggcgcataccctcgactcggaccgatg

SEQ ID NO: 4847 - DNA, 203 bp, Homo sapiens
  source 1..203: mol_type = other DNA
ggcgcgccagtcctcgaggcctcattcagtcgtcccgagctcatgccattgttgccttgacgcgccacactgagaagtgcgtcatcattgacgcaccaggcctgcttcgcgaggtgggcatctccgatgcaatcgttaataactttttccttgctggtggcgaaattggccaccagcgcccatctgttcgactcggaccgatg

SEQ ID NO: 4848 - DNA, 203 bp, Homo sapiens
  source 1..203: mol_type = other DNA
ggcgcgccagtcctgaactcaccacctgtgatagtgtcgtaacatttgaattaacagatattgtgcactgtcgtatggccgccccgagccagcgcaaggccgtgctgtccacgcttgtgggccattacggccgccgcacaaagctctacaatgcctcccactctgatgttcgcgactctctcgcccgtcgactcggaccgatg

SEQ ID NO: 4849 - DNA, 203 bp, Homo sapiens
  source 1..203: mol_type = other DNA
ggcgcgccagtccttttatcccggccattggccacgtacaggttacaacctgtgaattgtacgagctagtggaggccatggtcgagaagggccaggacggctccgccgtccttgagctcgacctttgtaaccgcgacgtgtccaggatcaccttcttccagaaagattgtaataaattcaccacggggcgactcggaccgatg

SEQ ID NO: 4850 - DNA, 203 bp, Homo sapiens
  source 1..203: mol_type = other DNA
ggcgcgccagtcctgcagcaagggcatccatggtgtttgagaatgacttttctgagtttgattccacccagaataatttttccttgggcctagagtgtgctattatggtggagtgtgggatgccgcagtggctcatccgcttgtaccaccttataaggtctgcgtggattctgcaggccccgaaggagcgactcggaccgatg

SEQ ID NO: 4851 - DNA, 203 bp, Homo sapiens
  source 1..203: mol_type = other DNA
ggcgcgccagtccttccctgcgagggttttggaagaaacactccggtgagcccggcacccttctatggaatacagtctggaacatggccgttatcacccactgttatgatttccgcgatctgcaggtggccgcctttaaaggtgatgattcgatagtgctttgcagtgagtaccgtcagagcccagggcgactcggaccgatg

SEQ ID NO: 4852 - DNA, 203 bp, Homo sapiens
  source 1..203: mol_type = other DNA
ggcgcgccagtcctctccgcctcgctgtgagtgattttctccgcaagctcacgaatgtagctcagatgtgtgtggatgttgtctctcgtgtttatggggtttcccctggactcgttcataacctgattggcatgctacaggctgttgctgacggcaaggctcatttcactgagtcagtgaagccagtgcgactcggaccgatg

SEQ ID NO: 4853 - DNA, 203 bp, Homo sapiens
  source 1..203: mol_type = other DNA
ggcgcgccagtcctcagcggcggttccggcggtggtttctggggtgaccgggctgattctcagcccttcgcaatcccctatattcatccaaccaaccccttcgcccccgatgtcaccgctgcggccggggctggacctcgtgttcgccaacccgcccgaccactcggctccgcttggcgtgaccaggccgactcggaccgatg

SEQ ID NO: 4854 - DNA, 203 bp, Homo sapiens
  source 1..203: mol_type = other DNA
ggcgcgccagtcctccagcgccccgccgctgcctcacgtcgtagacctaccacagctggggccgcgccgctaaccgcggtcgctccggcccatgacaccccgccagtgcctgatgttgactcccgcggcgccatcctgcgccggcagtataacctatcaacatctccccttacctcttccgtggccaccgactcggaccgatg

SEQ ID NO: 4855 - DNA, 203 bp, Homo sapiens
  source 1..203: mol_type = other DNA
ggcgcgccagtcctctccatctcgttctggccacagaccaccaccaccccgacgtccgttgacatgaattcaataacctcgactgatgttcgtattttagtccagcccggcatagcctccgagcatgttatcccaagtgagcgcctacactatcgtaaccaaggttggcgctctgttgagacctccggcgactcggaccgatg

SEQ ID NO: 4856 - DNA, 203 bp, Homo sapiens
  source 1..203: mol_type = other DNA
ggcgcgccagtcctctccagcactgcccgtcaccgccttcgtcgcggtgcagatgggactgccgagctcaccaccacggctgctacccgcttcatgaaggacctctattttactagtactaatggtgtcggtgagatcggccgcgggatagcgcttaccctgtttaaccttgctgacaccctgcttggcgactcggaccgatg

SEQ ID NO: 4857 - DNA, 203 bp, Homo sapiens
  source 1..203: mol_type = other DNA
ggcgcgccagtccttattcaggattatgataaccaacatgagcaggaccgaccgacaccttccccagccccatcgcgccccttttctgtcctccgagctaatgatgtgctttggctttctctcaccgctgccgagtatgaccagtccacttacggctcttcgaccggcccagtctatgtctctgactccgactcggaccgatg

SEQ ID NO: 4858 - DNA, 203 bp, Homo sapiens
  source 1..203: mol_type = other DNA
ggcgcgccagtcctcgggtacccttataattataacaccactgctagtgaccaactgctcgttgagaatgccgctgggcatcgggttgctatttccacttacaccactagcctgggtgctggccccgtctctatttccgcggttgctgttttagccccccactctgcgctagcattgcttgaggataccgactcggaccgatg

SEQ ID NO: 4859 - DNA, 203 bp, Homo sapiens
  source 1..203: mol_type = other DNA
ggcgcgccagtcctcccggagtgccgcccccttggcctccagggctgtgcttttcagtctactgtcgctgagcttcagcgccttaagatgaaggtgggtaaaactcgggagttatagtttatttgcttgtgccccccttctttctgttgcttatttctcatttctgcgttccgcgctccctgaaaaaacgactcggaccgatg

SEQ ID NO: 4860 - DNA, 203 bp, Homo sapiens
  source 1..203: mol_type = other DNA
ggcgcgccagtcctaacgagaacttggaacactcattgacgccgtgaacaagcggggcagaaaacaaaacaaaagaggaggaaatgaaggctcaatcatgtggctcgcaagcttggcagttgtcatagcttacgcaggagcaatgaagttgtcgaatttccaggggaagcttttgatgaccatcaacacgactcggaccgatg

SEQ ID NO: 4861 - DNA, 203 bp, Homo sapiens
  source 1..203: mol_type = other DNA
ggcgcgccagtcctctggctatgctttcctggcggcgacacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggactcgactcggaccgatg

SEQ ID NO: 4862 - DNA, 203 bp, Homo sapiens
  source 1..203: mol_type = other DNA
ggcgcgccagtcctacaacgagaagcgagctgatagtagctatgtgtgcaaacaaggcttcactgatcgtgggtggggcaacggatgtggacttttcgggaagggaagcattgacacatgtgcaaaattctcctgcaccagcaaagcgattggaagaacaatccagccagaaaacatcaaatacgaagcgactcggaccgatg

SEQ ID NO: 4863 - DNA, 203 bp, Homo sapiens
  source 1..203: mol_type = other DNA
ggcgcgccagtcctttgggtcacaggaaggaggcctccatcaggcgttggcaggagccatcgtggtggagtactcaagctcagtgaagttaacatcaggccacctgaaatgtaggctgaaaatggacaaactggctctgaaaggcacaacctatggcatgtgtacagaaaaattctcgttcgcgaaaacgactcggaccgatg

SEQ ID NO: 4864 - DNA, 203 bp, Homo sapiens
  source 1..203: mol_type = other DNA
ggcgcgccagtcctatccggcggacactggccacggaacagttgtcattgaactatcctactctgggagtgatggcccctgcaaaattccgattgtctccgttgcgagcctcaatgacatgacccccgttgggcggctggtgacagtgaaccctttcgtcgcgacttccagtgccaactcaaaggtgccgactcggaccgatg

SEQ ID NO: 4865 - DNA, 203 bp, Homo sapiens
  source 1..203: mol_type = other DNA
ggcgcgccagtccttggtcgagatggaaccccccttcggagactcctacatcgtggttgggaggggagacaagcagatcaaccaccattggcacaaagctggaagcacgctaggcaaggccttttcaacaactttgaagggagctcaaagactggcagcgttgggcgacacagcctgggactttggctcgactcggaccgatg

SEQ ID NO: 4866 - DNA, 203 bp, Homo sapiens
  source 1..203: mol_type = other DNA
ggcgcgccagtcctcaggaggtgtgctcgtgttcttagcgaccaatgtgcatgctgacactggatgtgccattgacatcacaagaaaagagatgagatgtggaagtggcatctttgtgcacaacgacgtggaagcctgggtggacaggtataaatacttgccagaaacgcccagatccctagcgaagacgactcggaccgatg

SEQ ID NO: 4867 - DNA, 203 bp, Homo sapiens
  source 1..203: mol_type = other DNA
ggcgcgccagtccttcagacctgtcaggcatgatgaaacaacactcgttagatcacaggttgatgctttcaatggtgaaatggttgacccttttcagctgggccttctggtgatgtttctggccacccaggaggtccttcgcaagaggtggacggccagattgaccattcctgcggttttgggggccccgactcggaccgatg

SEQ ID NO: 4868 - DNA, 203 bp, Homo sapiens
  source 1..203: mol_type = other DNA
ggcgcgccagtccttacttgtgctgatgcttgggggcatcacttacactgatttggcgaggtatgtggtgctagtcgctgccgctttcgcagaggccaacagtggaggagacgtcctgcatcttgctttgattgccgtttttaagatccaaccagcgtttctagtgatgaacatgcttagcacgagatcgactcggaccgatg

SEQ ID NO: 4869 - DNA, 203 bp, Homo sapiens
  source 1..203: mol_type = other DNA
ggcgcgccagtcctctgccggactaatggtctgcaacccaaacaagaagagagggtggccagccactgagtttttgtcggcagttggattgatgtttgccatcgtaggtggcttggccgagttggatattgaatccatgtcaatacccttcatgctggcaggtctcatggcagtgtcctacgtggtgtcgactcggaccgatg

SEQ ID NO: 4870 - DNA, 203 bp, Homo sapiens
  source 1..203: mol_type = other DNA
ggcgcgccagtcctttggcacttaccaggccggcgtcggagtcatgtacgagaatgttttccacacactatggcacacaactagaggagcagccattatgagtggagaaggaaaattgacgccatactggggtagtgtgaaagaagaccgcatagcttacggaggcccatggaggtttgaccgaaaatcgactcggaccgatg

SEQ ID NO: 4871 - DNA, 203 bp, Homo sapiens
  source 1..203: mol_type = other DNA
ggcgcgccagtcctgaaccacggatccttttcctgactcaaatgccccaatccatgatttgcaagatgagataccagacagggcatggagcagtggatacgaatggatcacagaatatgcgggcaaaaccgtgtggtttgtggcgagcgtaaaaatggggaatgagattgcaatgtgcctccaaagagcgactcggaccgatg

SEQ ID NO: 4872 - DNA, 203 bp, Homo sapiens
  source 1..203: mol_type = other DNA
ggcgcgccagtcctccaatggcattcagtacaccgacagaaggtggtgttttgatgggccgcgcacgaatgccatactggaggacaacaccgaggtagagatagtcacccggatgggtgagaggaaaatcctcaagccgagatggcttgatgcaagagtttatgcagatcaccaagccctcaagtggtcgactcggaccgatg

SEQ ID NO: 4873 - DNA, 203 bp, Homo sapiens
  source 1..203: mol_type = other DNA
ggcgcgccagtccttgctgatcgccctgctgctgatggtggtgctcatcccagaaccggaaaaacagaggtcacagacagataaccaactggcggtgtttctcatctgcgtcttgaccgtggttggagtggtggcagcaaacgagtacgggatgctagagaaaaccaaagcagatctcaagagcatgtcgactcggaccgatg

SEQ ID NO: 4874 - DNA, 203 bp, Homo sapiens
  source 1..203: mol_type = other DNA
ggcgcgccagtcctttgtcggaaagacgcaggcatcagggctgactggattgccaagcatggcactggacctgcgtccagccacagcctgggcactgtatggggggagcacagtcgtgctaacccctcttctgaaacacctgatcacgtcggaatacgtcaccacatcgctagcctcaattaactcaccgactcggaccgatg

SEQ ID NO: 4875 - DNA, 203 bp, Homo sapiens
  source 1..203: mol_type = other DNA
ggcgcgccagtcctatgtcaccactgtgagagaagcaggggtattggtgacggcggctacgctcactttgtgggacaatggagccagtgccgtctggaattccaccacagccacgggactctgccatgttatgcgaggtagctacctggctggaggttccattgcttggactctcatcaagaacgcggcgactcggaccgatg

SEQ ID NO: 4876 - DNA, 203 bp, Homo sapiens
  source 1..203: mol_type = other DNA
ggcgcgccagtcctcatctgactggttgcaccgaggacctagagagttctgcataaaagttctctgcccttacatgcccaaggttatagaaaaaatggaagttctgcagcgccgcttcggaggtgggctagtgcgtctccccctgtcccggaactccaatcacgagatgtattgggttagtggagccgcgactcggaccgatg

SEQ ID NO: 4877 - DNA, 203 bp, Homo sapiens
  source 1..203: mol_type = other DNA
ggcgcgccagtcctctggcaatgtggtgcacgctgtgaacatgaccagccaggtactactggggcgaatggatcgcacagtgtggagagggccaaagtatgaggaagatgtcaacctagggagcggaacaagagccgtgggaaagggagaagtccatagcaatcaggagaaaatcaagaagagaatcccgactcggaccgatg

SEQ ID NO: 4878 - DNA, 203 bp, Homo sapiens
  source 1..203: mol_type = other DNA
ggcgcgccagtcctaatttataaagaaagtcaacagcaacgcggctcttggagcagtgttcgctgaacagaatcaatggagcacggctcgtgaggctgtggatgacccgcggttctgggagatggttgatgaagagagggaaaaccatctgcgaggagagtgtcatacatgtatctacaacatgatggcgactcggaccgatg

SEQ ID NO: 4879 - DNA, 203 bp, Homo sapiens
  source 1..203: mol_type = other DNA
ggcgcgccagtcctagctgggatacatcctccgtgacatagcaggaaagcaaggagggaaaatgtacgctgatgacaccgccggatgggacactagaattaccagaactgatttagaaaatgaagccaaggtgctggagctcctagacggtgaacaccgcatgctcgctcgagccataattgaactgacgactcggaccgatg

SEQ ID NO: 4880 - DNA, 203 bp, Homo sapiens
  source 1..203: mol_type = other DNA
ggcgcgccagtcctcttacaggcacaaagtggtcaaggtcatgagacctgcagcagaaggaaagaccgtaatggacgtgatatcaagagaagatcaaagggggagtggacaggtggtcacttatgcccttaacactttcacgaacattgctgtccagctcgtcaggctgatggaggctgagggggtcacgactcggaccgatg

SEQ ID NO: 4881 - DNA, 203 bp, Homo sapiens
  source 1..203: mol_type = other DNA
ggcgcgccagtcctttggaccacaacacttggaacagctacctagaaaaaccaagatagctgtcaggacctggctctttgagaatggagaggagagagtgaccaggatggcgatcagcggagatgactgtgtcgtcaagccgctggatgacagattcgccacagccctccacttcctcaacgcaatgtcgactcggaccgatg

SEQ ID NO: 4882 - DNA, 203 bp, Homo sapiens
  source 1..203: mol_type = other DNA
ggcgcgccagtcctgagctggatggaatgtgaaggacacagcttgtctggccaaagcatatgcacagatgtggctactcctatacttccatcgtagggacttgcgtctcatggcaaatgcgatttgctcagcagtgccagtggattgggtgcccacaggcaggacgtcctggtcaatacactcgaaagcgactcggaccgatg

SEQ ID NO: 4883 - DNA, 203 bp, Homo sapiens
  source 1..203: mol_type = other DNA
ggcgcgccagtcctaaaatgcatgcatatggagtcaggccagcaaaagctgccaccggatactgggtagacggtgctgtctgcgtctcagtcccaggaggactgggttaacaaatctgacaacagaaagtgagaaagccctcagaaccgtctcggaagtaggtccctgctcactggaagttgaaagaccgactcggaccgatg

SEQ ID NO: 4884 - DNA, 203 bp, Homo sapiens
  source 1..203: mol_type = other DNA
ggcgcgccagtcctggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggacgactcggaccgatg

SEQ ID NO: 4885 - DNA, 203 bp, Homo sapiens
  source 1..203: mol_type = other DNA
ggcgcgccagtcctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatctcgactcggaccgatg

SEQ ID NO: 4886 - DNA, 203 bp, Homo sapiens
  source 1..203: mol_type = other DNA
ggcgcgccagtcctcctgtctctagtttgtctgttcgagatcctacagttggcgcccgaacagggacctgagaggggcgcagaccctacctgttgaacctggctgatcgtaggatccccgggacagcagaggagaacttacagaagtcttctggaggtgttcctggccagaacacaggaggacaggtacgactcggaccgatg

SEQ ID NO: 4887 - DNA, 203 bp, Homo sapiens
  source 1..203: mol_type = other DNA
ggcgcgccagtcctagatgggagaccctttgacatggagcaaggcgctcaagaagttagagaaggtgacggtacaagggtctcagaaattaactactggtaactgtaattgggcgctaagtctagtagacttatttcatgataccaactttgtaaaagaaaaggactggcagctgagggatgtcattccgactcggaccgatg

SEQ ID NO: 4888 - DNA, 203 bp, Homo sapiens
  source 1..203: mol_type = other DNA
ggcgcgccagtcctgggaatcccagggggaatctcaacccctattacccaacagtcagaaaaatctaagtgtgaggagaacacaatgtttcaaccttattgttataataatgacagtaagaacagcatggcagaatcgaaggaagcaagagaccaagaaatgaacctgaaagaagaatctaaagaagacgactcggaccgatg

SEQ ID NO: 4889 - DNA, 203 bp, Homo sapiens
  source 1..203: mol_type = other DNA
ggcgcgccagtcctagttaatcttaattcctctgactcctctaactctgtacgtgttgaggatgtaatgaacacagcggaatattggggatttaaatggctagaatgtaatcaaacagaaaattttaagactatattagtacctgaaaatgaaatggtaaatatcaatgatactgatacctggatacccgactcggaccgatg

SEQ ID NO: 4890 - DNA, 203 bp, Homo sapiens
  source 1..203: mol_type = other DNA
ggcgcgccagtccttaaggggtgtaatgagacgtgggcaagagtgaaacgttgtcctatagatattttatatgggatacatccaatcaggctgtgtgtacagccaccattttttctggtacaggagaaagggattgctgatacttctagaattggcaattgtgggccaacaatatttcttggggttttcgactcggaccgatg

SEQ ID NO: 4891 - DNA, 203 bp, Homo sapiens
  source 1..203: mol_type = other DNA
ggcgcgccagtcctaactgaggttaacaaaataatggaagtacaaaatcatacttttgaggtagaaaatagtactctaaatggtatggatttaatagaacgacaaataaagatattatatgctatgattcttcaaacacatgcagatgttcaactgttaaaggaaagacaacaggtagaggagacattcgactcggaccgatg

SEQ ID NO: 4892 - DNA, 203 bp, Homo sapiens
  source 1..203: mol_type = other DNA
ggcgcgccagtccttaatttaattggatgtatagaaagaacacatgtattttgtcatactggtcatccctggaatatgtcatggggacatttaaatgagtcaacacaatgggatgactgggtaagcaaaatggaagatttaaatcaagagatactaactacacttcatggagccaggaacaatttggccgactcggaccgatg

SEQ ID NO: 4893 - DNA, 203 bp, Homo sapiens
  source 1..203: mol_type = other DNA
ggcgcgccagtcctcgactggaatggagaatcagaggagtacaacaggcggccaaagagctgggtgaagtcaatcgaggcatttggagagagctatatttccgagaagaccaaaggggagatttctcagcctggggcggctatcaacgagcacaagaacggctctggggggaacaatcctcaccaaggcgactcggaccgatg

SEQ ID NO: 4894 - DNA, 203 bp, Homo sapiens
  source 1..203: mol_type = other DNA
ggcgcgccagtcctgtccttagacctggagattcgaagcgaaggaggaaacatttatgactgttgcattaaagcccaagaaggaactctcgctatcccttgctgtggatttcccttatggctattttggggactagtaattatagtaggacgcatagcaggctatggattacgtggactcgctgttatcgactcggaccgatg

SEQ ID NO: 4895 - DNA, 203 bp, Homo sapiens
  source 1..203: mol_type = other DNA
ggcgcgccagtcctttctgcggtctgagtcccttctctgctgggctgaaaaggcctttgtaataaatataattctctactcagtccctgtctctagtttgtctgttcgagatcctacagttggcgcccgaacagggacctgagaggggcgcagaccctacctgttgaacctggctgatcgtaggatcccgactcggaccgatg

SEQ ID NO: 4896 - DNA, 203 bp, Homo sapiens
  source 1..203: mol_type = other DNA
ggcgcgccagtcctgggaaaagcagagtgctttggagagctcgaaggaaagagtctccgggcctctcctgcctgcctgaaaagctcaataaaggagttggctgatatctgagcttgcctggttattatcgggattcgttactaattccgtgcaacaccggagcggatctcgcagctggcgcccaacgtcgactcggaccgatg

SEQ ID NO: 4897 - DNA, 203 bp, Homo sapiens
  source 1..203: mol_type = other DNA
ggcgcgccagtcctgaaagagaaagtgttgcttgggcacaggaggagggttcgcgaccccttaaaagacggaggggcacgggcgtcctcctgggccgaggggacacaagagcaacactggtaaggaagccgccgtggtgaggctagctagagacatggcgaagcaaggctcaaaggagaaaaagggatcgactcggaccgatg

SEQ ID NO: 4898 - DNA, 203 bp, Homo sapiens
  source 1..203: mol_type = other DNA
ggcgcgccagtcctgacaaaccaatcagcaggcatctcaagccaatatggatcaggcaagacagatatgcctgcagtgggtaataacagcgttaagatcagtgaggcatatgtcacatagaccaggaaaccctatgttagtgaagcagaagaatactgagagttatgaagacttcatagctcgcctaccgactcggaccgatg

SEQ ID NO: 4899 - DNA, 203 bp, Homo sapiens
  source 1..203: mol_type = other DNA
ggcgcgccagtcctactgccggcagaagaaacagcagggaaacaacaggagggggccacgtgtggtgccgtccgcgccccctatgttgtaacagaagcaccacccaaaatagaaataaaagtaggaacaaggtggaaaaaattattagtagatacaggggcagataaaactatagtaacatcccatgacgactcggaccgatg

SEQ ID NO: 4900 - DNA, 203 bp, Homo sapiens
  source 1..203: mol_type = other DNA
ggcgcgccagtcctagcgcccccacactggacttgtaatacccctatattttgtattaagaagaaatcaggaaaatggaggatgttaatagattttagagaattaaataagcaaacagaagatttagcagaagcacagttagggttaccgcatccaggaggattacagagaaagaaacatgtaacaatcgactcggaccgatg

SEQ ID NO: 4901 - DNA, 203 bp, Homo sapiens
  source 1..203: mol_type = other DNA
ggcgcgccagtccttcccctagcagaagaagagcataacaaatggcatcaagatgctgtgtccttgcatttagaatttgggattcccaggacagctgcagaagatatagttcaacaatgtgatgtgtgtcaagaaaataaaatgcctagtacattaagaggcagtaataaaaggggcatagaccattgcgactcggaccgatg

SEQ ID NO: 4902 - DNA, 203 bp, Homo sapiens
  source 1..203: mol_type = other DNA
ggcgcgccagtcctagcatttgtagcagaatctactcagctcttaatgaaatatttgggcatagaacatactacagggatcccctggaacccacaatctcaagcattagtagagagaacacatcagacgttaaagaatacattagaaaaacttatacctatgtttaacgcgtttgaatcagccctcgccgactcggaccgatg

SEQ ID NO: 4903 - DNA, 203 bp, Homo sapiens
  source 1..203: mol_type = other DNA
ggcgcgccagtcctcgggtatattgggaaaaagaggatgaagaaagcatgaagtttttgaatataaaagcctgtaatatatcattgaggtgtcaagatgaaggaaagagtccgggaggatgtgtacaaggataccccattccaaagggagcagaaataataccagaagctatgaaatacctcaggggacgactcggaccgatg

SEQ ID NO: 4904 - DNA, 203 bp, Homo sapiens
  source 1..203: mol_type = other DNA
ggcgcgccagtcctaagaaaagtcgatatggagggatcaaggataaaaatggggaattaaaattacctctctctgtaagggtgtgggtgaggatggcgaatttgtcaggatgggtgaatggaacgcctccttactggagtgcaaggattaatgggagtacagggataaatggaacaaggtggtatggacgactcggaccgatg

SEQ ID NO: 4905 - DNA, 203 bp, Homo sapiens
  source 1..203: mol_type = other DNA
ggcgcgccagtcctataggaacattacatcacttagggtgtaacattagcagtaacccagagagagggatatgtaactttacaggagaactttggatagggggcgacaaattcccatattattatacgccctcatggaattgttcacaaaattggacaggtcacccagtatggcacgtatttagataccgactcggaccgatg

SEQ ID NO: 4906 - DNA, 203 bp, Homo sapiens
  source 1..203: mol_type = other DNA
ggcgcgccagtccttacacatatggtgttgtagaaatgccacaatcatatatggaggcgcaaggggaaaacaagaggtcaagaaggaacctccaaaggaagaaaagagggataggcttggttattgtgctagccatcatggcaataatcgctgctgcaggagctggtctcggtgtcgcaaacgccgtgcgactcggaccgatg

SEQ ID NO: 4907 - DNA, 203 bp, Homo sapiens
  source 1..203: mol_type = other DNA
ggcgcgccagtcctcagcaatcctataccaggacggctgtccagtctcttgctaacgcaactgctgcccagcaggaagtgttagaagcatcgtatgccatggtacagcatatagccaaaggaataagaatcctagaggcaagagtggctagggtggaagccctggtagatcgaatgatggtataccaacgactcggaccgatg

SEQ ID NO: 4908 - DNA, 203 bp, Homo sapiens
  source 1..203: mol_type = other DNA
ggcgcgccagtccttgagtcatgtagcagctgatggttaagtcataaccgcagatgtaaacaagttgcctatataagccgcttgctagctggggaaaagcagagtgctttggagagctcgaaggaaagagtctccgggcctctcctgcctgcctgaaaagctcaataaaggagttggctgatatctgacgactcggaccgatg

SEQ ID NO: 4909 - DNA, 203 bp, Homo sapiens
  source 1..203: mol_type = other DNA
ggcgcgccagtcctctgtattgctactaaaaatctctgctgtacatggcacatggagttgatcacaaatgaacttttatacaaaacatacaaacaaaaacccgtcggggtggaggaacctgtttatgatcaggcaggtgatcccttatttggtgaaaggggagcagtccaccctcaatcgacgctaaacgactcggaccgatg

SEQ ID NO: 4910 - DNA, 203 bp, Homo sapiens
  source 1..203: mol_type = other DNA
ggcgcgccagtcctgctctttgaggagggatccatgtgtgaaacgactaaacggatagggagagtaactggaagtgacggaaagctgtaccacatttatgtgtgtatagatggatgtataataataaaaagtgccacgagaagttaccaaagggtgttcaggtgggtccataataggcttgactgccccgactcggaccgatg

SEQ ID NO: 4911 - DNA, 203 bp, Homo sapiens
  source 1..203: mol_type = other DNA
ggcgcgccagtcctggtaacacaagctagagatagccccacacccttaacaggttgcaagaaaggaaagaacttctcctttgcaggcatattgatgcggggcccctgcaactttgaaatagctgcaagtgatgtattattcaaagaacatgaacgcattagtatgttccaggataccactctttacctcgactcggaccgatg

SEQ ID NO: 4912 - DNA, 203 bp, Homo sapiens
  source 1..203: mol_type = other DNA
ggcgcgccagtcctcatatggtatacaaaaaattgcacccctgcctgcttacccaagaacacaaaaattgtcggccctgggaaatttggcaccaatgcagaggacggcaagatattacatgagatggggggtcacttgtcggaggtactactactttctttagtggtgctgtccgacttcgcaccggacgactcggaccgatg

SEQ ID NO: 4913 - DNA, 203 bp, Homo sapiens
  source 1..203: mol_type = other DNA
ggcgcgccagtcctaacagctagtgtaatgtacctaatcctacatttttccatcccacaaagtcacgttgatgtaatggattgtgataagacccagttgaacctcacagtggagctgacaacagctgaagtaataccagggtcggtctggaatctaggcaaatatgtatgtataagaccaaattggtgcgactcggaccgatg

SEQ ID NO: 4914 - DNA, 203 bp, Homo sapiens
  source 1..203: mol_type = other DNA
ggcgcgccagtcctgccttatgagacaactgtagtgttggcatttgaagaggtgagccaggtggtgaagttagtgttgagggcactcagagatttaacacgcatttggaacgctgcaacaactactgcttttttagtatgccttgttaagatagtcaggggccagatggtacagggcattctgtggctcgactcggaccgatg

SEQ ID NO: 4915 - DNA, 203 bp, Homo sapiens
  source 1..203: mol_type = other DNA
ggcgcgccagtcctcaagtgtaaattggagaacgagactggttacaggctagtagacagtacctcttgcaatagagaaggtgtggccatagtaccacaagggacattaaagtgcaagataggaaaaacaactgtacaggtcatagctatggataccaaactcggacctatgccttgcagaccatatgacgactcggaccgatg

SEQ ID NO: 4916 - DNA, 203 bp, Homo sapiens
  source 1..203: mol_type = other DNA
ggcgcgccagtcctaattgtaacgaggtggaaggttgacgtggctggcctattgttgcaatgtgtgcctatcttattgctggtcacaaccttgtgggccgacttcttaaccctaatactgatcctgcctacctatgaattggttaaattatactatctgaaaactgttaggactgatacagaaagaagcgactcggaccgatg

SEQ ID NO: 4917 - DNA, 203 bp, Homo sapiens
  source 1..203: mol_type = other DNA
ggcgcgccagtcctatacatgagttacttaactttggactttatgtactacatgcacaggaaagttatagaagagatctcaggaggtaccaacataatatccaggttagtggcagcactcatagagctgaactggtccatggaagaagaggagagcaaaggcttaaagaagttttatctattgtctggcgactcggaccgatg

SEQ ID NO: 4918 - DNA, 203 bp, Homo sapiens
  source 1..203: mol_type = other DNA
ggcgcgccagtcctaggtggcacctgcccaaaatgtggacgccatgggaagccgataacgtgtgggatgtcgctagcagattttgaagaaagacactataaaagaatctttataagggaaggcaactttgagggtatgtgcagccgatgccagggaaagcataggaggtttgaaatggaccgggaacccgactcggaccgatg

SEQ ID NO: 4919 - DNA, 203 bp, Homo sapiens
  source 1..203: mol_type = other DNA
ggcgcgccagtccttaagagtgccagatactgtgctgagtgtaataggctgcatcctgctgaggaaggtgacttttgggcagagtcgagcatgttgggcctcaaaatcacctactttgcgctgatggatggaaaggtgtatgatatcacagagtgggctggatgccagcgtgtgggaatctccccagacgactcggaccgatg

SEQ ID NO: 4920 - DNA, 203 bp, Homo sapiens
  source 1..203: mol_type = other DNA
ggcgcgccagtcctgattactttggcaacaggggcaggcaaaaccacagaactcccaaaagcagttatagaggagataggaagacacaagagagtattagttcttataccattaagggcagcggcagagtcagtctaccagtatatgagattgaaacacccaagcatctcttttaacctaaggataggcgactcggaccgatg

SEQ ID NO: 4921 - DNA, 203 bp, Homo sapiens
  source 1..203: mol_type = other DNA
ggcgcgccagtcctaatactaaataatctactcatctcagaagacttgccagccgctgttaagaacataatggccaggactgatcacccagagccaatccaacttgcatacaacagctatgaagtccaggtcccggtcctattcccaaaaataaggaatggagaagtcacagacacctacgaaaattacgactcggaccgatg

SEQ ID NO: 4922 - DNA, 203 bp, Homo sapiens
  source 1..203: mol_type = other DNA
ggcgcgccagtcctaaatgccctactagtggctttatttgggtatgtgggttaccaggctctctcaaagaggcatgtcccaatgataacagacatatataccatcgaggaccagagactagaagacaccacccacctccagtatgcacccaacgccataaaaaccgatgggacagagactgaactgaacgactcggaccgatg

SEQ ID NO: 4923 - DNA, 203 bp, Homo sapiens
  source 1..203: mol_type = other DNA
ggcgcgccagtcctaaataaagaagaaataatcagatatggtttgtggggaacacacacagcactatacaaaagcatagctgcaagactggggcatgaaacagcgtttgccacactagtgttaaagtggctagcttttggaggggaatcagtgtcagaccacgtcaagcaggcggcagttgatttagtcgactcggaccgatg

SEQ ID NO: 4924 - DNA, 203 bp, Homo sapiens
  source 1..203: mol_type = other DNA
ggcgcgccagtcctggtctattatgtgatgaataagccttccttcccaggtgactccgagacacagcaagaagggaggcgattcgtcgcaagcctgttcatctccgcactggcaacctacacatacaaaacttggaattaccacaatctctctaaagtggtggaaccagccctggcttacctcccctacgactcggaccgatg

SEQ ID NO: 4925 - DNA, 203 bp, Homo sapiens
  source 1..203: mol_type = other DNA
ggcgcgccagtcctcccatgtggctatgagatgaaagctttcaaaaatgtaggtggcaaacttaccaaagtggaggagagcgggcctttcctatgtagaaacagacctggtaggggaccagtcaactacagagtcaccaagtattacgatgacaacctcagagagataaaaccagtagcaaagttggacgactcggaccgatg

SEQ ID NO: 4926 - DNA, 203 bp, Homo sapiens
  source 1..203: mol_type = other DNA
ggcgcgccagtcctcaccacatggctagcttacaccttcgtgaatgaagacgtagggactataaaaccagtactaggagagagagtaatccccgaccctgtagttgatatcaatttacaaccagaggtgcaagtggacacgtcagaggttgggatcacaataattggaagggaaaccctgatgacaaccgactcggaccgatg

SEQ ID NO: 4927 - DNA, 203 bp, Homo sapiens
  source 1..203: mol_type = other DNA
ggcgcgccagtcctcccacctgcaactaagagcaataaggggcacatggcatcagcttaccaattggcacagggtaactgggagcccctcggttgcggggtgcacctaggtacaataccagccagaagggtgaagatacacccatatgaagcttacctgaagttgaaagatttcatagaagaagaagacgactcggaccgatg

SEQ ID NO: 4928 - DNA, 203 bp, Homo sapiens
  source 1..203: mol_type = other DNA
ggcgcgccagtccttataaatatagttgggaccgtccacctcaagaagacgacacgcccaacacgcacagctaaacagtagtcaagattatctacctcaagataacactacatttaatgcacacagcactttagctgtatgaggatacgcccgacgtctatagttggactagggaagacctctaacagcgactcggaccgatg

SEQ ID NO: 4929 - DNA, 203 bp, Homo sapiens
  source 1..203: mol_type = other DNA
ggcgcgccagtcctgagttctaggagagtccctcctagtctctcctctccgaggaggtaccgagacctcaaaataaaggagtgattgccttactgccgagtggagagtgattactgagcggccggtgtatcgggagtcgtcccttaatctgtgcaataccagagcggctctcgcagctggcgcccaaccgactcggaccgatg

SEQ ID NO: 4930 - DNA, 203 bp, Homo sapiens
  source 1..203: mol_type = other DNA
ggcgcgccagtcctattaacagtggatcaaattatgggggtaggacaaacaaatcaagcagcagcacaagctaacatggatcaggcaaggcaaatatgcctgcaatgggtaataaatgcattaagagcagtaagacatatggcgcacaggccagggaatccaatgctagtaaagcaaaaaacgaatgacgactcggaccgatg

SEQ ID NO: 4931 - DNA, 203 bp, Homo sapiens
  source 1..203: mol_type = other DNA
ggcgcgccagtcctaaaaatgcaagcatgtagagatgtgggatcagaagggttcaaaatgcaattgttagcacaagcattaaggccaggaaaaggaaaagggaatggacagccacaaaggtgttacaactgtggaaaaccgggacatcaagcaaggcaatgtagacaaggaatcatatgtcacaactgcgactcggaccgatg

SEQ ID NO: 4932 - DNA, 203 bp, Homo sapiens
  source 1..203: mol_type = other DNA
ggcgcgccagtccttggaaagagaggacatatgcaaaaagaatgcagaggaaagagagacataaggggaaaacagcagggaaacgggaggagggggatacgtgtggtgccgtccgctcctcctatggaataacttcagcaccacctatggttcaggtccgcataggttcccagcagaggaacttgttacgactcggaccgatg

SEQ ID NO: 4933 - DNA, 203 bp, Homo sapiens
  source 1..203: mol_type = other DNA
ggcgcgccagtcctgaaatcatagataaattagtggaagaaggaaaactaggaaaggcacccccacattggacatgtaatactccaatcttttgcataaaaaagaaatcagggaagtggagaatgttaatagatttcagagaattgaacaaacagacagaagatttaacagaagcgcagttaggactccgactcggaccgatg

SEQ ID NO: 4934 - DNA, 203 bp, Homo sapiens
  source 1..203: mol_type = other DNA
ggcgcgccagtcctggacaattggcttggggagacaaagctatagaatatatagtgtatcaggagaaagggaaaccattatgggtaaatgtggttcacaatataaagaacctaagcatcccgcaacaggttattaaagcagcgcaaaaattaacccaagaagtcatcattaggacaggaaaaataccacgactcggaccgatg

SEQ ID NO: 4935 - DNA, 203 bp, Homo sapiens
  source 1..203: mol_type = other DNA
ggcgcgccagtcctaattgggatgaagaagtaataaagaatccaattcaagcaagaattatggaaattgcccacaagaaagataggataggagtgcattgggtgccaggacataaagggattccccaaaatgaagaaatagacaaatatatttcggaaatatttcttgcaaaagaaggagaaggaattcgactcggaccgatg

SEQ ID NO: 4936 - DNA, 203 bp, Homo sapiens
  source 1..203: mol_type = other DNA
ggcgcgccagtcctaaaacctggaccagaattacccttagcactatggatacatatagcagaaagcattaatggggatagctcatggtacataacaatgagactgcaacagatgatgtggggaaaaagaggaaataagttacaatataagaatgaagacagggaatatgaaaattgggaaattacatccgactcggaccgatg

SEQ ID NO: 4937 - DNA, 203 bp, Homo sapiens
  source 1..203: mol_type = other DNA
ggcgcgccagtcctatggggatggaaaatgcacctaaggagagtgaaacaatggatacaagacaacaggagaggaagcccatggcagtacaaagtaggaggaacatggaaaagtataggagtgtggttcctgcaagcaggagattacagaaaggtagacaggcacttctggtgggcatggaggatactcgactcggaccgatg

SEQ ID NO: 4938 - DNA, 203 bp, Homo sapiens
  source 1..203: mol_type = other DNA
ggcgcgccagtccttatatcaagagaattggccatggaatacatatcattggcctctctggcaaatggagaatgttaggtactggttaaaagaaaatatgcaagaaaatcaacagagaaaaaataatacaaaagagggtatagaggaattattagcaggaactataaggggaagattctgtgtaccatcgactcggaccgatg

SEQ ID NO: 4939 - DNA, 203 bp, Homo sapiens
  source 1..203: mol_type = other DNA
ggcgcgccagtcctgagagagcatggcctttatgaatatcaaagcatgtgatagcaacctaaggtgtcagaaaagacctggagggtgtatggaaggataccctatcccagtaggagcagaaataatccctgaaagtatgaaatacctaaggggagcaaagagtcagtatgggggaataaaagataagacgactcggaccgatg

SEQ ID NO: 4940 - DNA, 203 bp, Homo sapiens
  source 1..203: mol_type = other DNA
ggcgcgccagtcctgccagaacggcaaatggtgtaactacaccggggaaataaaattagggcaagaaacattccaatatcattacaagccaaactggaactgtaccgggaattggacgcaatatccggtgtggcaagtgattagaaacctggatatggtggaacatatgacaggagaatgtgtgcagacgactcggaccgatg

SEQ ID NO: 4941 - DNA, 203 bp, Homo sapiens
  source 1..203: mol_type = other DNA
ggcgcgccagtcctaaatgccagaaaactatgcaaaaacaagaatcataaacaggaaaaaaagagaactcagccacaagaggaagaagagaggcgttggcttggtcattatgctagttatcatggcaatagtagctgccgcaggggcttctctgggagtcgcaaacgcgattcagcagtcttacactacgactcggaccgatg

SEQ ID NO: 4942 - DNA, 203 bp, Homo sapiens
  source 1..203: mol_type = other DNA
ggcgcgccagtcctaggcagctgtccagacccttgctaatgcaactgctgcacagcaggatgtgttagaggcaacctatgccatggtacagcatgtggctaaaggcgtacgaatcttggaagctcgagtggctcgagtggaagctatcacagatagaataatgctataccaagaattggattgttggccgactcggaccgatg

SEQ ID NO: 4943 - DNA, 203 bp, Homo sapiens
  source 1..203: mol_type = other DNA
ggcgcgccagtcctactatcatcaatactgtataacctctacaaaaacagaagtagcaaaatatatcaattggacgaggtttaaggataattgcacatggcagcagtgggagagaggattacaggggtatgatacaaacttaacaatactgttaaaggaatcagcagcaatgacacaactagcagaagcgactcggaccgatg

SEQ ID NO: 4944 - DNA, 203 bp, Homo sapiens
  source 1..203: mol_type = other DNA
ggcgcgccagtcctagcaagcaaggaggataccagaagtatgggaaagtttaaaagacgtctttgattggtcaggatggttctcatggctaaagtatattcctattatagtagtaggattattaggatgcattctgataagagctgtgatatgtgtatgtcaacctcttgtgcagatatacagaactccgactcggaccgatg

SEQ ID NO: 4945 - DNA, 203 bp, Homo sapiens
  source 1..203: mol_type = other DNA
ggcgcgccagtcctgtaacagctgacatatcagctgatgcttgctcatgctgacactgtagctctgagctgtatataaggagaagcttgctgcttgcacttcagagttctaggagagtccctcctagtctctcctctccgaggaggtaccgagacctcaaaataaaggagtgattgccttactgccgacgactcggaccgatg

SEQ ID NO: 4946 - DNA, 203 bp, Homo sapiens
  source 1..203: mol_type = other DNA
ggcgcgccagtcctccgtggcggtggctgcgttggcggcctgcctacggggaaacccgtaggacgctctaatacagacatggtgcgaagagtctattgagctagttggtaatcctccggcccctgaatgcggctaatcctaactgcggagcacataccctcaaaccagggggcagtgtgtcgtaacggcgactcggaccgatg

SEQ ID NO: 4947 - DNA, 203 bp, Homo sapiens
  source 1..203: mol_type = other DNA
ggcgcgccagtcctagaggttaaaacactacatctcatcattaaactaaatacaacaaaatgggggctcaagtatcaacacaaaagactggagcacatgagaccgggctgaatgcaagcgggaattccatcatccattacacaaacataaactactataaagatgctgcatccaactcagccaacagacgactcggaccgatg

SEQ ID NO: 4948 - DNA, 203 bp, Homo sapiens
  source 1..203: mol_type = other DNA
ggcgcgccagtcctttgcccgtcatgacgacaccgggtagcacgcaatttctgacttctgatgatttccaatcgccatcagcaatgccacaattcgacgtcacaccagagatgcagatcccgggtcgtgtcaacaatctgatggaaatagctgaggtggactctgtggtcccagtgaacaacactgaccgactcggaccgatg

SEQ ID NO: 4949 - DNA, 203 bp, Homo sapiens
  source 1..203: mol_type = other DNA
ggcgcgccagtcctaagaattaccactcaaggtcggaatcttccattgaaaatttcttgtgccgatctgcttgtgtgtattacgccacctacaataataattctgagaagggctacgcagagtgggttatcaacaccaggcaggttgcgcagttgctgaggaggaaactagagttcacttacttaaggcgactcggaccgatg

SEQ ID NO: 4950 - DNA, 203 bp, Homo sapiens
  source 1..203: mol_type = other DNA
ggcgcgccagtcctacagaggggaatgccccaccgaggatgtctattcccttcatcagtattggaaatgcttatagctgcttttatgatggatggacacagttctctaggaatggggtttacggcattaataccctgaacaacatgggtacgctgtacatgcggcacgtaaatgaggcaggccaaggccgactcggaccgatg

SEQ ID NO: 4951 - DNA, 203 bp, Homo sapiens
  source 1..203: mol_type = other DNA
ggcgcgccagtcctgtaactatgggaggggagggtgttgttggctttgccgacgtacgcgacctgctgtggttagaagatgatgcaatggagcagggggtcaaagattacgtagagcaacttggaaacgcctttgggtcaggattcactaaccaagtctgtgaacaggttaaccttttgaaagagtcccgactcggaccgatg

SEQ ID NO: 4952 - DNA, 203 bp, Homo sapiens
  source 1..203: mol_type = other DNA
ggcgcgccagtcctctagtgggccaagactccatcttagaaaaatctctgaaagccctagtaaaaattgtgtcagccttggtgatagtcgtgaggaaccacgacgatttaataacagtgactgcaacacttgccctcattggctgcacctcctcaccatggagatggcttaagcaaaaggtgtcccagcgactcggaccgatg

SEQ ID NO: 4953 - DNA, 203 bp, Homo sapiens
  source 1..203: mol_type = other DNA
ggcgcgccagtcctagacttaaacaacttccgttactggagagtcagattgccaccattgagcaaagtgcaccttctcagagtgatcaagagcaattgttttctaatgttcagtactttgcacattactgcaggaaatacgcacccctgtatgcggccgaagcaaaaagggtgttctcccttgagaagcgactcggaccgatg

SEQ ID NO: 4954 - DNA, 203 bp, Homo sapiens
  source 1..203: mol_type = other DNA
ggcgcgccagtcctaaaatgagtaactacatacagttcaagtccaaatgccgtattgaacctgtatgcttgctcttgcacgggagtcctggtgcagggaagtcagttgccactaacctgattgggcgctcactcgcggagaagcttaatagctctgtgtactctctaccaccagacccagaccattttcgactcggaccgatg

SEQ ID NO: 4955 - DNA, 203 bp, Homo sapiens
  source 1..203: mol_type = other DNA
ggcgcgccagtcctgacggttacaaacaacaggccgttgtgatcatggatgatttatgccagaacccagatggtaaggatgtttctttgttttgtcaaatggtctccagtgtggactttgtaccgccaatggcagcgctagaagagaaaggcattttgttcacctctccctttgtcctggcttcaacccgactcggaccgatg

SEQ ID NO: 4956 - DNA, 203 bp, Homo sapiens
  source 1..203: mol_type = other DNA
ggcgcgccagtcctaacgccggctctattaatgctccaacagtttcagacagtagggcactggctaggaggtttcactttgatatgaacatcgaggtcatttccatgtacagccagaatgggaagataaacatgcctatgtcggtgaagacgtgtgatgaagagtgttgcccagtcaactttaagaaacgactcggaccgatg

SEQ ID NO: 4957 - DNA, 203 bp, Homo sapiens
  source 1..203: mol_type = other DNA
ggcgcgccagtccttgctgccccttagtgtgtggaaaggctatccagtttatagatagaaggacacaagtcagatactcccttgacatgctggtaactgagatgttcagagaatataaccatagacatagtgttggggccacccttgaggcgctatttcagggcccgccaatatatagagagattaagcgactcggaccgatg

SEQ ID NO: 4958 - DNA, 203 bp, Homo sapiens
  source 1..203: mol_type = other DNA
ggcgcgccagtcctatcagtattgcgccagagacgccaccaccacctgccattgcagatctactcaaatcagtagacagtgaggctgtgagggagtactgcaaagaaaaaggatggctggttccagagatcaactccaccctgcagattgaaaagcacgtcagtagggcctttatctgtttgcaagcacgactcggaccgatg

SEQ ID NO: 4959 - DNA, 203 bp, Homo sapiens
  source 1..203: mol_type = other DNA
ggcgcgccagtcctcccaccaagagaatgcttatgtacaacttccccacgagggcaggtcagtgtggcggagtgctcatgtccactggcaaagttttggggatccatgttggcgggaatggtcatcaaggcttctcagcggcacttcttaaacactacttcaatgatgaacaaggagaaatcgagttccgactcggaccgatg

SEQ ID NO: 4960 - DNA, 203 bp, Homo sapiens
  source 1..203: mol_type = other DNA
ggcgcgccagtcctattgaaagctcaaaggaagcagggttcccagtcatcaacacgcctagcaaaactaaattggagccaagtgtcttccaccaggtttttgaaggcaataaagagccagcagtcctcaggaatggcgatccacgcctcagagccaactttgaggaggccatattttccaaatacatccgactcggaccgatg

SEQ ID NO: 4961 - DNA, 203 bp, Homo sapiens
  source 1..203: mol_type = other DNA
ggcgcgccagtcctatcatgacaccagcagacaaaggggattgcttcaatgaagtcacctgggctaatgtcacatttctaaagaggtattttagagcagatgaacagtacccctttttagtgcaccccgtcatgcctatgaaagacatacatgaatcaatcagatggaccaaggacccaaagaacacccgactcggaccgatg

SEQ ID NO: 4962 - DNA, 203 bp, Homo sapiens
  source 1..203: mol_type = other DNA
ggcgcgccagtcctagcgtcccagttggagcttgcttgactctacctgcgttttcaactctacgcaggaagtggttggactctttttaaattagagacaatttgaactaattttaattggcttaaccctaccgcactaaccgaactagataacggtgcagtgggggtaaattctccgcattcggtgcgcgactcggaccgatg

SEQ ID NO: 4963 - DNA, 203 bp, Homo sapiens
  source 1..203: mol_type = other DNA
ggcgcgccagtcctgatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatcgactcggaccgatg

SEQ ID NO: 4964 - DNA, 203 bp, Homo sapiens
  source 1..203: mol_type = other DNA
ggcgcgccagtcctcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacacgactcggaccgatg

SEQ ID NO: 4965 - DNA, 203 bp, Homo sapiens
  source 1..203: mol_type = other DNA
ggcgcgccagtcctgaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatcgactcggaccgatg

SEQ ID NO: 4966 - DNA, 203 bp, Homo sapiens
  source 1..203: mol_type = other DNA
ggcgcgccagtcctaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgccgactcggaccgatg

SEQ ID NO: 4967 - DNA, 203 bp, Homo sapiens
  source 1..203: mol_type = other DNA
ggcgcgccagtcctgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctacgactcggaccgatg

SEQ ID NO: 4968 - DNA, 203 bp, Homo sapiens
  source 1..203: mol_type = other DNA
ggcgcgccagtcctgtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccacgactcggaccgatg

SEQ ID NO: 4969 - DNA, 203 bp, Homo sapiens
  source 1..203: mol_type = other DNA
ggcgcgccagtccttccgtttccccactgctcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagccgactcggaccgatg

SEQ ID NO: 4970 - DNA, 203 bp, Homo sapiens
  source 1..203: mol_type = other DNA
ggcgcgccagtcctattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatccgactcggaccgatg

SEQ ID NO: 4971 - DNA, 203 bp, Homo sapiens
  source 1..203: mol_type = other DNA
ggcgcgccagtcctctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggcccgactcggaccgatg

SEQ ID NO: 4972 - DNA, 203 bp, Homo sapiens
  source 1..203: mol_type = other DNA
ggcgcgccagtcctcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaacgactcggaccgatg

SEQ ID NO: 4973 - DNA, 203 bp, Homo sapiens
  source 1..203: mol_type = other DNA
ggcgcgccagtcctaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaaccgactcggaccgatg

SEQ ID NO: 4974 - DNA, 203 bp, Homo sapiens
  source 1..203: mol_type = other DNA
ggcgcgccagtcctactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccacgactcggaccgatg

SEQ ID NO: 4975 - DNA, 203 bp, Homo sapiens
  source 1..203: mol_type = other DNA
ggcgcgccagtcctcgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatccgactcggaccgatg

SEQ ID NO: 4976 - DNA, 203 bp, Homo sapiens
  source 1..203: mol_type = other DNA
ggcgcgccagtcctacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccgactcggaccgatg

SEQ ID NO: 4977 - DNA, 203 bp, Homo sapiens
  source 1..203: mol_type = other DNA
ggcgcgccagtccttcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtcgactcggaccgatg

SEQ ID NO: 4978 - DNA, 203 bp, Homo sapiens
  source 1..203: mol_type = other DNA
ggcgcgccagtcctgcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttcgactcggaccgatg

SEQ ID NO: 4979 - DNA, 203 bp, Homo sapiens
  source 1..203: mol_type = other DNA
ggcgcgccagtcctgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaacgactcggaccgatg

SEQ ID NO: 4980 - DNA, 203 bp, Homo sapiens
  source 1..203: mol_type = other DNA
ggcgcgccagtcctatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactccgactcggaccgatg

SEQ ID NO: 4981 - DNA, 203 bp, Homo sapiens
  source 1..203: mol_type = other DNA
ggcgcgccagtcctaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttcgactcggaccgatg

SEQ ID NO: 4982 - DNA, 203 bp, Homo sapiens
  source 1..203: mol_type = other DNA
ggcgcgccagtccttggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggcgactcggaccgatg

SEQ ID NO: 4983 - DNA, 203 bp, Homo sapiens
  source 1..203: mol_type = other DNA
ggcgcgccagtccttgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaacgactcggaccgatg

SEQ ID NO: 4984 - DNA, 203 bp, Homo sapiens
  source 1..203: mol_type = other DNA
ggcgcgccagtcctacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaacgactcggaccgatg

SEQ ID NO: 4985 - DNA, 203 bp, Homo sapiens
  source 1..203: mol_type = other DNA
ggcgcgccagtcctgaaggagatctcaaacatgctgagcataatcaaccaacggaaaaagacatcgctctgtctcatgatgatattgccagcagcacttgctttccacttgacttcacgagatggagagccgcgcatgattgtggggaagaatgaaagaggtaaatccctactttttaagacagcctccgactcggaccgatg

SEQ ID NO: 4986 - DNA, 203 bp, Homo sapiens
  source 1..203: mol_type = other DNA
ggcgcgccagtcctacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcgactcggaccgatg

SEQ ID NO: 4987 - DNA, 203 bp, Homo sapiens
  source 1..203: mol_type = other DNA
ggcgcgccagtcctcacttccctgacccagaaggtggttattttcatattattaatgctggtcaccccatccatgacaatgagatgtgtgggagtaggaaacagagattttgtggaagggctatcaggagctacgtgggttgacgtggtgctcgagcacggggggtgtgtgactaccatggctaagaacgactcggaccgatg

SEQ ID NO: 4988 - DNA, 203 bp, Homo sapiens
  source 1..203: mol_type = other DNA
ggcgcgccagtcctatacgtagacagaggttgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaacgactcggaccgatg

SEQ ID NO: 4989 - DNA, 203 bp, Homo sapiens
  source 1..203: mol_type = other DNA
ggcgcgccagtcctgaaaatcaactggtacaagaaggggagctcgattgggaagatgttcgaggccactgaaaggggtgcaaggcgcatggccatcttgggagacacagcttgggactttggatcagtgggtggtgttctgaactcattaggcaaaatggtgcaccaaatatttggaagtgcttataccgactcggaccgatg

SEQ ID NO: 4990 - DNA, 203 bp, Homo sapiens
  source 1..203: mol_type = other DNA
ggcgcgccagtcctgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtctacacccaactatgtgaccatagcgactcggaccgatg

SEQ ID NO: 4991 - DNA, 203 bp, Homo sapiens
  source 1..203: mol_type = other DNA
ggcgcgccagtcctgctaatgtcggcagctgtcaaggatgagagggccgtgcatgccgacatgggctactggatagaaagccaaaagaatggaagttggaagctagaaaaagcatccctcatagaggtaaaaacctgcacatggccaaaatcacacactctctggactaatggtgtgctagagagtgacgactcggaccgatg

SEQ ID NO: 4992 - DNA, 203 bp, Homo sapiens
  source 1..203: mol_type = other DNA
ggcgcgccagtcctgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaacgactcggaccgatg

SEQ ID NO: 4993 - DNA, 203 bp, Homo sapiens
  source 1..203: mol_type = other DNA
ggcgcgccagtcctcagttctctccttagaaatgatgtgcccatggctggaccattagtggccgggggcttgctgatagcgtgctacgtcataactggcacgtcagcggacctcactgtagaaaaagccccagatgtaacatgggaggaagaggctgagcagacaggagtgtcccacaacttaatgatcgactcggaccgatg

SEQ ID NO: 4994 - DNA, 203 bp, Homo sapiens
  source 1..203: mol_type = other DNA
ggcgcgccagtcctgaaaagactggaaccaaactgggctagtgtgaaaaaagatctgatttcatatggaggaggatggagactgagcgcacaatggcaaaagggggaggaggtgcaggttattgccgtagagccagggaagaacccaaagaactttcaaaccacgccaggcactttccagactactaccgactcggaccgatg

SEQ ID NO: 4995 - DNA, 203 bp, Homo sapiens
  source 1..203: mol_type = other DNA
ggcgcgccagtcctgttggaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattcgactcggaccgatg

SEQ ID NO: 4996 - DNA, 203 bp, Homo sapiens
  source 1..203: mol_type = other DNA
ggcgcgccagtcctgaaagggctcccaataaggtaccaaacaacagcaacaaaatctgaacacacaggaagagagattgttgatctaatgtgccacgcaacgttcacaatgcgtttgctgtcaccagttagggttccaaattacaacttgataataatggatgaggcccatttcacagacccagccagcgactcggaccgatg

SEQ ID NO: 4997 - DNA, 203 bp, Homo sapiens
  source 1..203: mol_type = other DNA
ggcgcgccagtccttatagcggctagagggtacatatcaactcgtgttggaatgggagaggcagccgcaatcttcatgacagcaacaccccctggaacagctgatgcctttcctcagagcaacgctccaattcaagatgaagaaagggacataccagaacgctcatggaattcaggcaatgaatggatcgactcggaccgatg

SEQ ID NO: 4998 - DNA, 203 bp, Homo sapiens
  source 1..203: mol_type = other DNA
ggcgcgccagtccttaccgacttcgctgggaaaacggtgtggtttgtccctagcattaaagccggaaatgacatagcaaactgcttgcgaaaaaacgggaaaaaagtcattcaacttagtaggaagacttttgacacagaatatcagaagactaaactgaatgattgggactttgtggtgacaactgacgactcggaccgatg

SEQ ID NO: 4999 - DNA, 203 bp, Homo sapiens
  source 1..203: mol_type = other DNA
ggcgcgccagtcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatttggaccgactcggaccgatg

SEQ ID NO: 5000 - DNA, 203 bp, Homo sapiens
  source 1..203: mol_type = other DNA
ggcgcgccagtcctaaaggaaggagaaaagaaaaaattgagacctaggtggcttgatgcccgcacttattcagatccattggcactcaaggaattcaaggactttgcggctggcagaaagtcaatcgcccttgatcttgtgacagaaataggaagagtgccttcacatctagcccacagaacaagaaacgactcggaccgatg

SEQ ID NO: 5001 - DNA, 203 bp, Homo sapiens
  source 1..203: mol_type = other DNA
ggcgcgccagtcctcgctctggacaatctggtgatgctgcatacgtcagaagatggcggtagggcttacaggcatgcggtggaggaactaccagaaacaatggaaacactcctactcttgggactaatgatcttgttgacaggtggagcaatgcttttcttgatatcaggtaaagggattggaaagaccgactcggaccgatg

SEQ ID NO: 5002 - DNA, 203 bp, Homo sapiens
  source 1..203: mol_type = other DNA
ggcgcgccagtcctatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatcgactcggaccgatg

SEQ ID NO: 5003 - DNA, 203 bp, Homo sapiens
  source 1..203: mol_type = other DNA
ggcgcgccagtcctggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatccgactcggaccgatg

SEQ ID NO: 5004 - DNA, 203 bp, Homo sapiens
  source 1..203: mol_type = other DNA
ggcgcgccagtccttggaatcactgaagtggatagaacagaagccaaagaagggttgaaaagaggagagacaacacatcatgccgtgtcccgaggtagcgcaaaacttcaatggtttgtggaaagaaacatggtcgttcccgaaggaagagtcatagacttgggctgtggaagaggaggctggtcatacgactcggaccgatg

SEQ ID NO: 5005 - DNA, 203 bp, Homo sapiens
  source 1..203: mol_type = other DNA
ggcgcgccagtcctttactgtgcaggactgaaaaaagtcacagaagtgcgaggatacacaaaaggcggtccaggacacgaagaaccagtacctatgtctacatatggatggaacatagttaagttaatgagcggaaaggatgtgttctatctcccacctgaaaagtgtgataccctgttgtgtgacatcgactcggaccgatg

SEQ ID NO: 5006 - DNA, 203 bp, Homo sapiens
  source 1..203: mol_type = other DNA
ggcgcgccagtcctgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacacgactcggaccgatg

SEQ ID NO: 5007 - DNA, 203 bp, Homo sapiens
  source 1..203: mol_type = other DNA
ggcgcgccagtcctacagcaaatggaccctgaacacaggcagttagcgaacgctatattcaagctcacataccaaaacaaagtggtcaaagttcaacgaccgactccaacgggcacggtaatggatattatatctaggaaagaccaaaggggcagtggacaactgggaacttatggcctgaatacattcgactcggaccgatg

SEQ ID NO: 5008 - DNA, 203 bp, Homo sapiens
  source 1..203: mol_type = other DNA
ggcgcgccagtcctccactgggttcccacaagtagaacgacatggtctattcatgctcaccatcagtggatgactacagaagacatgcttactgtttggaacagggtgtggatagaggaaaatccatggatggaagacaaaactccagttacaacttgggaaaatgttccatatctaggaaagagagacgactcggaccgatg

SEQ ID NO: 5009 - DNA, 203 bp, Homo sapiens
  source 1..203: mol_type = other DNA
ggcgcgccagtcctagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagtcggagggagccatttggtacgactcggaccgatg

SEQ ID NO: 5010 - DNA, 203 bp, Homo sapiens
  source 1..203: mol_type = other DNA
ggcgcgccagtcctaacgtaggaagtggaaaagaggctaactgtcaggccaccttaagccacagtacggaagaagctgtgctgcctgtgagccccgtccaaggacgttaaaagaagaagtcaggccccaaagccacggtttgagcaaaccgtgctgcctgtagctccgtcgtggggacgtaaaacctgcgactcggaccgatg

SEQ ID NO: 5011 - DNA, 203 bp, Homo sapiens
  source 1..203: mol_type = other DNA
ggcgcgccagtcctagcactgagggaagctgtacctccttgcaaaggactagaggttagaggagaccccccgcaaataaaaacagcatattgacgctgggagagaccagagatcctgctgtctcctcagcatcattccaggcacagaacgccagaaaatggaatggtgctgttgaatcaacaggttctcgactcggaccgatg

SEQ ID NO: 5012 - DNA, 203 bp, Homo sapiens
  source 1..203: mol_type = other DNA
ggcgcgccagtcctaacatccatcacccagaaagggatcatttttattttgctgatgctggtaactccatccatggccatgcggtgcgtgggaataggcaacagagacttcgtggaaggactgtcaggagctacgtgggtggatgtggtactggagcatggaagttgcgtcactaccatggcaaaagacgactcggaccgatg

SEQ ID NO: 5013 - DNA, 203 bp, Homo sapiens
  source 1..203: mol_type = other DNA
ggcgcgccagtccttgagaccacagaacatggaacaactgcaaccataacacctcaagctcccacgtcggaaatacagctgacagactacggagctctaacattggattgttcacctagaacagggctagactttaatgagatggtgttgttgacaatgaaaaaaaaatcatggctcgtccacaaacacgactcggaccgatg

SEQ ID NO: 5014 - DNA, 203 bp, Homo sapiens
  source 1..203: mol_type = other DNA
ggcgcgccagtcctatctcttagaaccacaacagtcacaggaaagacaatccatgaatggtgctgtagatcttgcacgttaccccccctacgtttcaaaggagaagacgggtgctggtacggcatggaaatcagaccagtcaaggagaaggaagagaacctagttaagtcaatggtctctgcagggtccgactcggaccgatg

SEQ ID NO: 5015 - DNA, 203 bp, Homo sapiens
  source 1..203: mol_type = other DNA
ggcgcgccagtccttcttctaagttcacttctcaagaatgatgtgccactagctggcccactaatagctggaggcatgctaatagcatgttatgtcatatctggaagctcggccgatttatcactggagaaagcggctgaggtctcctgggaagaagaagcagaacactctggtgcctcacacaacatcgactcggaccgatg

SEQ ID NO: 5016 - DNA, 203 bp, Homo sapiens
  source 1..203: mol_type = other DNA
ggcgcgccagtcctccctgaaggcgaagttggagccatagctctagactttaaacccggcacatctggatctcctatcgtgaacagagagggaaaaatagtaggtctttatggaaatggagtggtgacaacaagtggtacctacgtcagtgccatagctcaagctaaagcatcacaagaagggcctctcgactcggaccgatg

SEQ ID NO: 5017 - DNA, 203 bp, Homo sapiens
  source 1..203: mol_type = other DNA
ggcgcgccagtcctaccagagattgaggacgaggtgtttaggaaaagaaacttaacaataatggacctacatccaggatcgggaaaaacaagaagataccttccagccatagtccgtgaggccataaaaagaaagctgcgcacgctagtcttagctcccacaagagttgtcgcttctgaaatggcagacgactcggaccgatg

SEQ ID NO: 5018 - DNA, 203 bp, Homo sapiens
  source 1..203: mol_type = other DNA
ggcgcgccagtcctaacagacatatccgaaatgggagcaaacttccgagccgacagggtaatagacccgaggcggtgcctgaaaccggtaatactaaaagatggcccagagcgtgtcattctagcgggaccgatgccagtgactgtggctagcgccgcccagaggagaggaagaattggaaggaaccacgactcggaccgatg

SEQ ID NO: 5019 - DNA, 203 bp, Homo sapiens
  source 1..203: mol_type = other DNA
ggcgcgccagtcctggtgataggtctgttattcatgatattgacagtggcagccaatgagatgggattactggaaaccacaaagaaggacctggggattggtcatgcagctgctgaaaaccaccatcatgctgcaatgctggacgtagacctacatccagcttcagcctggactctctatgcagtggccgactcggaccgatg

SEQ ID NO: 5020 - DNA, 203 bp, Homo sapiens
  source 1..203: mol_type = other DNA
ggcgcgccagtcctcatggtcaatggtgtggtgagactgctaaccaaaccatgggatgtcattcccatggtcacacaaatagccatgactgacaccacaccctttggacaacagagggtgtttaaagagaaagttgacacgcgtacaccaaaagcgaaacgaggcacagcacaaattatggaggtgaccgactcggaccgatg

SEQ ID NO: 5021 - DNA, 203 bp, Homo sapiens
  source 1..203: mol_type = other DNA
ggcgcgccagtccttccagttgattgggtcccaaccagccgcaccacctggtcgatccatgcccaccatcaatggatgacaacagaagacatgttgtcagtgtggaatagggtttggatagaggaaaacccatggatggaggacaagactcatgtgtccagttgggaagacgttccatacctaggaaacgactcggaccgatg

SEQ ID NO: 5022 - DNA, 203 bp, Homo sapiens
  source 1..203: mol_type = other DNA
ggcgcgccagtcctgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgccccgactcggaccgatg

SEQ ID NO: 5023 - DNA, 203 bp, Homo sapiens
  source 1..203: mol_type = other DNA
ggcgcgccagtcctacactgcttcagaaaagatcctggcggtggaaaggtactacaccttcaaggttaatgattggacatcaacacaaaagccctttgagtacatccgcattccccttcctcacgtcctgtccggtgaagatggtggtgtctttggtgcggccctccgccggcactacctggtgaaaacgactcggaccgatg

SEQ ID NO: 5024 - DNA, 203 bp, Homo sapiens
  source 1..203: mol_type = other DNA
ggcgcgccagtcctctggatggcgggtgcaagttcagtgcaacgcctctcaattccacgctggaggtttgctggtgttcatggcaccagagtatccaaccttagatgcttttgccatggacaaccgttggtccaaggataacctgcctaatggaaccagaactcagacaaacaaaaagggaccatttgcgactcggaccgatg

SEQ ID NO: 5025 - DNA, 203 bp, Homo sapiens
  source 1..203: mol_type = other DNA
ggcgcgccagtcctatggcaagactcctgttgctccatccaattacatggtaggcgaatacaaggacttcctggagatagctcagattccaacctttattgggaataagatccctaatgctgtcccctacattgaggcatccaacacagccgtcaagacccaaccgctggccacctatcaagtgacctcgactcggaccgatg

SEQ ID NO: 5026 - DNA, 203 bp, Homo sapiens
  source 1..203: mol_type = other DNA
ggcgcgccagtccttgtcctgctcctgtctggccaatacattcttggccgctttgtctagaaactttgctcagtaccggggatcattggtttatacctttgtgttcactgggaccgcgatgatgaagggcaagttcctcattgcctacaccccacctggagcgggcaagcccactagtcgagaccaagcgactcggaccgatg

SEQ ID NO: 5027 - DNA, 203 bp, Homo sapiens
  source 1..203: mol_type = other DNA
ggcgcgccagtcctgatgcccgacctctgctaagatactaacaatggtgagcgcagggaaggatttctcactcaagatgcctatctcacctgccccctggagccctcagggagtagaaaacgctgaaaaaggggtcactgaaaacacaaacgcaactgctgactttgtggctcaaccagtttacttgccgactcggaccgatg

SEQ ID NO: 5028 - DNA, 203 bp, Homo sapiens
  source 1..203: mol_type = other DNA
ggcgcgccagtcctcttttagactgcccctggttcagaaggaatggcccgtgcgagaggagaacgttttcggtttgtaccggatcttcaatgcccactacgctggttactttgcggacctactgattcatgacattgagacaaatccagggcccttcatgtttagaccaaggaaacaggttttccagacgactcggaccgatg

SEQ ID NO: 5029 - DNA, 203 bp, Homo sapiens
  source 1..203: mol_type = other DNA
ggcgcgccagtcctaaacactaaacaacccagagttctggaagcagctcttgagcagatgtgtgcagctgattgcagggatgacaatagcagtgatgcatccggaccctttgactctgctctgcttaggaacattgacggccgccgagattacaagccagacaagtctgtgcgaagaaatagcagctacgactcggaccgatg

SEQ ID NO: 5030 - DNA, 203 bp, Homo sapiens
  source 1..203: mol_type = other DNA
ggcgcgccagtcctaggaaaaggaacagaccctagatcagctcttgcagcgtttccccgaacatgcgaagcgcatttctgatctccggaatggaatggccgcctatgtagagtgcaaggagagttttgatttctttgaaaagctgtacaatcaggcagtgaaagagaagagaacgggtatcgccgccgcgactcggaccgatg

SEQ ID NO: 5031 - DNA, 203 bp, Homo sapiens
  source 1..203: mol_type = other DNA
ggcgcgccagtcctctcttccatgcttccagaataactgccttttccttgagaaagctgggctccagttcagagataaccgaactaaagagatcatttccctggtagatgtgattgagagagccgtggctaggattgaaaggaagaagaaagttctcacaaccgtgcagacccttgtggcacaaggtccgactcggaccgatg

SEQ ID NO: 5032 - DNA, 203 bp, Homo sapiens
  source 1..203: mol_type = other DNA
ggcgcgccagtcctcagtagacgaggtcagtttccattccgtagtccagcagcttaaagcaagacagcaagcgacagatgaacagcttgaggaattgcaagaggctttcgcgaaagtacaggagcgtaactctgtgttttctgattggttgaagatttctgcaatgttgtgtgctgcgactctggcaccgactcggaccgatg

SEQ ID NO: 5033 - DNA, 203 bp, Homo sapiens
  source 1..203: mol_type = other DNA
ggcgcgccagtcctaatatgtagccaaacatgtaaccgcccccattggttttgtctaccccactggggtgagcacccagacttgcctccttgtgagaggccgcaccttggtagtaaatagacacatggccgagtctgactggacttccatagtagtgcgtggagtcacacacgcccgctctactgttacgactcggaccgatg

SEQ ID NO: 5034 - DNA, 203 bp, Homo sapiens
  source 1..203: mol_type = other DNA
ggcgcgccagtcctaaattttggccatagctaaagcaggcaaagagactgacgtatctttcatccgcctctcttctggtcctctattcagagacaatacatccaaatttgtcaaggctggtgatgtacttcctactggtgccgctccagtcacggggataatgaacacggacatacccatgatgtacacgactcggaccgatg

SEQ ID NO: 5035 - DNA, 203 bp, Homo sapiens
  source 1..203: mol_type = other DNA
ggcgcgccagtcctctttggaaggactggaggggatggaccccatggacaggaacacctccccggggcttccatatactgcgctaggaatgcgcagaacagatgtcgtagattgggaatcagccaccctgatcccgtttgcggcagaaagattaagaaaaatgaatgaaggagacttttccgaagttgcgactcggaccgatg

SEQ ID NO: 5036 - DNA, 203 bp, Homo sapiens
  source 1..203: mol_type = other DNA
ggcgcgccagtcctccattgtaagagtatataaccagtgctttgtgaaacttcgaggagtctctttgttgaggacttttgagttctcccttgaggctcccacagatacaataaatatttgagattgaaccctgtcgagtatctgtgtaatcttttttacctgtgaggtctcggaatccgggccgagaacgactcggaccgatg

SEQ ID NO: 5037 - DNA, 203 bp, Homo sapiens
  source 1..203: mol_type = other DNA
ggcgcgccagtcctggatcaggaccagtgtgttttaattgtaaaaaaccaggacatctagcaagacaatgtagagaagtgaaaaaatgtaataaatgtggaaaacctggtcatgtagctgccaaatgttggcaaggaaatagaaagaattcgggaaactggaaggcggggcgagctgcagccccagtgcgactcggaccgatg

SEQ ID NO: 5038 - DNA, 203 bp, Homo sapiens
  source 1..203: mol_type = other DNA
ggcgcgccagtccttaacagaaatagtagaaagactagaaagagaagggaaagtaaaaagagcagatccaaataatccatggaatacaccagtatttgctataaaaaagaaaagtggaaaatggagaatgctcatagattttagagaattaaacaaactaactgagaaaggagcagaggtccagttggcgactcggaccgatg

SEQ ID NO: 5039 - DNA, 203 bp, Homo sapiens
  source 1..203: mol_type = other DNA
ggcgcgccagtccttatatgctaaattaagtttggtgggaccacatcaaataagttatcaagtatatcagaaggatccagaaaagatactatggtatggaaaaatgagtagacaaaagaaaaaggcagaaaatacatgtgatatagccttaagagcatgctataagataagagaagagtctattataacgactcggaccgatg

SEQ ID NO: 5040 - DNA, 203 bp, Homo sapiens
  source 1..203: mol_type = other DNA
ggcgcgccagtcctgaataggaaaagaaccaagatatgaaatacctacttctagagaagcctgggaatcaaatttaattaattcaccatatcttaaggccccacctcctgaggtagaatatatccatgctgctttgaatataaagagagcgttaagtatgataaaagatgctccaataccaggagcagcgactcggaccgatg

SEQ ID NO: 5041 - DNA, 203 bp, Homo sapiens
  source 1..203: mol_type = other DNA
ggcgcgccagtcctaaacatggtatatagatggaggtagaaagctaggaaaagcagcaaaagcagcctattggacagatacaggaaagtggcaagtgatggaattagaaggcagtaatcagaaggcagaaatacaagcattattattggcattaaaagcaggatcagaggagatgaatattataacagcgactcggaccgatg

SEQ ID NO: 5042 - DNA, 203 bp, Homo sapiens
  source 1..203: mol_type = other DNA
ggcgcgccagtcctaagctgtcttacaattgttgagtgctcataatgttactgaattacaaacagataatggaccaaattttaaaaatcaaaagatggaaggagtactcaattacatgggtgtgaaacataagtttggtatcccagggaacccacagtcacaagcattagttgaaaatgtaaatcatacgactcggaccgatg

SEQ ID NO: 5043 - DNA, 203 bp, Homo sapiens
  source 1..203: mol_type = other DNA
ggcgcgccagtccttcaggtagtatggagacttccaccattagtagtcccagtagaagaatcagaaataattttttgggattgttgggcaccagaagaacccgcctgtcaggactttcttggggcaatgatacatctaaaagctaagacaaatataagtatacgagagggacctaccttggggaattgcgactcggaccgatg

SEQ ID NO: 5044 - DNA, 203 bp, Homo sapiens
  source 1..203: mol_type = other DNA
ggcgcgccagtccttgaaagtaaaaaggtgaaaatatctctacagtgcaatagcacaaaaaacctaacctttgcaatgagaagttcaggagattatggagaagtaacgggagcttggatagagtttggatgtcatagaaataaatcaaaacttcatgctgaagcaaggtttagaattagatgtagatgcgactcggaccgatg

SEQ ID NO: 5045 - DNA, 203 bp, Homo sapiens
  source 1..203: mol_type = other DNA
ggcgcgccagtccttaaagcgctagcagctgcctaaccgcaaaaccacatcctatggaaagcttgctaatgacgtataagttgttccattgtaagagtatataaccagtgctttgtgaaacttcgaggagtctctttgttgaggacttttgagttctcccttgaggctcccacagatacaataaatatcgactcggaccgatg

SEQ ID NO: 5046 - DNA, 203 bp, Homo sapiens
  source 1..203: mol_type = other DNA
ggcgcgccagtcctagaaaaaaatagacctcacccttacccacttcccctagcgctgaaaaacaaggctctgacgattaccccctgcccataaaatttgcctagtcaaaataaaagatgccgagtctataaaagcgcaaggacagttcaggaggtggctcgctccctcaccgaccctctggtcacggacgactcggaccgatg

SEQ ID NO: 5047 - DNA, 203 bp, Homo sapiens
  source 1..203: mol_type = other DNA
ggcgcgccagtcctgtttccgcctgcgctcggctagactctgccttaaacttcacttccgcgttcttgtctcgttctttcctcttcgccgtcactgaaaacgaaacctcaacgccgccctcttggcaggcgtcccggggccaacatacgccgtggagcgcagcaagggctagggcttcctgaacctctcgactcggaccgatg

SEQ ID NO: 5048 - DNA, 203 bp, Homo sapiens
  source 1..203: mol_type = other DNA
ggcgcgccagtcctccgggagaggtctattgctataggcaggcccgccctaggagcattgtcttcccggggaagacaaacaattgggggctcgtccgggatttgaattcctccattctcacattatgggacaaatccacgggctttccccaactccaatacccaaagcccccagggggctatcaaccccgactcggaccgatg

SEQ ID NO: 5049 - DNA, 203 bp, Homo sapiens
  source 1..203: mol_type = other DNA
ggcgcgccagtccttggctgctttctccaccctgccaggcaatacccgtgacccctcttgggcagctatcctacaggggctggaggaaccctattgcgcgttcgtagagcgccttaacgtggcccttgacaacggcctccccgagggtacccccaaagagcccatcttacgttccctagcgtactcaacgactcggaccgatg

SEQ ID NO: 5050 - DNA, 203 bp, Homo sapiens
  source 1..203: mol_type = other DNA
ggcgcgccagtcctacgccaacaaagaatgccaaaaaatcttacaagcccgcggacacactaacagcccccttggggagatgctccggacatgtcaggcgtggacacccaaggacaaaaccaaggtccttgtggtccaaccacggaggcccccccccacacagccctgctttcgttgtggcaaggtagcgactcggaccgatg

SEQ ID NO: 5051 - DNA, 203 bp, Homo sapiens
  source 1..203: mol_type = other DNA
ggcgcgccagtcctccttaaggggggagatctaatctccccccatcccgatcaagacatctcgatactcccactcatccccctgcggcagcaacagcaaccaattctaggggtccggatctccgttatgggacaaacacctcagcctacccaagcgctacttgacacaggagccgaccttacggttatcgactcggaccgatg

SEQ ID NO: 5052 - DNA, 203 bp, Homo sapiens
  source 1..203: mol_type = other DNA
ggcgcgccagtcctaccccagacactcgtgcccgggccggtaaagctccacgacaccctgatcctaggcgccagtgggcaaaccaacacccagttcaaactcctccaaacccccctacacatattcttgcccttccgaaggtcccccgttatcctttcctcctgcctcttagacacccacaacaaatgcgactcggaccgatg

SEQ ID NO: 5053 - DNA, 203 bp, Homo sapiens
  source 1..203: mol_type = other DNA
ggcgcgccagtcctgaccatcattggaagggacgccctacaacaatgccaggggcttctatacctcccagacgaccccagcccccaccaattgctgccaatagccactccaaacaccataggcctcgaacaccttcccccacctccccaagtggaccaatttcctttaaacctgagcgcctccaggcccgactcggaccgatg

SEQ ID NO: 5054 - DNA, 203 bp, Homo sapiens
  source 1..203: mol_type = other DNA
ggcgcgccagtcctttaaatgacctggtctccaaggccctggaggctggtcacattgaaccatactcaggaccaggcaataaccccgtcttccccgttaaaaaaccaaatggtaaatggaggttcattcatgacctaagagccaccaatgccattactaccaccctcacctctccttccccagggccccgactcggaccgatg

SEQ ID NO: 5055 - DNA, 203 bp, Homo sapiens
  source 1..203: mol_type = other DNA
ggcgcgccagtcctcccgatctcactagcctaccgacagccttaccccacctacagaccatagatcttactgacgcctttttccaaatccccctccccaagcagtaccagccatacttcgccttcaccattccccagccatgtaactatggccccgggaccagatatgcatggactgtccttccacagcgactcggaccgatg

SEQ ID NO: 5056 - DNA, 203 bp, Homo sapiens
  source 1..203: mol_type = other DNA
ggcgcgccagtcctgtctctaaaggaacacccatccttcgcaaacacctacaatccctatattctgcccttcacgggtaccgggacccaagagcttgtatcaccctcaccccacaacaactccatgcgttacatgccattcaacaagctctacaacataactgccgtggccgcctcaaccccgccctacgactcggaccgatg

SEQ ID NO: 5057 - DNA, 203 bp, Homo sapiens
  source 1..203: mol_type = other DNA
ggcgcgccagtcctcctctccttggcctcatctcgttaagtacatctggtacaacatctgtcatctttcaacccaagcaaaattggcccctggcttggctccacaccccccaccctccgaccagtttatgtccttggggtcacctactggcctgcaccatcttaactctagacaaatataccctacaacgactcggaccgatg

SEQ ID NO: 5058 - DNA, 203 bp, Homo sapiens
  source 1..203: mol_type = other DNA
ggcgcgccagtcctcattatggccagctctgccaatctttccaccacaacatgtcaaagcaagccctttgcgacttcctgaggaactcccctcatccaagtgtcggcatcctcattcaccacatgggtcgattccataaccttggcagccaaccgtctggtccgtggaagactctcttacacctcccacgactcggaccgatg

SEQ ID NO: 5059 - DNA, 203 bp, Homo sapiens
  source 1..203: mol_type = other DNA
ggcgcgccagtcctcccctactgcagggcaagaccatctacctccaccatgtccgcagccacaccaacctccccgacccaatttccaccttcaatgaatacacagactcccttatcttagctccccttgttcccctgacgccccaaggcctccacggcctcacccattgcaatcaaagggctctagtccgactcggaccgatg

SEQ ID NO: 5060 - DNA, 203 bp, Homo sapiens
  source 1..203: mol_type = other DNA
ggcgcgccagtcctctaaatgtcatgaaccccagtggtaaaacccgatggcaaatccaccacagtcctccactaccacccattcctgaagcctctacccctcccaaaccacctcccaaatggttctattataaactccccggccttaccaatcagcggtggaaaggtccattgcaatccctccaggaacgactcggaccgatg

SEQ ID NO: 5061 - DNA, 203 bp, Homo sapiens
  source 1..203: mol_type = other DNA
ggcgcgccagtcctgcggccggggcagccttgctctccatagacggctccccccggtggatcccgtggcgattcctgaaaaaagctgcatgcccaagaccagacgccagcgaactcgccgagcacgccgcaacagaccaccaacaccatgggtaatgttttcttcctacttttattcagtctcacacacgactcggaccgatg

SEQ ID NO: 5062 - DNA, 203 bp, Homo sapiens
  source 1..203: mol_type = other DNA
ggcgcgccagtcctgtttcattcagatgtaaatttcacccaggaagtcagccaagtgtcccttcgactacacttctctaagtgcggctcctccatgaccctcctagtagatgcccctggatatgatcctttatggttcatcacctcagaacccactcagcctccaccaacttctcccccattggtccacgactcggaccgatg

SEQ ID NO: 5063 - DNA, 203 bp, Homo sapiens
  source 1..203: mol_type = other DNA
ggcgcgccagtcctaacctcctcccgaaccatcctctttccttcccttgccctgcccgctcctccatcccaacccttcccttggacccattgctaccaacctcgcctacaggcgataacaacagataactgcaacaactccattatcctcccccctttttccctcgctcccgtacctcctccggcgaccgactcggaccgatg

SEQ ID NO: 5064 - DNA, 203 bp, Homo sapiens
  source 1..203: mol_type = other DNA
ggcgcgccagtcctaagacgccgccgtgccgttccaatagcagtgtggcttgtctccgccctagcggccggaacaggtatcgctggtggagtaacaggctccctatctctggcttccagtaaaagccttctcctcgaggttgacaaagacatctcccaccttacccaggccatagtcaaaaatcatcacgactcggaccgatg

SEQ ID NO: 5065 - DNA, 203 bp, Homo sapiens
  source 1..203: mol_type = other DNA
ggcgcgccagtcctaaacatcctccgggttgcacagtatgcagcccaaaatagacgaggattagacctcctattctgggaacaagggggtttgtgcaaggccatacaggagcaatgttgcttcctcaacatcagtaacactcatgtatccgtcctccaggaacggccccctcttgaaaaacgtgtcatcgactcggaccgatg

SEQ ID NO: 5066 - DNA, 203 bp, Homo sapiens
  source 1..203: mol_type = other DNA
ggcgcgccagtcctcgctcacattcctcccataggaccttcttttccccttcaggaaatccacataaccctgaagcaagtcacaaaacccatcaaaacccaggagtcctatacactccaactgctgatgcctttcttccctctcccggcgcttttgatccttttcccgcaggcgctcctttctgcgcccgactcggaccgatg

SEQ ID NO: 5067 - DNA, 203 bp, Homo sapiens
  source 1..203: mol_type = other DNA
ggcgcgccagtcctggtctatgttccacccgcctacatcgacatgccctcctggccacctgtccagagcaccaactcacctgggaccccatcgatggacgcgttgtcagctctcctctccaataccttatccctcgcctcccctccttccccacccagagaacctcaaggaccctcaaggtccttacccgactcggaccgatg

SEQ ID NO: 5068 - DNA, 203 bp, Homo sapiens
  source 1..203: mol_type = other DNA
ggcgcgccagtcctcctcccaccactcctgtctcccccaaggttccacctgccttctttcaatcaatgcgaaagcacaccccctaccgaaatggatgcctggaaccaaccctcggggatcagctcccctccctcgccttccccgaacctggcctccgtccccaaaacatctacaccacctggggaaaacgactcggaccgatg

SEQ ID NO: 5069 - DNA, 203 bp, Homo sapiens
  source 1..203: mol_type = other DNA
ggcgcgccagtcctcagccatctttagtagttcagtcctccctattaatcttcgaaaaattcgaaaccaaagccttccatccctcctatctactctctcatcagcttatacaatactcctccttccataaccttcaccttctattcgatgaatacaccaacatccctgtctctattttatttaataaacgactcggaccgatg

SEQ ID NO: 5070 - DNA, 203 bp, Homo sapiens
  source 1..203: mol_type = other DNA
ggcgcgccagtcctaacagctctccagaaaaaaatagacctcacccttacccacttcccctagcgctgaaaaacaaggctctgacgattaccccctgcccataaaatttgcctagtcaaaataaaagatgccgagtctataaaagcgcaaggacagttcaggaggtggctcgctccctcaccgaccctcgactcggaccgatg

SEQ ID NO: 5071 - DNA, 203 bp, Homo sapiens
  source 1..203: mol_type = other DNA
ggcgcgccagtcctctggtcacggagactcaccttggggatccatcctctccaagcggcctcggttgagacgccttccgtgggaccgtctcccggcctcggcacctcctgaactgctcctcccaaggtaagtctcctctcaggtcgagctcggctgccccttaggtagtcgctccccgagggtctttacgactcggaccgatg

SEQ ID NO: 5072 - DNA, 203 bp, Homo sapiens
  source 1..203: mol_type = other DNA
ggcgcgccagtccttgtacaagcacttctgtttcccaggagcgaggtataggctgtacccactgccaaaagcctttaaccgttatccgccaaccaactacgtaacagttagtaccatcttgttcttgactggacgttcgatcaggtggattttccctccactagtttggtcgatgaggctaggaattccgactcggaccgatg

SEQ ID NO: 5073 - DNA, 203 bp, Homo sapiens
  source 1..203: mol_type = other DNA
ggcgcgccagtcctcccacgggtgaccgtgtcctagcctgcgtggcggccaacccagcttatgctgggacgcccttttaaggacatggtgtgaagactcgcatgtgcttggttgtgagtcctccggcccctgaatgcggctaaccttaaccctagagccttatgccacgatccagtggttgtaaggtccgactcggaccgatg

SEQ ID NO: 5074 - DNA, 203 bp, Homo sapiens
  source 1..203: mol_type = other DNA
ggcgcgccagtcctagaacaccaactggcttcacatgagggtggcaatgtttcagttaaatacacattcacgcatccaggtgaacgtggtatagatttatcatctgcaaatgaagtgggagggcctgtcaaggatgtcatatacaatatgaatggtactttattaggaaatctgctcattttccctcacgactcggaccgatg

SEQ ID NO: 5075 - DNA, 203 bp, Homo sapiens
  source 1..203: mol_type = other DNA
ggcgcgccagtccttgaaattgttcagtactatacacattggtctggatcacttagattctcttcgatgtatactggtcctgccttgtccagtgctaaactcactctagcatacaccccgcctggtgctcgtggtccacaggacaggagagaagcaatgctaggtactcatgttgtctgggatattggcgactcggaccgatg

SEQ ID NO: 5076 - DNA, 203 bp, Homo sapiens
  source 1..203: mol_type = other DNA
ggcgcgccagtccttgttccacatggtgccccgaaatccaaaagagtgggcgattacacatggcaaagtgcttcaaaccccagtgtattcttcaaggtgggggatacatcaaggtttagtgtgccttatgtaggattggcatcagcatataattgtttttatgatggttactcacatgatgatgcagacgactcggaccgatg

SEQ ID NO: 5077 - DNA, 203 bp, Homo sapiens
  source 1..203: mol_type = other DNA
ggcgcgccagtcctaactcagtatggcataactgttctaaaccatatgggtagtatggcattcagaatagtaaatgaacatgatgaacacaaaactcttgtcaagatcagagtttatcacagggcaaagctcgttgaagcatggattccaagagcacccagagcactaccctacacatcaatagggcgcgactcggaccgatg

SEQ ID NO: 5078 - DNA, 203 bp, Homo sapiens
  source 1..203: mol_type = other DNA
ggcgcgccagtcctcttgcctccaatggctagtttagataacaagggcatgttattcaccagtaattttgttctagcctccacaaattctaacacactaagccccccaacaatcttgaatcctgaagctttagtcaggagatttggttttgacctagatatatgtttgcatactacctacacaaagaacgactcggaccgatg

SEQ ID NO: 5079 - DNA, 203 bp, Homo sapiens
  source 1..203: mol_type = other DNA
ggcgcgccagtccttggaaaactcaatgcaggcatgtcaaccaagacatgcaaagattgccatcaaccatctaatttcaagaaatgttgccccctagtctgtggaaaagctattagcttggtagacagaactaccaacgttaggtatagtgtggatcaactggtcacggctattataagtgatttcaacgactcggaccgatg

SEQ ID NO: 5080 - DNA, 203 bp, Homo sapiens
  source 1..203: mol_type = other DNA
ggcgcgccagtcctacgcccagttgttgtgcaaggaccaaacacagaatttgcactatccctgttaaggaaaaacataatgactataacaacctcaaagggagagttcacagggttaggcatacatgatcgtgtctgtgtgatacccacacacgcacagcctggtgatgatgtactagtgaatggtcacgactcggaccgatg

SEQ ID NO: 5081 - DNA, 203 bp, Homo sapiens
  source 1..203: mol_type = other DNA
ggcgcgccagtcctcactatcttagaagttggccctgtaacaatggcaggacttattaatttgagtagcacccccactaacagaatgattcgttatgattatgcaacaaaaactgggcagtgtggaggtgtgctgtgtgctactggtaagatctttggtattcatgttggcggtaatggaagacaaggcgactcggaccgatg

SEQ ID NO: 5082 - DNA, 203 bp, Homo sapiens
  source 1..203: mol_type = other DNA
ggcgcgccagtccttgacaatgatcccagactggaagttaaattgactgaatcattattctctaagtacaaggggaatgtaaatacggaacccactgaaaatatgcttgtggctgtagaccattatgcagggcaactattatcactagatatccccacttctgaacttacactaaaagaagcattatacgactcggaccgatg

SEQ ID NO: 5083 - DNA, 203 bp, Homo sapiens
  source 1..203: mol_type = other DNA
ggcgcgccagtcctgtctgtcatcccttgcttaatggatgggcacctgatggcatttgattactctaattttgatgcctctttgtcaccagtttggtttgtctgtctagagaaggttttgaccaagttaggctttgcaggctcttcattaattcaatcaatttgtaatacccatcatatctttagggacgactcggaccgatg

SEQ ID NO: 5084 - DNA, 203 bp, Homo sapiens
  source 1..203: mol_type = other DNA
ggcgcgccagtcctgcaaggtatcagccgttctggtctgatcctctcaaccccatcttttgtctttctcagtttcttagcggggaccgtccgttctctccctgtgcaggtgcgactcttgtttgtgctggtcgcggcaggtggcgcccaacgtggggctcgagctcgacagttttcttccgccactaccgactcggaccgatg

SEQ ID NO: 5085 - DNA, 203 bp, Homo sapiens
  source 1..203: mol_type = other DNA
ggcgcgccagtcctattaattaattttctttcatttattgaggaagtttgcccttggtttcctagggaaggcacagtgaatttggagacatggaagaaggtgggagagcaaattcggacgcattataccttacacggccctgaaaaggtccctgtcgagacattatctttttggacattgattcgtgacgactcggaccgatg

SEQ ID NO: 5086 - DNA, 203 bp, Homo sapiens
  source 1..203: mol_type = other DNA
ggcgcgccagtcctctgcctggattttgataatgatgaattgaaacgtttaggaaatttgttaaaacaggaagaagatcctctccatacccctgattcggtacctagttatgatcctcctcctcctcctccgccatctctgaaaatgcacccttctgataatgatgattcactttcatctacagatgacgactcggaccgatg

SEQ ID NO: 5087 - DNA, 203 bp, Homo sapiens
  source 1..203: mol_type = other DNA
ggcgcgccagtccttaacaaccagcgttactatgaatcactgccgtttaaacaactaaaagagttaaagattgcttgttcgcaatatggtcctaccgctccatttactattgctatgatagaaagtttgggtactcaagctttgcccccgaatgactggaaacagaccgctagggcatgtctctcaggcgactcggaccgatg

SEQ ID NO: 5088 - DNA, 203 bp, Homo sapiens
  source 1..203: mol_type = other DNA
ggcgcgccagtccttgcggctcgacaggcatggaaaaaacttcctagctccagtactaagacagaggacctttcaaaggtccggcagggacctgatgagccttaccaggacttcgtggcacgacttttagatactataggtaagataatgtcagatgaaaaggctgggatggtgctggcaaaacaattcgactcggaccgatg

SEQ ID NO: 5089 - DNA, 203 bp, Homo sapiens
  source 1..203: mol_type = other DNA
ggcgcgccagtcctagcttttgaaaacgctaactctgcttgtcaagctgctttgagaccttatcgaaaaaagggagatctatctgattttattcgcatttgtgctgatattggaccctcctacatgcaaggcattgctatggcagcagcattacaaggaaaaagcataaaagaagtacttttccagcacgactcggaccgatg

SEQ ID NO: 5090 - DNA, 203 bp, Homo sapiens
  source 1..203: mol_type = other DNA
ggcgcgccagtcctgcaagcccggaacaagaaaggacttcaaaagtcaggtaattcgggttgctttgtttgtggtcagcctggccatcgggctgcagtatgccctcaaaaacatcaaacctctgttaatacccctaatttgtgcccacgctgtaaaaaaggaaagcattgggcacgagactgccgttccgactcggaccgatg

SEQ ID NO: 5091 - DNA, 203 bp, Homo sapiens
  source 1..203: mol_type = other DNA
ggcgcgccagtccttacgtccttatttaaaattacccacttataccttgcagccattatttgacatccttaaaggtgactctgatcctgcgtcaccccgaacgctttctttagaaggacgaactgctttacaatcaatagaagaagctattagacaacaacagattacttattgtgattaccaacgatcgactcggaccgatg

SEQ ID NO: 5092 - DNA, 203 bp, Homo sapiens
  source 1..203: mol_type = other DNA
ggcgcgccagtcctttaaatcttgctctacttgtcctcaattctttgttctccctcaatatggtgtcaaccctcgaggtttacgccctaatcacctctggcaaacagatgttactcacattcctcaatttgggcgtcttaaatatgttcatgtttctattgacactttttccaattttctcatggcttcgactcggaccgatg

SEQ ID NO: 5093 - DNA, 203 bp, Homo sapiens
  source 1..203: mol_type = other DNA
ggcgcgccagtcctcagaggaactccctgacgcatcagatgcaacgcatgaccctgagtgagcccacgagtgagctgcccacccagaggcaaattgaagcgctaatgccgtacgcctggaatgaggcacatgtacaaccccccgtgacacctactaatatactgattatgttgttgttactattacagcgactcggaccgatg

SEQ ID NO: 5094 - DNA, 203 bp, Homo sapiens
  source 1..203: mol_type = other DNA
ggcgcgccagtcctggccttactactcaataccccatgtgcttttcttatcaatcgcagcatccccattgtatacaggtgtcagccgacatatcatatcctcgagtgactatttcaggcattgatgaaaaaacagggaaaaaatcgtatgggaacggaactggacccctcgatattccgttttgtgaccgactcggaccgatg

SEQ ID NO: 5095 - DNA, 203 bp, Homo sapiens
  source 1..203: mol_type = other DNA
ggcgcgccagtcctaagcatttaagcatcggcataggcatagacactccgtggactttatgtcgagcccgggttgcatcggtgtataatatcaataatgccaatgccacctttttatgggactgggcacctggaggaacacctgattttcctgagtatcgaggacagcatccacctattttttcggtgcgactcggaccgatg

SEQ ID NO: 5096 - DNA, 203 bp, Homo sapiens
  source 1..203: mol_type = other DNA
ggcgcgccagtcctcaccgacatctaatggagcttttaaagaataaagagaggggagctgcgggggacgacccgtgaagggttaagtcctgggagctctttggcaaaagccaaagcctaggacaaatacctaagctccctgtcccgccaccctctaggattcttgaaagctcttaaggttcggatgttcgactcggaccgatg

SEQ ID NO: 5097 - DNA, 203 bp, Homo sapiens
  source 1..203: mol_type = other DNA
ggcgcgccagtcctgatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgcgactcggaccgatg

SEQ ID NO: 5098 - DNA, 203 bp, Homo sapiens
  source 1..203: mol_type = other DNA
ggcgcgccagtcctgtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggacgactcggaccgatg

SEQ ID NO: 5099 - DNA, 203 bp, Homo sapiens
  source 1..203: mol_type = other DNA
ggcgcgccagtccttggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggacgactcggaccgatg

SEQ ID NO: 5100 - DNA, 203 bp, Homo sapiens
  source 1..203: mol_type = other DNA
ggcgcgccagtcctaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggcgactcggaccgatg

SEQ ID NO: 5101 - DNA, 203 bp, Homo sapiens
  source 1..203: mol_type = other DNA
ggcgcgccagtccttcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggacgactcggaccgatg

SEQ ID NO: 5102 - DNA, 203 bp, Homo sapiens
  source 1..203: mol_type = other DNA
ggcgcgccagtcctaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctcgactcggaccgatg

SEQ ID NO: 5103 - DNA, 203 bp, Homo sapiens
  source 1..203: mol_type = other DNA
ggcgcgccagtcctgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgcgactcggaccgatg

SEQ ID NO: 5104 - DNA, 203 bp, Homo sapiens
  source 1..203: mol_type = other DNA
ggcgcgccagtccttcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacgactcggaccgatg

SEQ ID NO: 5105 - DNA, 203 bp, Homo sapiens
  source 1..203: mol_type = other DNA
ggcgcgccagtcctcagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcacgactcggaccgatg

SEQ ID NO: 5106 - DNA, 203 bp, Homo sapiens
  source 1..203: mol_type = other DNA
ggcgcgccagtcctagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgccgactcggaccgatg

SEQ ID NO: 5107 - DNA, 203 bp, Homo sapiens
  source 1..203: mol_type = other DNA
ggcgcgccagtcctaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcgactcggaccgatg

SEQ ID NO: 5108 - DNA, 203 bp, Homo sapiens
  source 1..203: mol_type = other DNA
ggcgcgccagtcctcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggcgactcggaccgatg

SEQ ID NO: 5109 - DNA, 203 bp, Homo sapiens
  source 1..203: mol_type = other DNA
ggcgcgccagtcctcagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagccgactcggaccgatg

SEQ ID NO: 5110 - DNA, 203 bp, Homo sapiens
  source 1..203: mol_type = other DNA
ggcgcgccagtcctctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacacgactcggaccgatg

SEQ ID NO: 5111 - DNA, 203 bp, Homo sapiens
  source 1..203: mol_type = other DNA
ggcgcgccagtcctactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgcgactcggaccgatg

SEQ ID NO: 5112 - DNA, 203 bp, Homo sapiens
  source 1..203: mol_type = other DNA
ggcgcgccagtcctggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaacgactcggaccgatg

SEQ ID NO: 5113 - DNA, 203 bp, Homo sapiens
  source 1..203: mol_type = other DNA
ggcgcgccagtcctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaacgactcggaccgatg

SEQ ID NO: 5114 - DNA, 203 bp, Homo sapiens
  source 1..203: mol_type = other DNA
ggcgcgccagtcctacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacacgactcggaccgatg

SEQ ID NO: 5115 - DNA, 203 bp, Homo sapiens
  source 1..203: mol_type = other DNA
ggcgcgccagtccttatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtcgactcggaccgatg

SEQ ID NO: 5116 - DNA, 203 bp, Homo sapiens
  source 1..203: mol_type = other DNA
ggcgcgccagtcctggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaacgactcggaccgatg

SEQ ID NO: 5117 - DNA, 203 bp, Homo sapiens
  source 1..203: mol_type = other DNA
ggcgcgccagtccttcaagactgagatgaggtcagtgattaaatcacaaacccatacttgccataggaggagacacacacctgtattcttcactggtagttcagttgagctgttaatctctcgtgaccttgttgctataatcagtaaggagtctcaacatgtatattacctgacgtttgaactggtttcgactcggaccgatg

SEQ ID NO: 5118 - DNA, 203 bp, Homo sapiens
  source 1..203: mol_type = other DNA
ggcgcgccagtccttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcgactcggaccgatg

SEQ ID NO: 5119 - DNA, 203 bp, Homo sapiens
  source 1..203: mol_type = other DNA
ggcgcgccagtcctggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacgactcggaccgatg

SEQ ID NO: 5120 - DNA, 203 bp, Homo sapiens
  source 1..203: mol_type = other DNA
ggcgcgccagtcctttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcacgactcggaccgatg

SEQ ID NO: 5121 - DNA, 203 bp, Homo sapiens
  source 1..203: mol_type = other DNA
ggcgcgccagtcctccattccctacttatacctggctgcttatgagagcggggtaaggattgcttcgttagtgcaaggggacaatcagaccatagccgtaacaaaaagggtacccagcacatggccttacaaccttaagaaacgggaagctgctagagtaactagagattactttgtaattcttaggccgactcggaccgatg

SEQ ID NO: 5122 - DNA, 203 bp, Homo sapiens
  source 1..203: mol_type = other DNA
ggcgcgccagtcctcatgcagtaatattgctacaacaatggctaaaagcatcgagagaggttatgaccgttatcttgcatattccctgaacgtcctaaaagtgatacagcaaattttgatctctcttggcttcacaatcaattcaaccatgacccgagatgtagtcatacccctcctcacaaacaacgcgactcggaccgatg

SEQ ID NO: 5123 - DNA, 203 bp, Homo sapiens
  source 1..203: mol_type = other DNA
ggcgcgccagtcctatctcttaataaggatggcactgttgcccgctcctattggggggatgaattatctgaatatgagcaggctgtttgtcagaaacatcggtgatccagtaacatcatcaattgctgatctcaagagaatgattctcgcatcactaatgcctgaagagaccctccatcaagtaatgacgactcggaccgatg

SEQ ID NO: 5124 - DNA, 203 bp, Homo sapiens
  source 1..203: mol_type = other DNA
ggcgcgccagtcctcacaacaaccgggggactcttcattcctagactgggctagcgacccttactcagcaaatcttgtatgcgtccagagcatcactagactcctcaagaacataactgcaaggtttgtcctaatccatagtccaaacccaatgttaaaagggttattccatgatgacagtaaagaagcgactcggaccgatg

SEQ ID NO: 5125 - DNA, 203 bp, Homo sapiens
  source 1..203: mol_type = other DNA
ggcgcgccagtcctaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagcgactcggaccgatg

SEQ ID NO: 5126 - DNA, 203 bp, Homo sapiens
  source 1..203: mol_type = other DNA
ggcgcgccagtccttgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggcccgactcggaccgatg

SEQ ID NO: 5127 - DNA, 203 bp, Homo sapiens
  source 1..203: mol_type = other DNA
ggcgcgccagtcctctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggcgactcggaccgatg

SEQ ID NO: 5128 - DNA, 203 bp, Homo sapiens
  source 1..203: mol_type = other DNA
ggcgcgccagtcctagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactcgactcggaccgatg

SEQ ID NO: 5129 - DNA, 203 bp, Homo sapiens
  source 1..203: mol_type = other DNA
ggcgcgccagtcctttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgacgactcggaccgatg

SEQ ID NO: 5130 - DNA, 203 bp, Homo sapiens
  source 1..203: mol_type = other DNA
ggcgcgccagtccttcaaacagataagattgagagttgatccaggattcatttttgacgccctcgctgaggtaaatgtcagtcagccaaaggtcggcagcaacaacatctcaaatatgagcatcaaggatttcagacctccacacgatgatgttgcaaaattgctcaaagatatcaacacaagcaagccgactcggaccgatg

SEQ ID NO: 5131 - DNA, 203 bp, Homo sapiens
  source 1..203: mol_type = other DNA
ggcgcgccagtcctatcctgaaaagatcaagcagcagataattgaatcatctgtgcggacttcacctggacttataggtcacatcctatccattaagcaactaagctgcatacaagcaattgtgggaggcgcagttagtagaggtgatatcaaccctattctgaaaaaacttacacctatagagcaggcgactcggaccgatg

SEQ ID NO: 5132 - DNA, 203 bp, Homo sapiens
  source 1..203: mol_type = other DNA
ggcgcgccagtcctccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatcgactcggaccgatg

SEQ ID NO: 5133 - DNA, 203 bp, Homo sapiens
  source 1..203: mol_type = other DNA
ggcgcgccagtcctagtcggttgatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgcgactcggaccgatg

SEQ ID NO: 5134 - DNA, 203 bp, Homo sapiens
  source 1..203: mol_type = other DNA
ggcgcgccagtccttgacctgggaagccttggcttttgacccccctccctgggtcaagccctttgtacaccctaagcctccgcctcctcttcctccatccgccccgtctctcccccttgaacctcctctttcgaccccgcctcgatcctccctttatccagccctcactccttctctaggcgccaaaccgactcggaccgatg

SEQ ID NO: 5135 - DNA, 203 bp, Homo sapiens
  source 1..203: mol_type = other DNA
ggcgcgccagtcctggagacgggagcccccagtggccgactccactacctcgcaggcattccccctccgcacaggaggaaacggacagcttcaatactggccgttctcctcttctgacctttacatcacccccgtcaacagcctggagaaacattcctggtatcatggccctgtatctcggaatgctgcgactcggaccgatg

SEQ ID NO: 5136 - DNA, 203 bp, Homo sapiens
  source 1..203: mol_type = other DNA
ggcgcgccagtccttggctgagttagttcaccatcactccacggtggctgatggcctcatcaccacactccactacccagctcccaagcgcaacaagcccactatctacggtgtgtcccccaactacgacaagtgggaaatggagcgcaccgacatcaccatgaagcacaagttgggtggaggccagtcgactcggaccgatg

SEQ ID NO: 5137 - DNA, 203 bp, Homo sapiens
  source 1..203: mol_type = other DNA
ggcgcgccagtcctacggggaggtgtacgagggcgtttggaagaagtacagcctcactgtggccgtgaagaccttgaaggaggacaccatggaggtggaggagttcctgaaggaagcggcggtgatgaaggagatcaaacaccctaacctggtgcagctgctaggggtgtgtacccgggaaccaccatcgactcggaccgatg

SEQ ID NO: 5138 - DNA, 203 bp, Homo sapiens
  source 1..203: mol_type = other DNA
ggcgcgccagtccttctacataatcactgagttcatgacctatgggaacctgctggactacctgagggagtgtaaccggcaggaggtgagcgccgtggtactgctctacatggccacacagatctcatcagccatggagtacttggagaagaagaacttcatccacagagaccttgctgcccggaactcgactcggaccgatg

SEQ ID NO: 5139 - DNA, 203 bp, Homo sapiens
  source 1..203: mol_type = other DNA
ggcgcgccagtcctcctttgctgaaatccaccaagcctttgaaaccatgttccaggaatccagtatctcagatgaggtggagaaggagctggggaaacgaggcacgagaggaggtgctgggagtatgctgcaggccccagagctgcccaccaagaccagaacctgcaggagagcagctgagcagaaagcgactcggaccgatg

SEQ ID NO: 5140 - DNA, 203 bp, Homo sapiens
  source 1..203: mol_type = other DNA
ggcgcgccagtcctccagccctcccagcttgactcccaaactcctccgcaggcaggtcactgcctctccttcctctggcctctctcacaagaaagaggccaccaagggcagtgcctcaggcatggggactccggccactgcagagccagcaccccccagcaacaaagtgggcctcagcaaggcctcctcgactcggaccgatg

SEQ ID NO: 5141 - DNA, 203 bp, Homo sapiens
  source 1..203: mol_type = other DNA
ggcgcgccagtcctctgaggagatgcgcgtaaggaggcacaagcacagctcggagtccccagggagagacaaggggcgactggctaagctcaagcctgccccgccgcctcctcctgcctgcacaggaaaagcaggcaagcccgcacagagccccagccaagaggccggggaggcaggggggcccacaacgactcggaccgatg

SEQ ID NO: 5142 - DNA, 203 bp, Homo sapiens
  source 1..203: mol_type = other DNA
ggcgcgccagtcctagacaaaatgcacgagtctggctatggatgctgtgaacactgaccccaccaaggccggcccacctggagaaggactgagaaagcctgtgcccccatctgtgccaaagccccagtcgacggctaagcctccagggactcccaccagcccggtctccaccccctccacagcaccagcgactcggaccgatg

SEQ ID NO: 5143 - DNA, 203 bp, Homo sapiens
  source 1..203: mol_type = other DNA
ggcgcgccagtcctctccttcacccctggctggggaccagcagccatcttctgccgccttcatccccctcatatcaacccgtgtgtctcttaggaagacccgccagccgccagagcgcattgccagtggcaccatcaccaagggtgtggttctggacagtactgaggccctgtgccttgccatctccccgactcggaccgatg

SEQ ID NO: 5144 - DNA, 203 bp, Homo sapiens
  source 1..203: mol_type = other DNA
ggcgcgccagtcctggaactcagagcagatggccagccacagtgctgtactggaggctggcaagaacctgtacactttctgtgtgagctatgtggactctatccagcagatgaggaacaagtttgccttccgtgaggctatcaacaagctggagagcaacctccgagagctgcagatctgccctgccacgactcggaccgatg

SEQ ID NO: 5145 - DNA, 203 bp, Homo sapiens
  source 1..203: mol_type = other DNA
ggcgcgccagtcctgtctttccccaggagctttaaagagagacaagcagagcctgagggagacctggatggagcctggtggagttggctcttcctcctgtgttgtgcaccagctgccctgcacctttcctgcccagcccaggcgtcagccacctctcctcactgcctgtggatgggtctcctgctctgcgactcggaccgatg

SEQ ID NO: 5146 - DNA, 203 bp, Homo sapiens
  source 1..203: mol_type = other DNA
ggcgcgccagtcctaagactacatctggcctgcctggccaccaggcttctcactccccggtgcctcagacccagctcccaggtcagcctggagtgctcttccctgtccttgcagaacgacctcctctgatggaccttcttgtcaccaaggcatgggagcccctgtgcttactgtacctgcacctttgacgactcggaccgatg

SEQ ID NO: 5147 - DNA, 203 bp, Homo sapiens
  source 1..203: mol_type = other DNA
ggcgcgccagtccttgcttacaaactgtccccgagagcctgtgctcactgtgttttcattggaaggaagctgtcgctttaagggtcatgaggtgctaaagccaggggcccagatgggtgggcactggaaacaggagctgggcagtgtggtctgtcacctgctctcagtatcttcagcagtgtgcccggcgactcggaccgatg

SEQ ID NO: 5148 - DNA, 203 bp, Homo sapiens
  source 1..203: mol_type = other DNA
ggcgcgccagtcctcagatcttggacagcaagcttgagttttatgggtggcagtcactggctggctaggcacatagccaggccaaacctaggcctccaagggctccccaaaatctgaatttctgagtagtcttcatcccctctcctgctctaaggtcaggtccatcctctctggtccttaccttgatgcgactcggaccgatg

SEQ ID NO: 5149 - DNA, 203 bp, Homo sapiens
  source 1..203: mol_type = other DNA
ggcgcgccagtcctctctagttttgactcaacaatatcaccagctgaagcctatagagtacgagccatagataaaataaaagattttatttagtctccagaaaaagggggaatgaaagaccccacctgtaggtttggcaagctagcttaagtaacgccattttgcaaggcatggaaaaatacataactcgactcggaccgatg

SEQ ID NO: 5150 - DNA, 203 bp, Homo sapiens
  source 1..203: mol_type = other DNA
ggcgcgccagtcctgagaatagagaagttcagatcaaggtcaggaacagagaaacagctgaatatgggccaaacaggatatgctgtggtaagcagttcctgccccggctcagggccaagaacagttggaacagctgaatatgggccaaacaggatatctgtggtaagcagttcctgccccggctcaggcgactcggaccgatg

SEQ ID NO: 5151 - DNA, 203 bp, Homo sapiens
  source 1..203: mol_type = other DNA
ggcgcgccagtcctgccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaacgactcggaccgatg

SEQ ID NO: 5152 - DNA, 203 bp, Homo sapiens
  source 1..203: mol_type = other DNA
ggcgcgccagtcctagtaaggagcaccctgcagtcttgaaaactgtatatctttgcacgattctgggtgaaagaccccacctgtaggtttggcaagctagcttaagtaacgccattttgcaaggcatggaaaaatacataactgagaatagagaagttcagatcaaggtcaggaacagagaaacagctcgactcggaccgatg

SEQ ID NO: 5153 - DNA, 203 bp, Homo sapiens
  source 1..203: mol_type = other DNA
ggcgcgccagtcctgaatatgggccaaacaggatatgctgtggtaagcagttcctgccccggctcagggccaagaacagttggaacagctgaatatgggccaaacaggatatctgtggtaagcagttcctgccccggctcagggccaagaacagatggtccccagatgcggtccagccctcagcagttcgactcggaccgatg

SEQ ID NO: 5154 - DNA, 203 bp, Homo sapiens
  source 1..203: mol_type = other DNA
ggcgcgccagtccttgaaagaccccaccaagttgcttagcctgatagccgcagtaacgccattttgcaaggcatggaaaaataccaaaccaagaatagggaagttcagatcaagggcgggtacacgaaaacagctaacgttgggccaaacaagatatctgcggtaagcagtttcggccccggcccgggcgactcggaccgatg

SEQ ID NO: 5155 - DNA, 203 bp, Homo sapiens
  source 1..203: mol_type = other DNA
ggcgcgccagtcctctcgtccgggatttggagacccccgcccagggaccaccgacccaccgtcgggaggtaagctggccagcgatcgttttgtctccgtctctgtctttgtgtgtgtgtgtgtgtaccggtatttactttttgcgcctgcgtctggttctgtactagttagctaactagatctgtatccgactcggaccgatg

SEQ ID NO: 5156 - DNA, 203 bp, Homo sapiens
  source 1..203: mol_type = other DNA
ggcgcgccagtcctgggaggtccaagccctcgccgcctccatctgaatttttgctttcggtttttcgccgaaaccgcgccgcgcgtcttgtctgtctcagtattgttttgttatttgtctgttcgttattgttttggaccgcttctaaaaacatgggacagaccgtaaccacccctctgagtctgacccgactcggaccgatg

SEQ ID NO: 5157 - DNA, 203 bp, Homo sapiens
  source 1..203: mol_type = other DNA
ggcgcgccagtcctctagaacactgggaggatgtccagcgcaccgcgtccaatcagtccgtagatgtcaagaagagacgctgggtcaccttctgctctgccgagtggccaactttcggtgtagggtggccacaagatggtacttttaacttggacattattctacaggttaaatctaaggtgttctctcgactcggaccgatg

SEQ ID NO: 5158 - DNA, 203 bp, Homo sapiens
  source 1..203: mol_type = other DNA
ggcgcgccagtcctcctggtccccacggacacccggatcaggtcccatatattgtcacctgggaggctattgcctatgaaccccctccgtgggtaaaaccttttgtctctcccaaactctccccctctccaaccgctcccatcctcccatccggtccttcgactcaacctccgccccgatctgcccttcgactcggaccgatg

SEQ ID NO: 5159 - DNA, 203 bp, Homo sapiens
  source 1..203: mol_type = other DNA
ggcgcgccagtccttaccctgctcttaccccctctataaaacccggaccttctccgataatggcggacctctcactgaccttctctcagaagaccctccgccgtacggaggacagggaccgtcctcctctgacggagatggcgacagagaagaggccacctccacttctgagattcctgccccctctccgactcggaccgatg

SEQ ID NO: 5160 - DNA, 203 bp, Homo sapiens
  source 1..203: mol_type = other DNA
ggcgcgccagtcctaaactgactacattgattgaatctgtcctcaccacccaccagcccacctgggatgattgccagcaattattagggactctgcttaccggggaggagaagcagcgggtgctcctggaagcccgaaaagctgtccggggcaacgatgggcgccccacccaactgcccaacgaggttcgactcggaccgatg

SEQ ID NO: 5161 - DNA, 203 bp, Homo sapiens
  source 1..203: mol_type = other DNA
ggcgcgccagtcctagggaagctgaagagatctttaataaatgagaaaccccggaagaaagagagagaaggagagggaccgcagaagacatagagaaatgagtaagttgctggctgctgtcgttagcgggcagagacaggatagacagggaggagagcgaaggaggccccaactcgaccacgaccagtcgactcggaccgatg

SEQ ID NO: 5162 - DNA, 203 bp, Homo sapiens
  source 1..203: mol_type = other DNA
ggcgcgccagtcctaccttcctagtggatactggggcccaacactccgtgctgacccaaaatcctggacccctaagtgacaagtctgcctgggtccaaggggctactggaagaaagcggtatcgctggaccacggatcgccaggtgcacctagccaccgggtttcaaaaacagtcccaccctgtttgacgactcggaccgatg

SEQ ID NO: 5163 - DNA, 203 bp, Homo sapiens
  source 1..203: mol_type = other DNA
ggcgcgccagtcctagcccaaaattgccagaaacaggtcaagtatctggggtatcttctaaaagagggtcagggatggctgactgaggccagaaaagagactgtgatggggcagcctactccaaagacccctcgacaactaagggagttcctagggacggcaggcttctgtcgcctctggatccccggcgactcggaccgatg

SEQ ID NO: 5164 - DNA, 203 bp, Homo sapiens
  source 1..203: mol_type = other DNA
ggcgcgccagtcctgtttgcagaaatggcagcccccttgtaccctctcaccaaaacggggactctgtttaaatggggcccagaccagcaaaaggcctaccaagagatcaagcaggctctcttaactgcccctgccctgggattaccagacttgactaagcccttcgaactttttgttgaccaaagacacgactcggaccgatg

SEQ ID NO: 5165 - DNA, 203 bp, Homo sapiens
  source 1..203: mol_type = other DNA
ggcgcgccagtcctggaatactccgggcccccatggacttactccgtatgaaattctgtatggggcacccccgccccttgtcaattttcatgatcctgaaatgtcaaagttaactaatagtccctctctccaagctcacttacaggccctccaagcagtacaacgagaggtctggaagccactggccgcgactcggaccgatg

SEQ ID NO: 5166 - DNA, 203 bp, Homo sapiens
  source 1..203: mol_type = other DNA
ggcgcgccagtcctctgcttatcaggaccagctggatcagccagtgataccacaccccctccgtgtcggtgacgccgtgtgggtacgccggcaccagactaagaacttagaaccccgctggaaaggaccctacaccgtcctgctgaccacccccaccgctctcaaagtagacggcatctctgcggggacgactcggaccgatg

SEQ ID NO: 5167 - DNA, 203 bp, Homo sapiens
  source 1..203: mol_type = other DNA
ggcgcgccagtcctcgacccggtgacccggttctctttgacccgccaggtcctcaatatagggccccgcatccccattgggcctaatcccgtgatcattggccaactacccccctcccgacccgtgcaggtcaggctccccaggcctcctcagcctcctcctacaggcgcagcctctatggtccctggcgactcggaccgatg

SEQ ID NO: 5168 - DNA, 203 bp, Homo sapiens
  source 1..203: mol_type = other DNA
ggcgcgccagtcctgactgccccaccttctcaacaaccggggacgggagacaggttactaaatctagtacagggagcttaccaggcactcaaccttaccaaccctgataaaacccaagagtgctggttatgcctagtgtctggacccccctattacgagggggttgcggtcctaggcactaattctaacgactcggaccgatg

SEQ ID NO: 5169 - DNA, 203 bp, Homo sapiens
  source 1..203: mol_type = other DNA
ggcgcgccagtccttcatacctctgccctaaaagaaaaatgttgtttctatgctgaccatacaggcctagtaagagatagtatggccaaattaagaaagagactcactcagagacaaaaactatttgagtcgagccaaggatggttcgaaggatcgtttaacagatccccctggtttaccacgttgatcgactcggaccgatg

SEQ ID NO: 5170 - DNA, 203 bp, Homo sapiens
  source 1..203: mol_type = other DNA
ggcgcgccagtcctacaagatatctgcggtaagcagtttcggccccggcccggggccaagaacagatggtccccagatatggcccaaccctcagcagtttcttaagacccatcagatgtttccaggctcccccaaggacctgaaatgaccctgtgccttatttgaattaaccaatcagcccgcttctccgactcggaccgatg

SEQ ID NO: 5171 - DNA, 203 bp, Homo sapiens
  source 1..203: mol_type = other DNA
ggcgcgccagtccttatgcgcctgcgtcggtactagttagctaactagctctgtatctggcggacccgtggtggaactgacgagttcggaacacccggccgcaaccctgggagacgtcccagggacttcgggggccgtttttgtggcccgacctgagtccaaaaatcccgatcgttttggactctttgcgactcggaccgatg

SEQ ID NO: 5172 - DNA, 203 bp, Homo sapiens
  source 1..203: mol_type = other DNA
ggcgcgccagtcctgtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtcgactcggaccgatg

SEQ ID NO: 5173 - DNA, 203 bp, Homo sapiens
  source 1..203: mol_type = other DNA
ggcgcgccagtcctctgagaatatgggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctcgactcggaccgatg

SEQ ID NO: 5174 - DNA, 203 bp, Homo sapiens
  source 1..203: mol_type = other DNA
ggcgcgccagtcctgaagccccaccaatttggccaaggtaaaaggaataacacaagggcccaatgagtctccctcggccttcctagagagacttaaggaagcctatcgcaggtacactccttatgaccctgaggacccagggcaagaaactaatgtgtctatgtctttcatttggcagtctgccccagcgactcggaccgatg

SEQ ID NO: 5175 - DNA, 203 bp, Homo sapiens
  source 1..203: mol_type = other DNA
ggcgcgccagtcctaaccacgaggacctcggggaccaagaccccagacctccctcctgaccctagatgactagggaggtcagggtcaggagcccccccctgaacccaggataaccctcaaagtcggggggcaacccgtcaccttcctggtagatactggggcccaacactccgtgctgacccaaaatccgactcggaccgatg

SEQ ID NO: 5176 - DNA, 203 bp, Homo sapiens
  source 1..203: mol_type = other DNA
ggcgcgccagtcctaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccgactcggaccgatg

SEQ ID NO: 5177 - DNA, 203 bp, Homo sapiens
  source 1..203: mol_type = other DNA
ggcgcgccagtcctacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcacgactcggaccgatg

SEQ ID NO: 5178 - DNA, 203 bp, Homo sapiens
  source 1..203: mol_type = other DNA
ggcgcgccagtcctagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcagaaatggcagcccccttgtcgactcggaccgatg

SEQ ID NO: 5179 - DNA, 203 bp, Homo sapiens
  source 1..203: mol_type = other DNA
ggcgcgccagtccttggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatcgactcggaccgatg

SEQ ID NO: 5180 - DNA, 203 bp, Homo sapiens
  source 1..203: mol_type = other DNA
ggcgcgccagtcctaaaattcatcaccctacacctcagaacattttcattacacagtgactgatataaaggacctaaccaagttgggggccatttatgataaaacaaagaagtattgggtctaccaaggaaaacctgtgatgcctgaccagtttacttttgaattattagactttcttcatcagctgacgactcggaccgatg

SEQ ID NO: 5181 - DNA, 203 bp, Homo sapiens
  source 1..203: mol_type = other DNA
ggcgcgccagtcctcgcttgcaactggctctagagactgggtgctcctactccccttagccctgtaccgagcccgcaacacgccgggcccccatggcctcaccccatatgagatcttatatggggcacccccgccccttgtaaacttccctgaccctgacatgacaagagttactaacagcccctctccgactcggaccgatg

SEQ ID NO: 5182 - DNA, 203 bp, Homo sapiens
  source 1..203: mol_type = other DNA
ggcgcgccagtccttccaagctcacttacaggctctctacttagtccagcacgaagtctggagacctctggcggcagcctaccaagaacaactggaccgaccggtggtacctcacccttaccgagtcggcgacacagtgtgggtccgccgacaccagactaagaacctagaacctcgctggaaaggaccgactcggaccgatg

SEQ ID NO: 5183 - DNA, 203 bp, Homo sapiens
  source 1..203: mol_type = other DNA
ggcgcgccagtccttacatttgggatccgactcagataccaaaatctaggaccccgcgtcccaatagggccaaaccccgttctggcagaccaacagccactctccaagcccaaacctgttaagtcgccttcagtcaccaaaccacccagtgggactcctctctcccctacccaacttccaccggcgggcgactcggaccgatg

SEQ ID NO: 5184 - DNA, 203 bp, Homo sapiens
  source 1..203: mol_type = other DNA
ggcgcgccagtcctaacggaaaataggctgctaaacttagtagacggagcctaccaagccctcaacctcaccagtcctgacaaaacccaagagtgctggttgtgtctagtagcgggacccccctactacgaaggggttgccgtcctgggtacctactccaaccatacctctgctccagccaactgctccgactcggaccgatg

SEQ ID NO: 5185 - DNA, 203 bp, Homo sapiens
  source 1..203: mol_type = other DNA
ggcgcgccagtcctactgtttaacagatccccttggtttaccaccttgatatctaccattatgggacccctcattgtactcctaatgattttgctcttcggaccctgcattcttaatcgattagtccaatttgttaaagacaggatatcagtggtccaggctctagttttgactcaacaatatcaccacgactcggaccgatg

SEQ ID NO: 5186 - DNA, 203 bp, Homo sapiens
  source 1..203: mol_type = other DNA
ggcgcgccagtcctgtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccgactcggaccgatg

SEQ ID NO: 5187 - DNA, 203 bp, Homo sapiens
  source 1..203: mol_type = other DNA
ggcgcgccagtcctcagtcctccgattgactgagtcgcccgggtacccgtgtatccaataaaccctcttgcagttgcagcgccagtcctccgattgactgagtcgcccgggtacccgtgtatccaataaaccctcttgcagttgcatccgacttgtggtctcgctgttccttgggagggtctcctctgcgactcggaccgatg

SEQ ID NO: 5188 - DNA, 203 bp, Homo sapiens
  source 1..203: mol_type = other DNA
ggcgcgccagtcctccttgggagggtctcctctgagtgattgactacccgtcagcgggggtctttcatttgggggctcgtccgggatcgggagacccctgcccagggaccaccgacccaccaccgggaggtaagctggccagcaacttatctgtgtctgtccgattgtctagtgtctatgactgatttcgactcggaccgatg

SEQ ID NO: 5189 - DNA, 203 bp, Homo sapiens
  source 1..203: mol_type = other DNA
ggcgcgccagtcctattcccaataaagcctcttgctgtttgcatccgaatcgtggtctcgctgttccttgggagggtctcctctgagtgattgactacccacgacgggggtctttcatttgggggctcgtccgggatttggagacccctgcccagggaccaccgacccaccaccgggaggtaagctggcgactcggaccgatg

SEQ ID NO: 5190 - DNA, 203 bp, Homo sapiens
  source 1..203: mol_type = other DNA
ggcgcgccagtcctccagcaacttatctgtgtctgtccgattgtctagtgtctatgtttgatgttatgcgcctgcgtctgtactagttagctaactagctctgtatctggcggacccgtggtggaactgacgagttctgaacacccggccgcaaccctgggagacgtcccagggactttgggggccgtcgactcggaccgatg

SEQ ID NO: 5191 - DNA, 203 bp, Homo sapiens
  source 1..203: mol_type = other DNA
ggcgcgccagtcctttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcatcgttctgtgttgtctcgactcggaccgatg

SEQ ID NO: 5192 - DNA, 203 bp, Homo sapiens
  source 1..203: mol_type = other DNA
ggcgcgccagtcctcgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcccgactcggaccgatg

SEQ ID NO: 5193 - DNA, 203 bp, Homo sapiens
  source 1..203: mol_type = other DNA
ggcgcgccagtccttccgcctcctcttcttccatccgcgccgtctctcccccttgaacctcctctttcgaccccgcctcaatcctccctttatccagccctcactccttctttgggcgccaaacctaaacctcaagttctttctgacagtggggggccgctcatcgacctacttacagaagacccccccgactcggaccgatg

SEQ ID NO: 5194 - DNA, 203 bp, Homo sapiens
  source 1..203: mol_type = other DNA
ggcgcgccagtcctgccttatagggacccaagaccacccccttccgacagggacggagatagtggagaagcgacccctgcgggagaggcaccggacccctccccaatggcatctcgcctgcgtgggagacgggagccccctgtggccgactccactacctcgcaggcattccccctccgcacaggaggcgactcggaccgatg

SEQ ID NO: 5195 - DNA, 203 bp, Homo sapiens
  source 1..203: mol_type = other DNA
ggcgcgccagtcctcggggaagaaaaacaacgggtgctcttagaggctagaaaggcggtgcggggcgatgatgggcgccccactcaactgcccaatgaagtcgatgccgcttttcccctcgagcgcccagactgggagtacaccacccaggcaggtaggaaccacctagtccactatcgccagttgctcgactcggaccgatg

SEQ ID NO: 5196 - DNA, 203 bp, Homo sapiens
  source 1..203: mol_type = other DNA
ggcgcgccagtcctacgccgtaggacagaggatgagcagaaagagaaagaaagagatcgtaggagacatagagagatgagcaggctattggccactgtcgttagtggacagagacaggatagacaggaaggagaacgaaggaggtcccaactcgactgcgaccagtgtacctactgcgaagaacaaggcgactcggaccgatg

SEQ ID NO: 5197 - DNA, 203 bp, Homo sapiens
  source 1..203: mol_type = other DNA
ggcgcgccagtcctgcactgggctaaagattgtcccaagagaccacgaggacctcggggaccaagaccccagacctccctcctgaccctagatgactagggaggtcagggtcaggagcccccccctgaacccaggataaccctcaaagtcggggggcaacccgtcaccttcctggtagatactggggccgactcggaccgatg

SEQ ID NO: 5198 - DNA, 203 bp, Homo sapiens
  source 1..203: mol_type = other DNA
ggcgcgccagtccttccaaacagctagacccagtagcagctgggtgacccccttgcctacggatggtagcagccattgccgtactgacaaaggatgcaggcaagctaaccatgggacagccactagtcattctggccccccatgcagtagaggcactagtcaaacaaccccccgaccgctggctttcccgactcggaccgatg

SEQ ID NO: 5199 - DNA, 203 bp, Homo sapiens
  source 1..203: mol_type = other DNA
ggcgcgccagtcctaacgcccggatgactcactatcaggccttgcttttggacagggaccgggtccagttcagaccggtggtagccctgaacccggctacgctgctcccactgcctgagaaagggctgcaacacaactgccttgatatcctggccgaagctcatggaacccgacccgacctaagggaccgactcggaccgatg

SEQ ID NO: 5200 - DNA, 203 bp, Homo sapiens
  source 1..203: mol_type = other DNA
ggcgcgccagtcctcagccgctcccagacgccgaccacacctggtacacggatggaagcagtcttttacaagagggacagcgtaaggcgggagctgcggtgaccaccgagaccgagaagccttcccaaccaagaaaaaaaaccgccaaggtcgtaaatcttccccaggttcggcatgcttcaggtattcgactcggaccgatg

SEQ ID NO: 5201 - DNA, 203 bp, Homo sapiens
  source 1..203: mol_type = other DNA
ggcgcgccagtccttagggactgggtgctcctactccccttagccctgtatcgagcccgcaacacgccgggcccccatggcctcaccccatatgagatcttatgtggggcacccccgccccttgtaaacttccctgaccctgacatgacaagagttactaacagcccctctctccaagctcacatacacgactcggaccgatg

SEQ ID NO: 5202 - DNA, 203 bp, Homo sapiens
  source 1..203: mol_type = other DNA
ggcgcgccagtccttaatgccttcgcctctaagcctgtgtcgctacctccctcgtgagctgtcgccatcggtagactcgcggtcctgcagcattcctttggtggccccgaggaaggcagggaagctcttcctggggaccactcctcctcgggctcccggactgccacgccggctggcctggttctccacgactcggaccgatg

SEQ ID NO: 5203 - DNA, 203 bp, Homo sapiens
  source 1..203: mol_type = other DNA
ggcgcgccagtcctgccacgacaacatagttcgggttgtggctgccagcacgcgcacgcccgaagactccaacagcctaggtaccataatcatggagtttgggggcaacgtgactctacaccaagtcatctacgatgccacccgctcaccggagcctctcagctgcagaaaacaactaagtttggggacgactcggaccgatg

SEQ ID NO: 5204 - DNA, 203 bp, Homo sapiens
  source 1..203: mol_type = other DNA
ggcgcgccagtcctcccctccccacatagggggcacgtacacgcaccaagctccggagatcctaaaaggagagattgccacgcccaaagctgacatctactcttttggaatcaccctgtggcagatgactaccagagaggtgccttactccggcgaacctcagtacgtgcagtatgcagtggtagcctcgactcggaccgatg

SEQ ID NO: 5205 - DNA, 203 bp, Homo sapiens
  source 1..203: mol_type = other DNA
ggcgcgccagtcctacaatctgcgtccctcactggcaggagcggtgttcaccgcctccctgactggaaaggcactgcagaacatcatccagagctgctgggaggcccgcggcctgcagaggccgagtgcagaactgctccaaagggacctcaaggctttccgagggacactaggctgactccatcgagcgactcggaccgatg

SEQ ID NO: 5206 - DNA, 203 bp, Homo sapiens
  source 1..203: mol_type = other DNA
ggcgcgccagtcctagtttctagtgaatcatcagatgtttccagggtgccccaaggacctgaaaatgaccctgtaccttatttgaactaaccaatcagttcgcttctcgcttctgttcgcgcgcttccgctctccgagctcaataaaagagcccacaacccctcactccgcgcgccagtcttccgatacgactcggaccgatg

SEQ ID NO: 5207 - DNA, 203 bp, Homo sapiens
  source 1..203: mol_type = other DNA
ggcgcgccagtcctcactttgcaaggcatggaaaaatacataactgagaatagaaaagttcagatcaaggtcaggaacaaagaaacagctgaataccaaacaggatatctgtggtaagcggttcctgccccggctcagggccaagaacagatgagacagctgagtgatgggccaaacaggatatctgtcgactcggaccgatg

SEQ ID NO: 5208 - DNA, 203 bp, Homo sapiens
  source 1..203: mol_type = other DNA
ggcgcgccagtccttttccagggtgccccaaggacctgaaaatgaccctgtaccttatttgaactaaccaatcagttcgcttctcgcttctgttcgcgcgcttccgctctccgagctcaataaaagagcccacaacccctcactccgcgcgccagtcttccgatagactgcgtcgcccgggtacccgtcgactcggaccgatg

SEQ ID NO: 5209 - DNA, 203 bp, Homo sapiens
  source 1..203: mol_type = other DNA
ggcgcgccagtcctggagagatcagagcactcttgggagtggaagctcccgggtctctcctgcctgactgtggagacaataaaggagttactttacaactgcgctagcctggttattatcgggattcgtcactaattctgtgcaacaccagagcggatctcgcagctggcgcccaacgtggggctcgacgactcggaccgatg

SEQ ID NO: 5210 - DNA, 203 bp, Homo sapiens
  source 1..203: mol_type = other DNA
ggcgcgccagtcctgaaaagaagacagcagtccgcagaaatcaggagaagaagagtcatggaaggagttatgggacctcggactttgctgttgtaaagagaaaccagcgcgcagcggaagagcggagacacggacaaaagggaaacaaaaacttcggggacgcctgaagtaaggtaagagagacacctcgactcggaccgatg

SEQ ID NO: 5211 - DNA, 203 bp, Homo sapiens
  source 1..203: mol_type = other DNA
ggcgcgccagtcctgaaaaaatgcaagcatgtcgggacgtaggatcagaaggatttaaaatgcagctgttagcacaggcattgagaccgccacggaaggaaggaaaacagggagtacaaaaatgctattactgcgggaaaccaggacatctcgcaaggcaatgcagacaaggaataatatgtcatcatcgactcggaccgatg

SEQ ID NO: 5212 - DNA, 203 bp, Homo sapiens
  source 1..203: mol_type = other DNA
ggcgcgccagtcctgatggaagttgagtccctcagtgtatcaatttacaatgcaagaaatattaagggattggatagcgaaacatcctatgatacaatttggaatatacatggatgatatttatatagggagtgatttggatataatgaaacacagagagatagtagaagaactagctagctatattgcgactcggaccgatg

SEQ ID NO: 5213 - DNA, 203 bp, Homo sapiens
  source 1..203: mol_type = other DNA
ggcgcgccagtcctcccagtatggatttatgttaccagaagaaaagagacaagaagggtatccagcaaagtggcttggatttgaattgcacccagagaaatggagatttcagaaacatacacttccagaaataaaggaagggaccataacattaaataaattacaaaaattagtaggagatttagtctcgactcggaccgatg

SEQ ID NO: 5214 - DNA, 203 bp, Homo sapiens
  source 1..203: mol_type = other DNA
ggcgcgccagtcctggagacaatcattaataggaaaaagcatacctaatatactaaagttaatggaaggggatagggcgctccaaagtgaaagaaggatagagctcagacatgtaaaggaatgggaggaatgtagaagaaaattagcagaaatggaaggaaattactatgatgaagagaaggatgtatcgactcggaccgatg

SEQ ID NO: 5215 - DNA, 203 bp, Homo sapiens
  source 1..203: mol_type = other DNA
ggcgcgccagtcctagaatggaaaaggaagtctaggattcattgcctctacaggcgttaaatttagaaaacacgaagagggaacaaatcaacaattagaattaagagcaatagaagaggcgtgcaaacagggaccagagaaaatgaatatagtaacagatagcagatatgcatatgaatttatgagaacgactcggaccgatg

SEQ ID NO: 5216 - DNA, 203 bp, Homo sapiens
  source 1..203: mol_type = other DNA
ggcgcgccagtcctaagggggaataatagattcaggatatcaaggcattatacaggtagtagtatataacagcaatgacaaggaagtcattatcccacaagggagaaaatttgcacaattaattctcatgcctttaatacatgaagacctagaagcttggggggaaactagaaggacagaaagaggaacgactcggaccgatg

SEQ ID NO: 5217 - DNA, 203 bp, Homo sapiens
  source 1..203: mol_type = other DNA
ggcgcgccagtcctaccaaggatttggatcaacgggagcatattggattgaaaatattcccctagcagaggaagatcacagtaaatggcatcaagatgctgggtcattacacttagactttgggataccccgaactgcagctgaggatattgtacaacaatgtgaagtatgtcaagaaaataaaatgccgactcggaccgatg

SEQ ID NO: 5218 - DNA, 203 bp, Homo sapiens
  source 1..203: mol_type = other DNA
ggcgcgccagtccttttgttattacagagtcaggaaaagaggacacccaggcgagtggctgggaccaacacaggtactctgggaaggggaaggagcaatcgtaataaaagataaaaatctagaaaagtatttagtcatagcaaaaaaggatgttaagttcataccgcaaccaaaagaaatacaaacagcgactcggaccgatg

SEQ ID NO: 5219 - DNA, 203 bp, Homo sapiens
  source 1..203: mol_type = other DNA
ggcgcgccagtcctaatgaggaaacagagagacgaagaagaaaaacaaaatttggtaacaggtaaggaaaaatcttgggtaagtattgacctcctggggaccaaacaagaagggaaaaggcagaaggtaaacatatggggaccatgggaaaaatggggaattaaaatagtatgggtaatgctatgggtcgactcggaccgatg

SEQ ID NO: 5220 - DNA, 203 bp, Homo sapiens
  source 1..203: mol_type = other DNA
ggcgcgccagtccttgctatcatggctataatagctgctgcaggagctggactcggcgttgctaatgccgtgcagcaatcctacaccaggacggctgttcagtctcttgctaacgcaactgctgctcagcagaatgtgttagaagcaacttatgccatggttcagcatgtggcaaaaggggtaagaatcgactcggaccgatg

SEQ ID NO: 5221 - DNA, 203 bp, Homo sapiens
  source 1..203: mol_type = other DNA
ggcgcgccagtcctggccaccaataaaggacctgatcacgcacagaacatgcatggctgcaccaatggggtagctgatcatgagctaaacactcgtctcccagcctatcagaactacttcccctttcccctctctacccgctcccctccctatataaggaacccattttgaaataaactttgcagcttcgactcggaccgatg

SEQ ID NO: 5222 - DNA, 203 bp, Homo sapiens
  source 1..203: mol_type = other DNA
ggcgcgccagtcctttcactgggcttcagaatgccgttctcgattagacattaatggacaacccattattaagcagggaaacttgaacaggggccagccccagggccccactaccgggatgaactccggggcttcacagttcaccccccaataccgccagccaacccctgccctcccagtaatcaacccgactcggaccgatg

SEQ ID NO: 5223 - DNA, 203 bp, Homo sapiens
  source 1..203: mol_type = other DNA
ggcgcgccagtcctacgccgctacgtcacagacctctggcgagcaacagcgggcagtgcaggactggacctctgtaccaccaccgacacaatactaaccacccaaaatagccctctgacacttccagttggaatatatggacccttaccaccccagacattcggcctcatattagcagagccagctctcgactcggaccgatg

SEQ ID NO: 5224 - DNA, 203 bp, Homo sapiens
  source 1..203: mol_type = other DNA
ggcgcgccagtcctaaccgttgctactcacctgcgcggtattggccaggccaccaacccccaacaaagtgctcaaatgcttaagtgggaggactctgaaggcaataatggtcacattaccccttatgtcctccccaatctgccagtcaatctctggggaagggacatcctctctcaaatgaaacttgtcgactcggaccgatg

SEQ ID NO: 5225 - DNA, 203 bp, Homo sapiens
  source 1..203: mol_type = other DNA
ggcgcgccagtcctttaagaaaaaatcaggtagctggcgtcttttacaggatctaagagccgttaataaggtaatggtccccatgggagcccttcagcctggtcttccctctcctgtagccatccccctaaactatcacaaaattgttattgaccttaaggattgtttctttaccatccccttacacccgactcggaccgatg

SEQ ID NO: 5226 - DNA, 203 bp, Homo sapiens
  source 1..203: mol_type = other DNA
ggcgcgccagtcctctgaagacagaccttactttgcctttagcgtccctcaaatcaacttccaaagtcctatgcctcgttatcagtggaaggttctgccacagggcatggccaacagtcccacactgtgccaaaaatttgttgctgccgccattgccccagtaagatcccagtggccagaggcctatacgactcggaccgatg

SEQ ID NO: 5227 - DNA, 203 bp, Homo sapiens
  source 1..203: mol_type = other DNA
ggcgcgccagtcctccctcctttggctccatctacctgcctccccatcaaaagtcttactcacctacccctcgctcctcgccatgttaattattaagggtcggtacactggccgccaactgtttggcagggacccccactctataatcattccatacacccaggaccaattaacctggctcctgcaaacgactcggaccgatg

SEQ ID NO: 5228 - DNA, 203 bp, Homo sapiens
  source 1..203: mol_type = other DNA
ggcgcgccagtcctgaattgctgcatatgttattgataatcaacccatctcaataaaatccccctacctgtcagctcaacttgttgagctctatgctattctccaggtgttcacagttctagctcaccaaccgtttaacttgtacactgacagtgcgtatattgctcaatcagtccctcttttggagacgactcggaccgatg

SEQ ID NO: 5229 - DNA, 203 bp, Homo sapiens
  source 1..203: mol_type = other DNA
ggcgcgccagtccttcaccagtgtttggaagggccctgaccctgtcctcatatgggggcgaggctcagcctgcatatacgatcaaaaggaggatggcccccgctggctccctgagcgactaattagacacatcaataatcagacagcccccttgtgtgacaggccaagtaacccaaatacagccccagcgactcggaccgatg

SEQ ID NO: 5230 - DNA, 203 bp, Homo sapiens
  source 1..203: mol_type = other DNA
ggcgcgccagtcctcggatgcgatggcacggttggaaaatcggtttgttggaatcagcaagcccctattcacgtctccgacggtggcggaccccaagatgctgtgagagagctttatgtacaaaaacaaatagagcttgttattcaaagccaattccctaagttatcctaccaccccctagctcgctccgactcggaccgatg

SEQ ID NO: 5231 - DNA, 203 bp, Homo sapiens
  source 1..203: mol_type = other DNA
ggcgcgccagtcctaaaaccaagaggacctgacattgatgcacaaatgcttgatattctgtcagccacccaccaggccctcaatatctccaaccccagcctagcccaaaattgctggttatgcttaaatcaaggtacctccatgcccctagccttccctgtcaatatatctagttttaatgcctcacacgactcggaccgatg

SEQ ID NO: 5232 - DNA, 203 bp, Homo sapiens
  source 1..203: mol_type = other DNA
ggcgcgccagtcctccaagcttttgtttgcggcaacaacctcgcctttactgctctgcctgcaaactggacagggtcatgtgtgttagccgccctcctgccagatatagacattatttctggtgatgaccctgtccctatccctacctttgactatattgcagggcggcagaaacgagccgttacactcgactcggaccgatg

SEQ ID NO: 5233 - DNA, 203 bp, Homo sapiens
  source 1..203: mol_type = other DNA
ggcgcgccagtcctgattcccctgctagtaggattgggtgtctctacagcagtcgctaccggtacagcaggactcggggtggctgttcaatcttacacaaaactttcccatcaacttattaacgacgtccaagccttgtctagcaccattaatgacttacaggaccaactagattccctagccgaagtcgactcggaccgatg

SEQ ID NO: 5234 - DNA, 203 bp, Homo sapiens
  source 1..203: mol_type = other DNA
ggcgcgccagtcctcttcctcaccggcctcaatggacttctcccttacctcctccccttccttggacccttattcgctatcatcctgttcttctcttttgccccttggatcctaagacgagtaacagcgttaatcagggatcagctcaattccctactgggaaagcccatacaaatccactatcaccacgactcggaccgatg

SEQ ID NO: 5235 - DNA, 203 bp, Homo sapiens
  source 1..203: mol_type = other DNA
ggcgcgccagtccttggcttgcatagaggttggtactcgaaaaatcctctcctcccaaaaaggtacctgtaagcctgaaaattaaggctcaggaggagcacagcctctacctcccctagctggttaaggtccgcctcctctttttttaaagaaaaagggaggagatgttgggaacccaggctaagctgcgactcggaccgatg

SEQ ID NO: 5236 - DNA, 203 bp, Homo sapiens
  source 1..203: mol_type = other DNA
ggcgcgccagtccttttgaaaaagccctgtataactctaggaaaggctcccgatttaaataaagcatacaagtcagttttatcatgcatgagcgccgccaaacttgatcctgacgatgtatgttcctatttggcggcggcaatgcagttttttgaggggacatgtccggaagactggaccagctatggcgactcggaccgatg

SEQ ID NO: 5237 - DNA, 203 bp, Homo sapiens
  source 1..203: mol_type = other DNA
ggcgcgccagtcctaaatgcaacggttattgctgcatgtgctcctcatgaaatgtctgttctagggggctatctgggagaggaattcttcgggaaagggacatttgaaagaagattcttcagagatgagaaagaacttcaagaatacgaggcggctgaactgacaaagactgacgtagcactggcagacgactcggaccgatg

SEQ ID NO: 5238 - DNA, 203 bp, Homo sapiens
  source 1..203: mol_type = other DNA
ggcgcgccagtcctcaaccctccaggaaagtcttcagaggataaatcaacccagactaccggccgagagctcaagaaggagacaacacccactccttctcagagagaaagccaatcctcgaaagccaggatggcggctcaaactgcttctggccctccagcccttgaatggtcggccaccaatgaagacgactcggaccgatg

SEQ ID NO: 5239 - DNA, 203 bp, Homo sapiens
  source 1..203: mol_type = other DNA
ggcgcgccagtcctgggtcttccctggcgggaattgctcaggagtagcggtgtcttctacctactgctccactaaccacgattacaccatttggatgcccgagaatccgagactagggatgtcttgtgacatttttaccaatagtagagggaagagagcatccaaagggagtgagacttgcggctttgcgactcggaccgatg

SEQ ID NO: 5240 - DNA, 203 bp, Homo sapiens
  source 1..203: mol_type = other DNA
ggcgcgccagtcctatgctcactacaagtcagtcagaacttggaatgagatcatcccttcaaaagggtgtttaagagttggggggaggtgtcatcctcatgtaaacggggtatttttcaatggtataatattaggacctgacggcaatgtcttaatcccagagatgcaatcatccctcctccagcaaccgactcggaccgatg

SEQ ID NO: 5241 - DNA, 203 bp, Homo sapiens
  source 1..203: mol_type = other DNA
ggcgcgccagtccttactgagtgcaggggccctgactgccttgatgttgataattttcctgatgacatgctggagaagagtcaatcgatcggaacctacacaacacaatctcagagggacagggagggaggtgtcagtcactccccaaagcgggaagatcatatcttcatgggaatcatacaagagcgcgactcggaccgatg

SEQ ID NO: 5242 - DNA, 203 bp, Homo sapiens
  source 1..203: mol_type = other DNA
ggcgcgccagtcctttgccaacacgtattcctcttacttgttcttccatgtaatcaccttatacatgaacgccctagactgggatgaagaaaagaccatcctagcattatggaaagatttaacctcagtggacatcgggaaggacttggtaaagttcaaagaccaaatatggggactgctgatcgtgacgactcggaccgatg

SEQ ID NO: 5243 - DNA, 203 bp, Homo sapiens
  source 1..203: mol_type = other DNA
ggcgcgccagtcctcaaaggactttgtttactcccaaagttccaattgtctttttgacagaaactacacacttatgctaaaagatcttttcttgtctcgcttcaactccttaatggtcttactttctcccccagagccccgatactcagatgacttgatatctcagctatgccagctgtacattgctgcgactcggaccgatg

SEQ ID NO: 5244 - DNA, 203 bp, Homo sapiens
  source 1..203: mol_type = other DNA
ggcgcgccagtcctggcacaagctcccgatcacgcaaatctttgagattcctgaatcaatggatccatcagaaatattggatgacaaatcacattctttcaccagaacgagactagcttcttggctgtcagaaaaccgaggggggcctgttcctagcgaaaaagttattatcacggccctgtctaagccgactcggaccgatg

SEQ ID NO: 5245 - DNA, 203 bp, Homo sapiens
  source 1..203: mol_type = other DNA
ggcgcgccagtcctatggccaggatggcgggctagaaggcttacggcagaagggctggagtctagtcagcttattgatgatagatagagaatctcaaatcaggaacacaagaaccaaagtactagctcaaggagacaaccaggttttatgtccgacatatatgttgtcgccagggctatctcaagaggcgactcggaccgatg

SEQ ID NO: 5246 - DNA, 203 bp, Homo sapiens
  source 1..203: mol_type = other DNA
ggcgcgccagtcctagtccaaaagatgggccagagtctcttgcgtctctaatgaccaaatagtcaacctcgccaatataatgtcgacagtgtccaccaacgcgctaacagtggcacaacactctcaatctttgatcaaaccgatgagggattttctgctcatgtcagtacaggcagtctttcactacccgactcggaccgatg

SEQ ID NO: 5247 - DNA, 203 bp, Homo sapiens
  source 1..203: mol_type = other DNA
ggcgcgccagtcctggttatccttctggagagagatctggttaagctcccacgagtcctggattcacgcgttgtgtcaagaggctggaaacccagatcttggagagagaacactcgagagcttcactcgccttctagaagatcctaccaccttaaatatcagaggaggggccagtcctaccattctaccgactcggaccgatg

SEQ ID NO: 5248 - DNA, 203 bp, Homo sapiens
  source 1..203: mol_type = other DNA
ggcgcgccagtccttgggaatccccgagtcaatcattggactgatacaaaactcccgaacgataagaaggcagtttagaaagagtctctcaaaaactttagaagaatccttctacaactcagagatccacgggattagtcggatgacccagacacctcagagggttgggggggtgtggccttgctcttcgactcggaccgatg

SEQ ID NO: 5249 - DNA, 203 bp, Homo sapiens
  source 1..203: mol_type = other DNA
ggcgcgccagtcctatcagtcatttttttgcacggggcccctaaaggggtacttgggctcgtccacctctatgtcgacccagctattccatgcatgggaaaaagtcactaatgttcatgtggtgaagagagctctatcgttaaaagaatctataaactggttcattactagagattccaacttggctccgactcggaccgatg

SEQ ID NO: 5250 - DNA, 203 bp, Homo sapiens
  source 1..203: mol_type = other DNA
ggcgcgccagtcctttaatagacctcttgaattgatctcaggggtaatctcatatattctcctgaggctagataaccatccctccttgtacataatgctcagagaaccgtcttttagagaagagatattttctatccctcagaaaatccccgccgcttatccaaccactatgaaagaaggcaacagatcgactcggaccgatg

SEQ ID NO: 5251 - DNA, 203 bp, Homo sapiens
  source 1..203: mol_type = other DNA
ggcgcgccagtcctctggagattacagccccaacaagaaggtgtcccgtaaggtaggatgttcagaatgggtctgctctgctcaacaggttgcagtctctacctcagcaaacccggcccctgtctcggagcttgacataagggccctctctaagaggttccagaaccctttgatctcgggcttgagagcgactcggaccgatg

SEQ ID NO: 5252 - DNA, 203 bp, Homo sapiens
  source 1..203: mol_type = other DNA
ggcgcgccagtccttggttcagtgggcaaccggtgctcattataagcttaagcctattctagatgatctcaatgttttcccatctctctgccttgtagttggggacgggtcaggggggatatcaagggcagtcctcaacatgtttccagatgccaagcttgtgttcaacagtcttttagaggtgaatgcgactcggaccgatg

SEQ ID NO: 5253 - DNA, 203 bp, Homo sapiens
  source 1..203: mol_type = other DNA
ggcgcgccagtcctaaagcgggccatcgtagccgtgatacccagacctgtgttcacgcagatgcaggtcagtgatcacccagcactccacgcaatttcgcggtatacccgccgccattggatcgagtggggccctaaagaagccctacacgtcctcatcgacccaagcccgggcctgctccgcgaggtcgactcggaccgatg

SEQ ID NO: 5254 - DNA, 203 bp, Homo sapiens
  source 1..203: mol_type = other DNA
ggcgcgccagtcctcggcggttgccccgccgattgccgcggagccggcgctgggcccacgcccggctacacccgcccctgcaccacacgcatctaccaagtcctgccggacaccgcccaccccgggcgcctctaccggtgcgggccccgcctgtggacgcgcgattgcgccgtggccgaactctcatgcgactcggaccgatg

SEQ ID NO: 5255 - DNA, 203 bp, Homo sapiens
  source 1..203: mol_type = other DNA
ggcgcgccagtcctcgccgccttcgaccgcggccccctcgaggacggcgggcgccacttggacaccgtgcaacccccaaaatcgccgccccgccctgagatcgccgcgacctggatcgtccacgcagccagcgaagaccgccattgcgcgtgcgctccccgctgcgacgtcccgcgcgaacgtccttccgactcggaccgatg

SEQ ID NO: 5256 - DNA, 203 bp, Homo sapiens
  source 1..203: mol_type = other DNA
ggcgcgccagtcctaaccagggcagacccagacagcgacatcgttgaaagttacgcccgcgccgccggacccgtgcacctccgagtccgcgacatcatggacccaccgcccggctgcaaggtcgtggtcaacgccgccaacgaggggctactggccggctctggcgtgtgcggtgccatctttgccaacgactcggaccgatg

SEQ ID NO: 5257 - DNA, 203 bp, Homo sapiens
  source 1..203: mol_type = other DNA
ggcgcgccagtcctcgccacgctgacgcacgcctccgtgctcgtcggcgcggggctcgctgccaggcgcgtcagtcctcctccgaccgagcccctcgcatcttgccccgccggtgacccgggccgaccggctcagcgcagcgcgtcgcccccagcgaccccccttggggatgccaccgcgcccgagcccgactcggaccgatg

SEQ ID NO: 5258 - DNA, 203 bp, Homo sapiens
  source 1..203: mol_type = other DNA
ggcgcgccagtcctccgcggatgccaggggtgcgaactctgccggtacacgcgcgtcaccaatgaccgcgcctatgtcaacctgtggctcgagcgcgaccgcggcgccaccagctgggccatgcgcattcccgaggtggttgtctacgggccggagcacctcgccacgcattttccattaaaccactacgactcggaccgatg

SEQ ID NO: 5259 - DNA, 203 bp, Homo sapiens
  source 1..203: mol_type = other DNA
ggcgcgccagtcctagacccaaacacctgctggctccgcgccgccgccaacgttgcgcaggctgcgcgcgcctgcggcgcctacacgagtgccgggtgccccaagtgcgcctacggccgcgccctgagcgaagcccgcactcatgaggacttcgccgcgctgagccagcggtggagcgcgagccacgccgactcggaccgatg

SEQ ID NO: 5260 - DNA, 203 bp, Homo sapiens
  source 1..203: mol_type = other DNA
ggcgcgccagtcctgcgccccgaggggggcaaccccaccggccacttcgtctgcgcggtcggcggcggcccacgccgcgtctgggaccgcccccacctctggcttgcggtccccctgtctcggggcggtggcacctgtgccgcgaccgacgaggggctggcccaggcgtactacgacgacctcgaggtcgactcggaccgatg

SEQ ID NO: 5261 - DNA, 203 bp, Homo sapiens
  source 1..203: mol_type = other DNA
ggcgcgccagtcctgcgccgcctcggggatgacgccatggcccgggcggccctcgcatcagtccaacgccctcgcaaaggcccttacaatatcagggtatggaacatggccgcaggcgctggcaagactacccgcatcctcgctgccttcacgcgcgaagacctttacgtctgccccaccaatgcgctcgactcggaccgatg

SEQ ID NO: 5262 - DNA, 203 bp, Homo sapiens
  source 1..203: mol_type = other DNA
ggcgcgccagtcctcggcaccttcgcctgcaacctttgggacggccgccaggtcgaccttcacctcgccttctcgcgcgaaaccgtgcgccgccttcacgaggctggcatacgcgcatacaccgtgcgcgaggcccagggtatgagcgtcggcaccgcctgcatccatgtaggcagagacggcacggacgactcggaccgatg

SEQ ID NO: 5263 - DNA, 203 bp, Homo sapiens
  source 1..203: mol_type = other DNA
ggcgcgccagtcctcatgcgcatctcgcgtcacctgctcaacaagaatcacaccgagatgcccggaacggaacgcgttctcagtgccgtttgcgccgtgcggcgctaccgcgcgggcgaggatgggtcgaccctccgcactgctgtggcccgccagcacccgcgcccttttcgccagatcccaccccccgactcggaccgatg

SEQ ID NO: 5264 - DNA, 203 bp, Homo sapiens
  source 1..203: mol_type = other DNA
ggcgcgccagtcctcgccttgcgcccgcaattccttgtggccgctggccatacggagcccgaggtcgatgcgtggtggcaggcccattacaccaccaacgccatcgaggtcgacttcactgagttcgacatgaaccagaccctcgctactcgggacgtcgagctcgagattagcgccgctctcttgggcgactcggaccgatg

SEQ ID NO: 5265 - DNA, 203 bp, Homo sapiens
  source 1..203: mol_type = other DNA
ggcgcgccagtcctcctcttccatgatgtcatgcaccaggcgatcaaggtgctttgccgccgtttcgacccagacgtgcttgaagaacagcaggtggccctcctcgaccgcctccggggggtctacgcggctctgcctgacaccgttgccgccaatgctgcgtactacgactacagcgcggagcgcgtcgactcggaccgatg

SEQ ID NO: 5266 - DNA, 203 bp, Homo sapiens
  source 1..203: mol_type = other DNA
ggcgcgccagtcctcgaggcctgcgtgacctcgtggctttggagcgagggcgaaggcgcggtcttttaccgcgtcgacctgcatttcaccaacctgggcacccccccactcgacgaggacggccgctgggaccctgcgctcatgtacaacccttgcgggcccgagccgcccgctcacgtcgtccgcgccgactcggaccgatg

SEQ ID NO: 5267 - DNA, 203 bp, Homo sapiens
  source 1..203: mol_type = other DNA
ggcgcgccagtcctgacccgctccgcgcgccatccttggcgcatccgcttcggtgccccccaggccttccttgccgggctcttgctcgccacggtcgccgttggcaccgcgcgcgccgggctccagccccgcgctgatatggcggcacctcctacgctgccgcagcccccctgtgcgcacgggcagcacgactcggaccgatg

SEQ ID NO: 5268 - DNA, 203 bp, Homo sapiens
  source 1..203: mol_type = other DNA
ggcgcgccagtccttcataccaagcacatggacttctggtgtgtggagcacgaccgaccgccgcccgcgaccccgacgcctctcaccaccgcggcgaactccacgaccgccgccacccccgccactgcgccggccccctgccacgccggcctcaatgacagctgcggcggcttcttgtctgggtgcggcgactcggaccgatg

SEQ ID NO: 5269 - DNA, 203 bp, Homo sapiens
  source 1..203: mol_type = other DNA
ggcgcgccagtcctcgtgcccgcccatccaggcgcccgctgccccgaactggtgagccccatgggacgcgcgacttgctccccagcctcggccctctggctcgccacagcgaacgcgctgtctcttgatcacgccctcgcggccttcgtcctgctggtcccgtgggtcctgatatttatggtgtgccgcgactcggaccgatg

SEQ ID NO: 5270 - DNA, 203 bp, Homo sapiens
  source 1..203: mol_type = other DNA
ggcgcgccagtcctctcctctggcgggtacgcgcagctggcctcttacttcaaccctggcggcagctactacaagcagtaccaccctaccgcgtgcgaggttgaacctgccttcggacacagcgacgcggcctgctggggcttccccaccgacaccgtgatgagcgtgttcgcccttgctagctacgtcgactcggaccgatg

SEQ ID NO: 5271 - DNA, 203 bp, Homo sapiens
  source 1..203: mol_type = other DNA
ggcgcgccagtcctgctgcgcactgcccctggacccggcgaggtgtgggtcacgcctgtcataggctctcaggcgcgcaagtgcggactccacatacgcgctggaccgtacggccatgctaccgtcgaaatgcccgagtggatccacgcccacaccaccagcgacccctggcatccaccgggccccttcgactcggaccgatg

SEQ ID NO: 5272 - DNA, 203 bp, Homo sapiens
  source 1..203: mol_type = other DNA
ggcgcgccagtcctggggctgaagttcaagacagttcgcccggtggccctgccacgcacgttagcgccaccccgcaatgtgcgtgtgaccgggtgctaccagtgcggtacccccgcgctggtggaaggccttgcccccgggggaggcaattgccatctcaccgtcaatggcgaggacctcggcgccgtcgactcggaccgatg

SEQ ID NO: 5273 - DNA, 203 bp, Homo sapiens
  source 1..203: mol_type = other DNA
ggcgcgccagtcctcccccctgggaagttcgtcaccgccgccctcctcaacacccccccgccctaccaagtcagctgcgggggcgagagcgatcgcgcgaccgcgcgggtcatcgaccccgccgcgcaatcgtttaccggcgtggtgtatggcacacacaccactgctgtgtcggagacccggcagaccgactcggaccgatg

SEQ ID NO: 5274 - DNA, 203 bp, Homo sapiens
  source 1..203: mol_type = other DNA
ggcgcgccagtcctctgggcggagtgggctgctgcccattggtggcagctcactctgggcgccatttgcgccctcccactcgctggcttactcgcttgctgtgccaaatgcttgtactacttgcgcggcgctatagcgcctcgctagtgggcccccgcgcgaaacccgcactaggccactagatcccccgactcggaccgatg

SEQ ID NO: 5275 - DNA, 203 bp, Homo sapiens
  source 1..203: mol_type = other DNA
ggcgcgccagtcctgaacagggacttgagaagaggcatcggcaccgaccgctgagttgctgagcgtcggagagggacgactcaggtagggtgagagcctacgagttttttgctacctagtcagcgagaaaggctaggccgcgacaggggcgcgggtcccattagtggcaaccaacccagttggacgaacgactcggaccgatg

SEQ ID NO: 5276 - DNA, 203 bp, Homo sapiens
  source 1..203: mol_type = other DNA
ggcgcgccagtcctgggttggtaggggacgggtcggagcaatgggcgggggtcactcagcactgtcagggagaagcctcgacacgttcgagaagattaggctacgtccgaacgggaaaaagaagtaccaaattaaacatttaatatgggcaggaaaagaaatggaacgatttgggttacatgagaaaccgactcggaccgatg

SEQ ID NO: 5277 - DNA, 203 bp, Homo sapiens
  source 1..203: mol_type = other DNA
ggcgcgccagtcctttggacatatgcaaagggaatgcaaggcaccaagacagatcaaatgctttaagtgcggcaaaattggccatatggcaaaagactgcaagaatggacaggcaaattttttagggtatggccattggggaggagcgaaaccaagaaattttgtgcaatacagaggagacacagttgcgactcggaccgatg

SEQ ID NO: 5278 - DNA, 203 bp, Homo sapiens
  source 1..203: mol_type = other DNA
ggcgcgccagtcctgtctggaaccaacagcccccccaatggaaacagcttacgatccagcaaagaagctcctccagcagtatgcagagaagggacagcgcctgagagaggagagagaacagacaaggaaacagaaggagaaagaagtggaggatgtttccttgagctccctctttggaggagaccaatcgactcggaccgatg

SEQ ID NO: 5279 - DNA, 203 bp, Homo sapiens
  source 1..203: mol_type = other DNA
ggcgcgccagtcctattggaggacagtggagaaaatgtaaatatagtcacagattctcaatatgtaatgaacatcttgacagcatgtccacaggaaagtaactcacccttagtggaacagataatacaagccctaatgaaaaagaggcaggtctacttacaatgggtaccagctcataaggggataggcgactcggaccgatg

SEQ ID NO: 5280 - DNA, 203 bp, Homo sapiens
  source 1..203: mol_type = other DNA
ggcgcgccagtcctcaaaagatgattacatagaagtgaatatttatcacaacctcaccccagaaagaggatggctctcaagtcatggagtagggttatcctattaccatcaaaagggatataagacagaagtagatccaggaacagcagacagaatgatacacctatattattttaactgttttacagcgactcggaccgatg

SEQ ID NO: 5281 - DNA, 203 bp, Homo sapiens
  source 1..203: mol_type = other DNA
ggcgcgccagtcctatagagccatccaacaggctatcagaggggagaagtatacgtggtgcacattcaaggaaggacataaaggtcaggtacaatcactgcaacttttggcactagttgcatatacaaatggcatcaggaagagatccaagagaacctttaccaggatggctggaaatctgggatctacgactcggaccgatg

SEQ ID NO: 5282 - DNA, 203 bp, Homo sapiens
  source 1..203: mol_type = other DNA
ggcgcgccagtcctcaaaagtctatgtttgtacatttcagatgtggttgtagaaggagaggacctttttccccttacgaagagaggagaaatggacaaggaggaggagccccaccccctcctccaggacttgcataggccattacaaccatgtactaataaatgctattgcaaaaaatgctgttatcacgactcggaccgatg

SEQ ID NO: 5283 - DNA, 203 bp, Homo sapiens
  source 1..203: mol_type = other DNA
ggcgcgccagtcctctggtaaaacaagcagagagtaatatacatctactctttgaacaaacgatgaggccttgtgttaagctctcccccatatgtattaaaatgtcctgtgtagagctgaatggtacagccacgacaaaggccaccactactgcaactacaacaatgactaccccctgtcagaattgccgactcggaccgatg

SEQ ID NO: 5284 - DNA, 203 bp, Homo sapiens
  source 1..203: mol_type = other DNA
ggcgcgccagtcctatacattgtaatgattcagtgataaaagaagcttgtgataaaacatattgggatactttaagagtaagatactgtgcaccagcagggtatgctttgctaaaatgtaatgataaggattatagaggctttgctccaaagtgcaagaatgtttcagtagtgcattgtactagattacgactcggaccgatg

SEQ ID NO: 5285 - DNA, 203 bp, Homo sapiens
  source 1..203: mol_type = other DNA
ggcgcgccagtcctatcaatactactataactacagggataggattaaatggtagtagatcagaaaatagaacagagatatggcagaaaggaggaaatgataatgatacagttataataaagttgaataagttttacaacttgacagtgagatgccgaagacctggtaataaaacagtgttgccagtacgactcggaccgatg

SEQ ID NO: 5286 - DNA, 203 bp, Homo sapiens
  source 1..203: mol_type = other DNA
ggcgcgccagtcctgttgcctgccatatacgacaagtagtaaatgattggtacactgtctctaaaaaggtatatgctccaccaagggaaggtcatttggagtgtaactcatcagtcacggcactatacgtggcaatagattataacaacaagtctggcccaataaatgtgaccctaagtcctcaggtacgactcggaccgatg

SEQ ID NO: 5287 - DNA, 203 bp, Homo sapiens
  source 1..203: mol_type = other DNA
ggcgcgccagtcctaagaatctggatctgtaccagaaattggatgattggtcagggttctggtcatggttctcactgtcaacttggttaggctatgttaaaataggatttttagtgatagtgattattctaggattaagatttgcatgggtattatggggatgtatcagaaatattaggcagggatatcgactcggaccgatg

SEQ ID NO: 5288 - DNA, 203 bp, Homo sapiens
  source 1..203: mol_type = other DNA
ggcgcgccagtcctaatcctctcccccagatccatatccacagttcagcggaacggccagacaacggaggagggcaagacagaggtggagaaagcagcagcagcaaattgataagattgcaggaagagtcctcaacaccttcgaggatcaacaactggtggctcaacttcaagagctgcagcttgagacgactcggaccgatg

SEQ ID NO: 5289 - DNA, 203 bp, Homo sapiens
  source 1..203: mol_type = other DNA
ggcgcgccagtcctgtaccgcccggacatgtttaaggacatgcacgaacatgcaaagcgctagtgtcagcactttgcggttgggactttccgccagggactttccacagtgggtggatcggaggcggtacaggggcggtactgggagtggctttcccctcagagctgcataaaagcagatgctcgctgcgactcggaccgatg

SEQ ID NO: 5290 - DNA, 203 bp, Homo sapiens
  source 1..203: mol_type = other DNA
ggcgcgccagtcctgcttgtaactcagtctcttactaggagaccagctagagcctgggtgttcgctggttagcctaacccggttggccaccgggggtaaggactccttggcttcatatagctcaataaacctgctcgcttagtcgctatattggagtcaagtgctcattgctgcgccgagcctctagacgactcggaccgatg

SEQ ID NO: 5291 - DNA, 203 bp, Homo sapiens
  source 1..203: mol_type = other DNA
ggcgcgccagtcctgttagcctaacccggttggccaccgggggtaaggactccttggcttcatatagctcaataaacctgctcgcttagtcgctatattggagtcaagtgctcattgctgcgccgagcctctagaggtgaacctctcttactgggttctcctgtacccaggtgggagaaactccagcacgactcggaccgatg

SEQ ID NO: 5292 - DNA, 203 bp, Homo sapiens
  source 1..203: mol_type = other DNA
ggcgcgccagtcctaactcacccagacacagcaggaggcctttctcgcacgcctcactggccagggcaacatatccctaaaggaaaatgttgcgccagtcgagaaaaggaagaacaaatcccaaaagatattttcccagtgactgaaaccgttgatgggcaaggtcaagcctggagacaccataatggcgactcggaccgatg

SEQ ID NO: 5293 - DNA, 203 bp, Homo sapiens
  source 1..203: mol_type = other DNA
ggcgcgccagtcctgcgttaagcactggaatatatggaccactgcctcccaacacttttggattaatcctaggccgaagtagcattactatgaagggtctacaagtttatccaggagtaattgataatgactataccggagaaattaaaattatggcaaaagctgttaacaatattgttactgtctctcgactcggaccgatg

SEQ ID NO: 5294 - DNA, 203 bp, Homo sapiens
  source 1..203: mol_type = other DNA
ggcgcgccagtcctcaaggcaacagaatagctcaattaatcctcctgcctctgatcgagacagacaataaggtacaacaaccttatagaggacaaggaagttttggatcctcagacatatattgggtccaacctattacttgtcaaaaaccttccttaacattatggttagatgacaaaatgttcacacgactcggaccgatg

SEQ ID NO: 5295 - DNA, 203 bp, Homo sapiens
  source 1..203: mol_type = other DNA
ggcgcgccagtcctccccagaaaaagttcaattacaagatccctacacatatttaggatttgaacttaatggtcctaaaatcactaatcaaaaagcagtcattcgtaaagataaattacagactcttaatgatttccaaaaacttttaggagacatcaattggctcagaccatatctaaaactcactacgactcggaccgatg

SEQ ID NO: 5296 - DNA, 203 bp, Homo sapiens
  source 1..203: mol_type = other DNA
ggcgcgccagtcctctggagacttaaaacccttattcgacacccttaaaggagactctgaccccaattcccatagatccttatcaaaagaagctcttgcctcacttgaaaaggtagagacagccattgcagaacaattcgttactcacataaattattcactaccattaattttcctcatattcaacacgactcggaccgatg

SEQ ID NO: 5297 - DNA, 203 bp, Homo sapiens
  source 1..203: mol_type = other DNA
ggcgcgccagtcctacaatgccttattagtttttactgatggctcttccactgggatggccgcatatactcttactgataccaccatcaaattccaaactaatcttaattcggctcaactagtagaactacaagctttaattgcagtcttatcagccttccctaatcaacctcttaatatttacactgcgactcggaccgatg

SEQ ID NO: 5298 - DNA, 203 bp, Homo sapiens
  source 1..203: mol_type = other DNA
ggcgcgccagtcctacagtgcttacttagcccactcaatacccctacttgaaactgtcgcacaaattaaacacatatcagaaacagctaaactgttcctacagtgccagcaactcatatacaatagatccatacctttttatattggacatgtcagggcccattctggactacctggacccatagctccgactcggaccgatg

SEQ ID NO: 5299 - DNA, 203 bp, Homo sapiens
  source 1..203: mol_type = other DNA
ggcgcgccagtccttagttgaaagagcccacttatctcttaaaaccaccattgaaaagataaaaaagggggaatggtaccctaggaagggtacccccaggaacatcctcaatcatgcactctttattctaaattttttaaatttagatgatcaaaataaatcagcagctgatcgtttttggcataatacgactcggaccgatg

SEQ ID NO: 5300 - DNA, 203 bp, Homo sapiens
  source 1..203: mol_type = other DNA
ggcgcgccagtcctaccccaaaaaacaatttgccatggtaaaatggaaagatccattagataatacatggcatggccccgatccagtgttaatttggggcagaggttcagtctgtgtttactctcaaacctatgatgccgctagatggctaccagaacggttagtaagacaggtgtctaacaataacccgactcggaccgatg

SEQ ID NO: 5301 - DNA, 203 bp, Homo sapiens
  source 1..203: mol_type = other DNA
ggcgcgccagtcctgatctcatatgattctgtacatgcctcttgctataaccactatcaacaatgtaacattggtaataaaacatatctcactgccactataactggagatagaactcctgccattggtgacgggaatgtccctacagtactagggactagtcacaacctcattacagcaggctgtcccgactcggaccgatg

SEQ ID NO: 5302 - DNA, 203 bp, Homo sapiens
  source 1..203: mol_type = other DNA
ggcgcgccagtcctacgccgaagacaactgatcgacaacccattttggaccagttttcatggattcctcccttatgttatgcccctattaggccctttgctttgcttattgcttgtgttatctttcggtccaattattttcaacaagcttatgacctttattaaacatcaaattgagagcatccaggccgactcggaccgatg

SEQ ID NO: 5303 - DNA, 203 bp, Homo sapiens
  source 1..203: mol_type = other DNA
ggcgcgccagtcctccaatgacgggtaatagtgacaagaaatgtatcactccaacctaagacaggcgcagcctccgagggatgtgtcttttgttttttataattaaaaagggtgacatgtccggagccgtgctgcccggatgatgtcttggcctctgtttgctctagctccatgttatgaatttaagacgactcggaccgatg

SEQ ID NO: 5304 - DNA, 203 bp, Homo sapiens
  source 1..203: mol_type = other DNA
ggcgcgccagtcctatgagacttgatcagaacactgtcttgtctccatttcttgtgtctcttgttcccttcaattcccactccctcctccaggttcctactgttgatcccgcgggtcgggacagttggcgcccaacgtggggcacgaacccacgaccctgggattaagagtcccatgctctaccgactcgactcggaccgatg

SEQ ID NO: 5305 - DNA, 203 bp, Homo sapiens
  source 1..203: mol_type = other DNA
ggcgcgccagtccttccatgttatgaatttaagatggcgtatttcctggttcttctccgtcttactttcccgccggcgcgaatgtttcccgctcttgggcttacgtggctttccttgctctgctactgagcatgcgcccagtatctttcccctcccacttgctgcctgtgtatataaggcaacacattcgactcggaccgatg

SEQ ID NO: 5306 - DNA, 203 bp, Homo sapiens
  source 1..203: mol_type = other DNA
ggcgcgccagtcctactgacgtgattaccattccaacagctgctgggaaaaacctgtgcatcgtaagggctatggacgtaggatacctttgtgaggatactatcacttatgaatgtccggtcctagctgctggaaatgaccctgaagacattgactgctggtgcacgaaatcatctgtttacgtgcgccgactcggaccgatg

SEQ ID NO: 5307 - DNA, 203 bp, Homo sapiens
  source 1..203: mol_type = other DNA
ggcgcgccagtcctggcgatagttgtgtgaccataatgtcaaaagacaagccaaccattgatgtcaaaatgatgaacatggaagcagccaacctcgcagatgtgcgcagttactgttacctagcttcggtcagtgacttgtcaacaagagctgcgtgtccaaccatgggtgaagcccacaacgagaaacgactcggaccgatg

SEQ ID NO: 5308 - DNA, 203 bp, Homo sapiens
  source 1..203: mol_type = other DNA
ggcgcgccagtcctggaacggtggtgttggaactgcaatataccggaacagacggtccctgcaaagtgcccatttcttccgtagcttccctgaatgacctcacacctgttggaagactggtgaccgtgaatccatttgtgtctgtggccacagccaactcgaaggttttgattgaactcgaacccccgcgactcggaccgatg

SEQ ID NO: 5309 - DNA, 203 bp, Homo sapiens
  source 1..203: mol_type = other DNA
ggcgcgccagtccttttggtgactcttacatcgtggtgggaagaggagaacagcagataaaccatcactggcacaaatctgggagcagcattggaaaggcctttaccaccacactcagaggagctcaacgactcgcagctcttggagatactgcttgggattttggatcagttggaggggttttcacccgactcggaccgatg

SEQ ID NO: 5310 - DNA, 203 bp, Homo sapiens
  source 1..203: mol_type = other DNA
ggcgcgccagtccttcagtggggaaagccatacaccaagtctttggaggagcttttagatcactctttggagggatgtcctggatcacacagggacttctgggagctcttctgttgtggatgggaatcaatgcccgtgacaggtcaattgctatgacgtttcttgcggttggaggagttttgctcttccgactcggaccgatg

SEQ ID NO: 5311 - DNA, 203 bp, Homo sapiens
  source 1..203: mol_type = other DNA
ggcgcgccagtcctttcctgaggattcgggaaacgaacacaacggaatgcgactcgaagatcataggaaccgccgtcaagaacaacatggctgtgcatagtgatctatcatactggatagagagcggactcaacgacacctggaagcttgagagggcggttctaggagaagtcaaatcatgcacctggcgactcggaccgatg

SEQ ID NO: 5312 - DNA, 203 bp, Homo sapiens
  source 1..203: mol_type = other DNA
ggcgcgccagtcctccagaaacccacactctgtggggtgatggagttctggaaagtgatctcatcatacccatcaccttggcaggacccagaagcaaccacaacaggagaccagggtacaaaactcagaaccaaggcccatgggatgaggggcgcgtcgagattgactttgactattgcccaggaacacgactcggaccgatg

SEQ ID NO: 5313 - DNA, 203 bp, Homo sapiens
  source 1..203: mol_type = other DNA
ggcgcgccagtcctgaaaagaccctcgtgcaatcgagagtgaatgcatacaacgccgacatgattgatccttttcagttgggccttatggtcgtgttcttggccacccaggaggtccttcgcaagaggtggacggccaagatcagcattccagctatcatgcttgcactcctagtcctagtgtttgggcgactcggaccgatg

SEQ ID NO: 5314 - DNA, 203 bp, Homo sapiens
  source 1..203: mol_type = other DNA
ggcgcgccagtcctggtattacgtacactgatgtcctgcgatatgtcattctcgtcggcgccgcgtttgctgaagcaaactcaggaggagacgtcgtgcacttggcacttatggctacattcaagattcaaccagtctttctggtggcttcctttttgaaggcaaggtggaccaaccaagagagtattcgactcggaccgatg

SEQ ID NO: 5315 - DNA, 203 bp, Homo sapiens
  source 1..203: mol_type = other DNA
ggcgcgccagtcctcctggattgaaatgcttaaaccttgatgtgtacagaattttgctactcatggttggagttggaagcctcatcaaagaaaaaaggagctctgcagcaaaaaagaaaggagcttgcctcatctgcctagcgctggcgtctacaggagtgttcaatccaatgatacttgcagctgggcgactcggaccgatg

SEQ ID NO: 5316 - DNA, 203 bp, Homo sapiens
  source 1..203: mol_type = other DNA
ggcgcgccagtccttcaacagacatgtggattgagaggacggctgacattacttgggagagtgatgctgaaatcacaggctctagcgaaagagtagatgtgaggctggatgatgatggaaattttcaactgatgaatgaccccggggcaccatggaaaatttggatgcttaggatggcctgcctggcgcgactcggaccgatg

SEQ ID NO: 5317 - DNA, 203 bp, Homo sapiens
  source 1..203: mol_type = other DNA
ggcgcgccagtccttatgggaacggcgtcatcatgcctaatggttcatacataagcgccattgtgcaaggagagagaatggaagaaccggcaccagctggcttcgaacctgaaatgttgaggaagaaacagatcactgtccttgatctgcaccccggagcaggaaagacacgcaagatacttccccaacgactcggaccgatg

SEQ ID NO: 5318 - DNA, 203 bp, Homo sapiens
  source 1..203: mol_type = other DNA
ggcgcgccagtcctatcatcaaggaggccatcaacaaaagattgaggacggctgtgctggcacccaccagggtcgttgctgctgagatgtctgaggccctgagaggacttcccattcggtaccaaacctcagcagtgcacagagagcacagtggaaatgagatcgttgatgtcatgtgccatgccacccgactcggaccgatg

SEQ ID NO: 5319 - DNA, 203 bp, Homo sapiens
  source 1..203: mol_type = other DNA
ggcgcgccagtcctgacccctttccagagtctaatgctcctatctcggacatgcaaacagagatcccagacagagcctggaacactggatatgaatggataactgagtatgttggaaagaccgtttggtttgttccaagtgtgaaaatgggaaatgagattgccctctgtctgcaacgggcggggaagcgactcggaccgatg

SEQ ID NO: 5320 - DNA, 203 bp, Homo sapiens
  source 1..203: mol_type = other DNA
ggcgcgccagtcctggaagagtcatcctgggggaaccctcagccatcacggctgccagcgctgctcagcggagaggacgcataggaagaaacccatcacaagttggtgatgagtattgctatggagggcacacaaatgaggatgattccaactttgctcactggacagaggctcgcatcatgctagaccgactcggaccgatg

SEQ ID NO: 5321 - DNA, 203 bp, Homo sapiens
  source 1..203: mol_type = other DNA
ggcgcgccagtcctaggccagaagctagagagacgaccctgggagttgagagcttcttacttgatctgcggccggccacggcatggtcgctctatgccgtaacgacagccgttctcacccctttgctgaagcatctaatcacgtcagactacatcaacacttcgttgacctcaataaacgtccaagcccgactcggaccgatg

SEQ ID NO: 5322 - DNA, 203 bp, Homo sapiens
  source 1..203: mol_type = other DNA
ggcgcgccagtcctagaaccgtcagagaggccggaattctgactacagcagcagcagtcaccctatgggagaatggtgctagttcagtgtggaatgcaacgacagctattggcctttgtcacatcatgcgaggaggatggctctcgtgtctctccatcatgtggactctcatcaaaaacatggagaaacgactcggaccgatg

SEQ ID NO: 5323 - DNA, 203 bp, Homo sapiens
  source 1..203: mol_type = other DNA
ggcgcgccagtcctccagtctcacggggaaccgcgaaattacggtggttagtggaaaggcgtttcctcgagccagtgggaaaggttgtggatctcgggtgtggtagaggcggctggtgctattacatggctacccagaagagggtacaggaagtgaaagggtacacgaaaggaggacctggccatgaacgactcggaccgatg

SEQ ID NO: 5324 - DNA, 203 bp, Homo sapiens
  source 1..203: mol_type = other DNA
ggcgcgccagtcctgaaccacaactggtgcagagctatggttggaatattgttaccatgaagagtggagtcgacgtcttctacagaccatcagaagcgagcgacacactgctctgtgacattggagagtcatcgtcaagtgccgaggtagaagaacaccgcaccgtccgtgtcctggagatggtggaacgactcggaccgatg

SEQ ID NO: 5325 - DNA, 203 bp, Homo sapiens
  source 1..203: mol_type = other DNA
ggcgcgccagtcctgattggttgcacagaggaccgaaggaattctgcatcaaagtgctatgcccttacatgcccaaagtgattgagaagatggaaacactccaaaggcgatatggaggtggccttataagaaaccccctttcacgcaactctacccatgagatgtactgggtgagccacgcttcaggccgactcggaccgatg

SEQ ID NO: 5326 - DNA, 203 bp, Homo sapiens
  source 1..203: mol_type = other DNA
ggcgcgccagtcctgccatgacagacaccactcctttcggtcaacaacgagtgttcaaggaaaaggtggacacaaaggctccagagcctccagaaggagtcaaatacgtcctcaatgagaccacgaactggctgtgggcttttttagcccgcgataagaaacccaggatgtgttcccgggaggaatttcgactcggaccgatg

SEQ ID NO: 5327 - DNA, 203 bp, Homo sapiens
  source 1..203: mol_type = other DNA
ggcgcgccagtcctattggaaaagtcaacagtaatgccgccctaggagcgatgtttgaagaacagaaccaatggaagaacgcccgggaagctgtagaggatccaaagttttgggagatggtggatgaggagcgtgaagcgcatctccgtggagaatgcaacacctgcatctacaacatgatgggaaagcgactcggaccgatg

SEQ ID NO: 5328 - DNA, 203 bp, Homo sapiens
  source 1..203: mol_type = other DNA
ggcgcgccagtcctcgacacaaagtcgtgaaagtgatgaggccagcggccgacgggaaaactgtgatggacgtcatctctagagaggatcagagaggaagcggtcaggtagtgacttacgccctgaacaccttcaccaatctagcagttcagctggtcagaatgatggagggggagggggtcattggacgactcggaccgatg

SEQ ID NO: 5329 - DNA, 203 bp, Homo sapiens
  source 1..203: mol_type = other DNA
ggcgcgccagtcctcccgatgatgttgaaaaactgggaaaaggaaaaggccctaaggtcagaacctggctgtttgagaatggcgaggagcgtctcagtcgcatggccgtcagcggtgatgactgcgtggtgaaacctttggacgaccgcttcgccacatcactacacttcctaaatgctatgtcaaagcgactcggaccgatg

SEQ ID NO: 5330 - DNA, 203 bp, Homo sapiens
  source 1..203: mol_type = other DNA
ggcgcgccagtcctgtccgcaaagacatccaggaatggaaaccctcgacggggtggtatgactggcagcaggttccattctgttcaaaccatttcacggaactgatcatgaaggacggcaggacgctggtggtcccgtgtcgtggacaagacgagttgattggacgtgccaggatctctccaggggctcgactcggaccgatg

SEQ ID NO: 5331 - DNA, 203 bp, Homo sapiens
  source 1..203: mol_type = other DNA
ggcgcgccagtcctggatggaatgtgcgcgacaccgcctgcctggcgaagtcatacgcgcagatgtggctgctgctttatttccaccgtagagacctgagattgatggccaatgccatctgttccgctgtgcctgccaactgggttcccacagggcgtaccacttggtcgatccacgcaaaaggagaacgactcggaccgatg

SEQ ID NO: 5332 - DNA, 203 bp, Homo sapiens
  source 1..203: mol_type = other DNA
ggcgcgccagtccttcgtccaagccctcattcacatggcattggtgcttcatgccttgtttgcctccatcgaccggcgaattcgctcattatcccgacgtgttaccgctcttgaatctcgccgaaccacaggaaatcccatgacgctagctttcatcttgggctttctcacagtgttatgtggatgcgcgactcggaccgatg

SEQ ID NO: 5333 - DNA, 203 bp, Homo sapiens
  source 1..203: mol_type = other DNA
ggcgcgccagtcctcagattgcggatcaacgtggactgagttcacattgcggtatcggagatgcgtcgtgaagaaacgtgaaaagcgatcacgtgaacccccgaaagcggatttgctagctgaaatggagatcattgcgttcaagaccattcgcgaaaataagacaatcttcatcgtggccctattgtcgactcggaccgatg

SEQ ID NO: 5334 - DNA, 203 bp, Homo sapiens
  source 1..203: mol_type = other DNA
ggcgcgccagtcctacggtctcctcgagtttaaaacaggaccggcggagatctacggggggcaatggctgcgcgagttactcgcagattgccacgtcaacgcatcctattcgactgacgtgtgtcccggtggatcgcagctcaacatggcagatatcatggccaaggaacgagtatgctcgacccaaccgactcggaccgatg

SEQ ID NO: 5335 - DNA, 203 bp, Homo sapiens
  source 1..203: mol_type = other DNA
ggcgcgccagtcctgtcggcacggcatggagaaagttgttgtgtggggagatgctaggtccaatgagattctagtaaaaaacgtaattgaaccttcgttgtcctgggaagacgcgatcgccactcatggtggattccgtgacatctcctttgtttgtcagattatgctcgacaaactagtcagtggagcgactcggaccgatg

SEQ ID NO: 5336 - DNA, 203 bp, Homo sapiens
  source 1..203: mol_type = other DNA
ggcgcgccagtcctaggatctggtcggaaagttttcggttggtgccttcttctccaacacagcccttctggtcattctcgtcctcgctgccttgattgacaaacgcatagcctttctattggttttaggggggtacttttactatgtgcgggctgatctggggtgtggaattgacaccacgagaaaaacgactcggaccgatg

SEQ ID NO: 5337 - DNA, 203 bp, Homo sapiens
  source 1..203: mol_type = other DNA
ggcgcgccagtccttgcgcagagctgctttctctgctgttgggtcgatgggttctgaacgggtgtatgtaaatgacacattggcgcgtacattcaagttctccgaaacagcaaagagaaccatttccgtcaccattaacttaattcagtacaagttctcatcttatgttgcacatggacgcgctgaggcgactcggaccgatg

SEQ ID NO: 5338 - DNA, 203 bp, Homo sapiens
  source 1..203: mol_type = other DNA
ggcgcgccagtcctcaaaggtcaaagtggactctcgatgccatgggcgaatgcacgcccaggtaattggaccgaatgacacggaatcttggtgttgccagtcatgcacaagaatagtccactttcgagtcggtgacctcctatattaccccatggagatccaacttggaaccatgtctgaagcgtcagcgactcggaccgatg

SEQ ID NO: 5339 - DNA, 203 bp, Homo sapiens
  source 1..203: mol_type = other DNA
ggcgcgccagtcctcattgcagcttatcggggcaaaaactagaacatcgacactaactcgcctatttctgacgattctcgcaatggcgctctttggactccccaacttgttttcatctgtggggctatctgcgtgggtgttgctggtggcgtcctcatcggcgcaaccgcaagacctatcaatgaatccgactcggaccgatg

SEQ ID NO: 5340 - DNA, 203 bp, Homo sapiens
  source 1..203: mol_type = other DNA
ggcgcgccagtcctagcttgagttcatctcagctggagagactcccgaaggagtgtcaaccgaaaatgatgacgggataaatattcctgacttaaaagggcgctatggagaggatgggatcgtcgtgggggcggcctcatcgtctggttacctacctgagctcgtgtttgtgttcctcctaggctttgcgactcggaccgatg

SEQ ID NO: 5341 - DNA, 203 bp, Homo sapiens
  source 1..203: mol_type = other DNA
ggcgcgccagtcctccgtgacgtccacttcatactttttgggggcactctacctgctcatcgcaaccagcactaacctccccgtggtcataatacggatgctgcgtatgaagctcactgctagcaaccgatctgatgatctcttgggactcggcggacctgttgaaactgacctccagaccagctttccgactcggaccgatg

SEQ ID NO: 5342 - DNA, 203 bp, Homo sapiens
  source 1..203: mol_type = other DNA
ggcgcgccagtcctgcgacgtggtgtcgtatggtggaccttggcagttggacacccccaccaccacggaagacctcgtgctgatggcttgcaaaccggataagaccattgagtaccataggtacaggccgggagtcatgagtattgacggtgagcctgtcatgttcattagtgatgatttcggaaaagcgactcggaccgatg

SEQ ID NO: 5343 - DNA, 203 bp, Homo sapiens
  source 1..203: mol_type = other DNA
ggcgcgccagtcctgatcttctggctcaccgttcttcatcaatggcgagcccgtcgggttctatggttttgggttctatgtgaacggtatttaccgctcaacagtagcaggtggcaaaccaaccgatgtcacggagagcttgaactgtgattcgaccaggcggtttgtgacatggcatccaggaaaagcgactcggaccgatg

SEQ ID NO: 5344 - DNA, 203 bp, Homo sapiens
  source 1..203: mol_type = other DNA
ggcgcgccagtccttcggcatgacttttatgctagaggaagctgcatacagccagcctccggggagattcaccctagtgggagaggatagaatgcgatttttaaagcttatggaccgggatgacattcccatttggctggcgtggcactgggcagaagctggagaccgacggcactcagccctgtttccgactcggaccgatg

SEQ ID NO: 5345 - DNA, 203 bp, Homo sapiens
  source 1..203: mol_type = other DNA
ggcgcgccagtcctagggcgcaggaaccggaaagatcatcgaaaaccgatttggcaaacaagagtatcgaccacaatacgttgatgaccgctttgagagcattgagtgggagacgcgaaaggtgtccattgatttctacatgaactgccgcggggggcctaccctctatgagttttttacagtggttgcgactcggaccgatg

SEQ ID NO: 5346 - DNA, 203 bp, Homo sapiens
  source 1..203: mol_type = other DNA
ggcgcgccagtcctccgggccatctttcccaagttgggaaatagcgcaaggaaagggagctacaatgttggactctctgcaggtattcttcttcataacagtgttgtcaacaaaattcctgtattggttccaggagaactggactgcacgaatgtacgctatgaaacatccggagatggttagctcgacgactcggaccgatg

SEQ ID NO: 5347 - DNA, 203 bp, Homo sapiens
  source 1..203: mol_type = other DNA
ggcgcgccagtcctttggtggatttagatttgatgaaattcccttcagggctgtccttccctctggttttgccattgtcgcgattgctagcctcccaagcgtggtggtggggcttctggcagctggtgtgttcatggccatcatgtactgtcagaacaagtggaatgccaccccaaagatcttgacagcgactcggaccgatg

SEQ ID NO: 5348 - DNA, 203 bp, Homo sapiens
  source 1..203: mol_type = other DNA
ggcgcgccagtcctcattggacgctcgcgaccagaggcatgatcgtcccactgaaatcactagtagagtgccactcgaaaacactcgatccatcatgtatgccttttgcctgatcttcagcctgttttgggctttctgcacacggtctcctggagattttctccgagggtcattggtggtcggggctacgactcggaccgatg

SEQ ID NO: 5349 - DNA, 203 bp, Homo sapiens
  source 1..203: mol_type = other DNA
ggcgcgccagtccttggacgtcgttggccgtcgagaccaacgtgggtcagggcaagtagtcacatatgcgttgaacaccataacaaatggtaaggtccaggtggcgagagttttagaaagtgaaggactactgcaagcggatgaatcggtgttggatgcgtggttggaaaaacaccttgaagaagctccgactcggaccgatg

SEQ ID NO: 5350 - DNA, 203 bp, Homo sapiens
  source 1..203: mol_type = other DNA
ggcgcgccagtcctatttgcgcctaggtttcattgctatctcatcggctgtgccaaccaattggttcccactaggacgcacctcgtggtcagtccaccagtatcacgaatggatgaccactgatgatatgcttcgggtttggaatgacgtgtgggtgcacaacaacccgtggatgctaaacaaggagtcgactcggaccgatg

SEQ ID NO: 5351 - DNA, 203 bp, Homo sapiens
  source 1..203: mol_type = other DNA
ggcgcgccagtcctagctctcagtcatgagtcgatatcgaagaggaaatgatgtcatttagacgtgatcgaatagagccgtgaggaaccagcatcctcccggccacaggagcagggcatgaaaatgtcgggcatgacgaacccgctcccccgagtcccctggcaacagggtgtgttcccttatggagccgactcggaccgatg

SEQ ID NO: 5352 - DNA, 203 bp, Homo sapiens
  source 1..203: mol_type = other DNA
ggcgcgccagtccttagccagctgatggtcttaagcatcccccccatggaatgggtaagagaagcctgtaaacaaaactggatggcaccagtgctcttataaaatggcagccaaagcgatccagagctttcaaaactggacggggcaacagggagaaatcccggggtagcgaacctcctccgtaaatgcgactcggaccgatg

SEQ ID NO: 5353 - DNA, 203 bp, Homo sapiens
  source 1..203: mol_type = other DNA
ggcgcgccagtcctattatttgacacaaatcatcaggttagtatctgtaatcagataatagatgcaataaactcagggattgatcttggagatctcctagaagggggtttgctgacgttgtgtgttgagcattactataattctgataaggataaattcaacacaagtcctatcgcgaagtacttacgcgactcggaccgatg

SEQ ID NO: 5354 - DNA, 203 bp, Homo sapiens
  source 1..203: mol_type = other DNA
ggcgcgccagtccttcaaggagtaaatttggtgacaggtcatgatgcctatgacagtatcattagtaattcagtaggtcaaactagattctcaggacttcttatcgtgaaaacagttctcgagttcatcttgcaaaaaactgattcaggggtgacactacatcctttggtgcggacctccaaagtaaacgactcggaccgatg

SEQ ID NO: 5355 - DNA, 203 bp, Homo sapiens
  source 1..203: mol_type = other DNA
ggcgcgccagtcctaaatgaagttgctagtttcaagcaggcgttgagcaacctagcccgacatggggaatacgcaccatttgcacgggttctgaatttatcagggattaacaacctcgaacatggactctatcctcagctttcagcaattgcgctgggtgtggcaacagcacacggcagtacattggccgactcggaccgatg

SEQ ID NO: 5356 - DNA, 203 bp, Homo sapiens
  source 1..203: mol_type = other DNA
ggcgcgccagtccttggtgtcaatgttggcgaacaatatcaacaactacgagaggcggcacatgatgcggaagtaaaactacaaaggcgacatgaacatcaggaaattcaagctattgccgaggatgacgaggaaaggaagatattagaacaattccaccttcagaaaactgaaatcacacacagtcacgactcggaccgatg

SEQ ID NO: 5357 - DNA, 203 bp, Homo sapiens
  source 1..203: mol_type = other DNA
ggcgcgccagtcctgacactagccgtcctcagccagaaacgagaaaaattagctcgtctcgctgcagaaattgaaaacaatattgtggaagatcagggatttaagcaatcacagaatcgggtgtcacagtcgtttttgaatgaccctacacctgtggaagtaacggttcaagccaggcccatgaatcgcgactcggaccgatg

SEQ ID NO: 5358 - DNA, 203 bp, Homo sapiens
  source 1..203: mol_type = other DNA
ggcgcgccagtccttgctcctcaggaagacacaaggatgagggaagcctatgaattgtcgcctgatttcacaaatgatgaggataatcagcagaattggccacaaagagtggtgacaaagaagggtagaactttcctttatcctaatgatcttctgcaaacaaatcctccagagtcacttataacagccgactcggaccgatg

SEQ ID NO: 5359 - DNA, 203 bp, Homo sapiens
  source 1..203: mol_type = other DNA
ggcgcgccagtccttttatttgaatatttgaaccaccttttagtatcctattacttgttactattgtgtgagacaacataagccatcaaataacaatcacgggcaaggactgggcatactatggtggtcttagagcattgtccagtgctacaaattcttttttcaattgctataattatacaactacacgactcggaccgatg

SEQ ID NO: 5360 - DNA, 203 bp, Homo sapiens
  source 1..203: mol_type = other DNA
ggcgcgccagtcctcaaggggatgtcagaaatgttagccaaatacgaccaccttgtaatttcaactggaagaaccactgcaccagctgctgcctttgatgcctacttaaatgagcatggtgtccctccccctcaacccgcgattttcaaagatcttggggttgcccaacaagcttgtagtaaggggaccgactcggaccgatg

SEQ ID NO: 5361 - DNA, 203 bp, Homo sapiens
  source 1..203: mol_type = other DNA
ggcgcgccagtcctgggtgatttaaacctagatgatcagttcaaagggaatgtctgccatgctttcactttagaggcaataattgacatatctgcatataacgagcgaacagtcaaaggcgttccggcatggctgcctcttgggattatgagcaattttgaatatcctttagctcatactgtggccgccgactcggaccgatg

SEQ ID NO: 5362 - DNA, 203 bp, Homo sapiens
  source 1..203: mol_type = other DNA
ggcgcgccagtcctcacctacaatctcactaatttagtattgagtgtgcaaaaacttcctgatgatgcctggcgcccatccaaggacaaattaattgggaacactatgcatcccgcagtctccatccacccgaatctgccgcctattgttctaccaacagtcaagaagcaggcttatcgtcagcacaacgactcggaccgatg

SEQ ID NO: 5363 - DNA, 203 bp, Homo sapiens
  source 1..203: mol_type = other DNA
ggcgcgccagtcctagcacctgagaacttccctttgaatggcttcaataacagacaagttgtgctagcgtatgcgaatccaacgctcagtgccgtttgaaatgatgctcaaatgagacaggagtccatctgtataagaagtatggcttaaatggatatttgtcaaattcttacaagattagtttgtatcgactcggaccgatg

SEQ ID NO: 5364 - DNA, 203 bp, Homo sapiens
  source 1..203: mol_type = other DNA
ggcgcgccagtccttaacatatgtcattgtgccctccattgctaagtcaactcaactgacgataatactccttctgaaatagtaagaaaaactaatgaagaacattaattgctgggtaaaagtgattaatttctttaaatttgaccagaataatattttgtcagtgaatatattctcatatcacttgacgactcggaccgatg

SEQ ID NO: 5365 - DNA, 203 bp, Homo sapiens
  source 1..203: mol_type = other DNA
ggcgcgccagtcctttaaaaacagaaaattaccctaacatgaagaccacatgtttccttatcagtcttatcttaattcaagggacaaaaaatctccccattttagagatagctagtaataatcaaccccaaaatgtggattcggtatgctccggaactctccagaagacagaagacgtccatctgatgcgactcggaccgatg

SEQ ID NO: 5366 - DNA, 203 bp, Homo sapiens
  source 1..203: mol_type = other DNA
ggcgcgccagtcctcctcctaccaacatccgtgactatcctaaatgcaaaactatccatcatattcaaggtcaaaaccctcatgcacaggggatcgcccttcatttatggggagcattttttctgtatgatcgcattgcctccacaacaatgtaccgaggcaaagtcttcactgaagggaacatagcacgactcggaccgatg

SEQ ID NO: 5367 - DNA, 203 bp, Homo sapiens
  source 1..203: mol_type = other DNA
ggcgcgccagtcctaaaaaaggccccgccacaacggcaccaaacacgacaaatgagcatttcaccagtcctccccccacccccagctcgactgcacaacatcttgtatatttcagaagaaagcgaagtatcctctggagggaaggcgacatgttcccttttctggatgggttaataaatgctccaattcgactcggaccgatg

SEQ ID NO: 5368 - DNA, 203 bp, Homo sapiens
  source 1..203: mol_type = other DNA
ggcgcgccagtcctttattgagagtcacaactgaggaaagaacattctccttaatcaatagacatgctattgactttctactcacaagatggggaggaacatgcaaagtgcttggacctgattgttgcatcgggatagaagacttgtccaaaaatatttcagagcaaattgaccaaattaaaaaggaccgactcggaccgatg

SEQ ID NO: 5369 - DNA, 203 bp, Homo sapiens
  source 1..203: mol_type = other DNA
ggcgcgccagtccttaggactttaggacaattgctactgagccctttttctaatctactgaaatcaacttgggagatttttaagaagctgataacttaatgtgaatcaatagtttatgtattatcgattattatggtttgatattcaattgttattattgtcaggagtgaccttttctatttgatgcacgactcggaccgatg

SEQ ID NO: 5370 - DNA, 203 bp, Homo sapiens
  source 1..203: mol_type = other DNA
ggcgcgccagtcctacgtgctgttcaaagagtcttaatttataaccaactattgcaagaattaatttactttttccgttatacttagttacattaatcttttgactgttcagcattattaacgacttgtcttaattcaatcgttcggatgaaattcataaggaaaaatgagcctccttccccctattccgactcggaccgatg

SEQ ID NO: 5371 - DNA, 203 bp, Homo sapiens
  source 1..203: mol_type = other DNA
ggcgcgccagtcctcaacctcgcggaagaagtcgaacccgcaaccaccaagtcacaccgactatatatcatgaaactcaattgccctccaaacctcattataccaattatcatccacgtgcaagatcgatgagctcaacccgtagtagtgcagaaagtagtcccaccaatcatattccccgtgctcgacgactcggaccgatg

SEQ ID NO: 5372 - DNA, 203 bp, Homo sapiens
  source 1..203: mol_type = other DNA
ggcgcgccagtccttaggaacagatttggagctgtttggaatagcagattttgttatttttaaggttccagtaaaaacaataatccgaaatgctgtaagcttacaagcttcaaaaccgggattaagaatatggtaccgtgaccaaaacttgaccccttatctatgcgacgatgagtttattgtaagcgcgactcggaccgatg

SEQ ID NO: 5373 - DNA, 203 bp, Homo sapiens
  source 1..203: mol_type = other DNA
ggcgcgccagtcctaggacggtttcaaattgattaaacacttagaacccttgtgtgtcagctgtatacaaacacatggcatctttacaccaagaaaatactggttccaatcacagatgattaagtcatattatgatgaactccatgatctcaatttgaaacttcaaatttcagacaataaggctgagtcgactcggaccgatg

SEQ ID NO: 5374 - DNA, 203 bp, Homo sapiens
  source 1..203: mol_type = other DNA
ggcgcgccagtcctccctgctagcagatggactggcaaaagcattccctagtaacatgatggttgtcactgagagggaacagaaagaagcattattacatcaggcttcttggcaccacaattcagcaagcataggggagaacgctatagtgaggggtgcaagttttgttactgatcttgagaaatacacgactcggaccgatg

SEQ ID NO: 5375 - DNA, 203 bp, Homo sapiens
  source 1..203: mol_type = other DNA
ggcgcgccagtcctcaattgatgctcccaacgattatcaagagaacgaggctgaattgaatgcggcacgagttgctgtcgaattagctattactacaggttatagtggtatatttttaaagcctgaggaaacatttgtccattcagggttcatttattttggtaaaaagcaatatctcaacggtgttccgactcggaccgatg

SEQ ID NO: 5376 - DNA, 203 bp, Homo sapiens
  source 1..203: mol_type = other DNA
ggcgcgccagtcctactcaaaatcaactataaacttgttgccgtatgactgtaaggaactgcgacttgaaggaagcaatgacacagagttaaattatgtcagttgtgctcttgaccggaaagttgtccagaaacatccctctgttaatcgtctagcttggacgataggaaatcgagcaccgtatattgcgactcggaccgatg

SEQ ID NO: 5377 - DNA, 203 bp, Homo sapiens
  source 1..203: mol_type = other DNA
ggcgcgccagtcctagacggtgcttaactttttacctacacactactcaggcaacatagttcatagatataatgatcaatatggacaacattcctttatggcaaacaggatgagtaatacatctacacgtgcaattatatcaactaacacactgggtaaatatgctgggggaggtcaagctgctattgcgactcggaccgatg

SEQ ID NO: 5378 - DNA, 203 bp, Homo sapiens
  source 1..203: mol_type = other DNA
ggcgcgccagtcctttaagaacctctcagatttgacattccttatatcatccacaatcaggaatttatcacatagatcacttcggattcttcaatctactttccgacatgaattggtgctcacccgactagcccaccacataccgttaatttctttaatgttagggggctctgcaggagagaagagttcgactcggaccgatg

SEQ ID NO: 5379 - DNA, 203 bp, Homo sapiens
  source 1..203: mol_type = other DNA
ggcgcgccagtccttccttataaaatcactagatgcacatgaggactttgatgcctcgaagataatcttaaattctgaaataaataatcttaaccttacggagtatactcttaatacaaagttattgacaactcctaccaggacagaaattttagatacaagtccgttacaatcctctagatattcatcgactcggaccgatg

SEQ ID NO: 5380 - DNA, 203 bp, Homo sapiens
  source 1..203: mol_type = other DNA
ggcgcgccagtccttgaagaatgctattcagtattatgggcaagttcaactcaagaaaccatatagctcaaatgcaaaaaactcagaatggtacttgtgttgcggtaaacgaagaattcaacggctccaaattgatttctcagaccaggtgggaatttttctgatttgtaaagcaatgtcacgccaaacgactcggaccgatg

SEQ ID NO: 5381 - DNA, 203 bp, Homo sapiens
  source 1..203: mol_type = other DNA
ggcgcgccagtcctgcgggtcgccaagatatgtctcaggaccctaagaaatttacagaccctgtgatggatgtcatacacgagatggctcctcccttgaaatcacccagtgctgaagcttgtggttatagtgatcgagttgcccaactcacaattggaaactccacaatcactacacaagaagctgcacgactcggaccgatg

SEQ ID NO: 5382 - DNA, 203 bp, Homo sapiens
  source 1..203: mol_type = other DNA
ggcgcgccagtcctgattcggccctaaaccattgcaactttggcttaattgtagtgcccgtagtaccactcgactttaacgctggagctacatcagaaataccaataactgtcaccatcgcacccatgtgcgctgaatttgcaggtttgcgacaggcaatcaaacaggggatacctaccgagttgaagcgactcggaccgatg

SEQ ID NO: 5383 - DNA, 203 bp, Homo sapiens
  source 1..203: mol_type = other DNA
ggcgcgccagtcctatgcaacgactatgcttccctgtctcggtgcagagtaagacgggggaattgtgtgctgtttttagggccgaccctggtaggaatggaccgtggcagtcgactattttaggacagttgtgtaggtactatactcaatggtctggatctctggaagtcactttcatgtttgctggacgactcggaccgatg

SEQ ID NO: 5384 - DNA, 203 bp, Homo sapiens
  source 1..203: mol_type = other DNA
ggcgcgccagtcctaacatccagggtgatggaattgcagacatgattgaccaggctgtcacttcccgagttggtcgtgcgctgacatccttacaggtagaacctaccgccgccaacaccaatgctagtgagcacagattgggcaccgggctcgtccccgccttgcaggctgcagagaccggcgcctctcgactcggaccgatg

SEQ ID NO: 5385 - DNA, 203 bp, Homo sapiens
  source 1..203: mol_type = other DNA
ggcgcgccagtcctatgggttatgctcaaatgaggcgtaagtgtgagctattcacatacatgcgctttgatgcagagtttacatttgtagctgccaaaccaaacggtgagctagtaccacaattgttgcagtacatgtatgtgcctcccggagctccaaaacctacgtcccgggattcctttgcctggcgactcggaccgatg

SEQ ID NO: 5386 - DNA, 203 bp, Homo sapiens
  source 1..203: mol_type = other DNA
ggcgcgccagtcctgtcgagcggcaccttaatagggcggtgttgatcatgcagtccattgccactgtggtagcagttgtttcactggtgtatgttatctacaaattgtttgcagggttccaaggtgcatactctggtgcccctaagcaaacactcaagaaacctatactccgcacagcgacagtgcaacgactcggaccgatg

SEQ ID NO: 5387 - DNA, 203 bp, Homo sapiens
  source 1..203: mol_type = other DNA
ggcgcgccagtcctgctgttgagttggtggatgaacaaggggtcaacttagaactgaccctggttactcttgataccaatgagaagttcagagacatcaccaagttcatcccagaaaacattagcgctgccagtgatgccaccctagtgatcaacacagagcacatgccctccatgttcgtgccagtgcgactcggaccgatg

SEQ ID NO: 5388 - DNA, 203 bp, Homo sapiens
  source 1..203: mol_type = other DNA
ggcgcgccagtcctaagaggagttattttgccagtgagcaaggagagatccagtgggtcaagcccaataaagagacaggcagactcaacatcaatgggccgactcgcactaagctcgaacccagtgtgttccatgatgtctttgaggggaacaaagaaccagcagtcttgcatagcagagacccacgccgactcggaccgatg

SEQ ID NO: 5389 - DNA, 203 bp, Homo sapiens
  source 1..203: mol_type = other DNA
ggcgcgccagtcctcttgaagtggactttgagcaggctttattctccaagtatgtagggaacacactgcatgagcctgacgagtacatcaaagaggcggccctccactatgcaaatcagttgaagcaactggacatcaacacttctcaaatgagtatggaggaagcttgctatggtactgagaaccttcgactcggaccgatg

SEQ ID NO: 5390 - DNA, 203 bp, Homo sapiens
  source 1..203: mol_type = other DNA
ggcgcgccagtcctctgcttccaggttcactctttgcatttgattactcaggctatgatgctagtctcagtccagtctggtttagagcactggagctggtcctcagggaggtgggctatagtgaggaggcagtctcccttatagaggggattaaccatacacaccatgtataccgcaataaaacttaccgactcggaccgatg

SEQ ID NO: 5391 - DNA, 203 bp, Homo sapiens
  source 1..203: mol_type = other DNA
ggcgcgccagtcctgattgcctggaattggcaagaacaggcaaagagtatggtttgactatgactcctgcagacaaatctccttgcttcaatgaggtaaattggggcaatgcaacctttctcaaaagaggcttcttgcccgatgagcaattccctttcttgatccatcctaccatgccaatgaaggagcgactcggaccgatg

SEQ ID NO: 5392 - DNA, 203 bp, Homo sapiens
  source 1..203: mol_type = other DNA
ggcgcgccagtccttgtttccccggtcaatgaggatatgctttacccaaggcaaaaaccttagagatcgttatccccacactgcctacacagagcccagtaccatttttgatataattgggttggtcgctccctgcaaacccagcagtagacctggcagatgaggctggacattccccactggcgacacgactcggaccgatg

SEQ ID NO: 5393 - DNA, 203 bp, Homo sapiens
  source 1..203: mol_type = other DNA
ggcgcgccagtcctgtggtccagcctgcgtggctgcctgctcacccttcttgggtgagaagcctaattattgacaaggtgtgaagagccgcgtgtgctcagtgtgcttcctccggcccctgaatgtggctaaccttaaccctgcagccgttgcccataatccaatgggtttgcggtcgtaatgcgtaacgactcggaccgatg

SEQ ID NO: 5394 - DNA, 203 bp, Homo sapiens
  source 1..203: mol_type = other DNA
ggcgcgccagtcctgtgcgggatgggaccaactactttgggtgtccgtgtttcctgtttttcttttgattgcattttatggtgacaatttatagtgtatagattgtcatcatgggtgcacaagtatctagacaaaatgttgggacacactccacacaaaattcagtgagcaatggatctagcttaaatcgactcggaccgatg

SEQ ID NO: 5395 - DNA, 203 bp, Homo sapiens
  source 1..203: mol_type = other DNA
ggcgcgccagtcctttggcatctgcaacaagtggaaatgtatcagtcgggtacaatcacacccacccaggtgagcaaggtagagaagtagtaccatcacggacatctagtgataataaaagacctagtgatgacagttggttaaattttgatggaacattacttggtaacttacctatttatccccaccgactcggaccgatg

SEQ ID NO: 5396 - DNA, 203 bp, Homo sapiens
  source 1..203: mol_type = other DNA
ggcgcgccagtcctcaatacattaatctaaggactaacaattcagctacccttattttaccttatgtcaatgctgtaccaatggactctatgcttagacataataattggagcttggttataatcccaatatgccctcttcaggtccaacctggggggacacaatccatacctataacagtatcaattcgactcggaccgatg

SEQ ID NO: 5397 - DNA, 203 bp, Homo sapiens
  source 1..203: mol_type = other DNA
ggcgcgccagtcctcaagttaggaatttaattgaaatgtgccaagttgacacactcattcctgttaacaatacacaggaaaatgtaagatctgtgaatatgtacactgttgatttacgcacacaagttgatttagctaaagaagtcttttctataccagtagatattgcctcacaacctttagccactcgactcggaccgatg

SEQ ID NO: 5398 - DNA, 203 bp, Homo sapiens
  source 1..203: mol_type = other DNA
ggcgcgccagtcctgtttctgcatgcaaagatttttgcttaagattagccagagatactaacctacacacacaagaaggagtactcacacaaaacccagttgaaaattatatagatagtgtattaaatgaagttcttgtggtgccaaatatccaacctagcacatctgtgtcaagtcatgcagcgcctcgactcggaccgatg

SEQ ID NO: 5399 - DNA, 203 bp, Homo sapiens
  source 1..203: mol_type = other DNA
ggcgcgccagtcctattgccactctcacccttctaggttgttcaggctcaccatggaggtttcttaaagagaaactctgtgcgtggctccagcttagctatgtacataagcagtctgattcatggctcaagaaatttactgaagcgtgtaacgcagcacgtgggctagagtggattggacaaaagatacgactcggaccgatg

SEQ ID NO: 5400 - DNA, 203 bp, Homo sapiens
  source 1..203: mol_type = other DNA
ggcgcgccagtccttccttaaaattcttaccactgtatgcatctgaagcacgtagaattaagaatttatatatcaaatgcagtaatgttattaaagggggaaagaggaatgaaccagttgcagttctaatacatggttctcctggtactggaaaatctcttgccacttctgttcttgctcgaatgctacgactcggaccgatg

SEQ ID NO: 5401 - DNA, 203 bp, Homo sapiens
  source 1..203: mol_type = other DNA
ggcgcgccagtcctagctttcgaccatgtgatgttaatattaaaataggcaatgctaagtgctgtccatttatctgtggaaaagctgtagagtttaaagatagaaattcatgtacaaccttgtctttatctcaattgtatagtcatataaaggaagaagataggagaagaagcagtgcagcacaagcacgactcggaccgatg

SEQ ID NO: 5402 - DNA, 203 bp, Homo sapiens
  source 1..203: mol_type = other DNA
ggcgcgccagtcctatggaggctatatttcaaggtatagacctccaatctcctccacctccagccatagctgacctccttaggtctgtgaaaacaccagagatcattaagtattgccaagataataattggattgttccagcagagtgttctattgaaagagatttagggatagcaaatatgactatacgactcggaccgatg

SEQ ID NO: 5403 - DNA, 203 bp, Homo sapiens
  source 1..203: mol_type = other DNA
ggcgcgccagtcctaattgctgtgttgtgacaaccgacaaaggcaaattcacaggtcttggcatatatgaccaagtcatggtacttccaacacattctgacccaggctctgagatcttggtagatggagtaaaagttaaggtctctgattcctatgatttgcataaccatgagggtgttaagctagagcgactcggaccgatg

SEQ ID NO: 5404 - DNA, 203 bp, Homo sapiens
  source 1..203: mol_type = other DNA
ggcgcgccagtcctaaagaacttcctgtatctgtaaagaacttaccatccgtacatgtttcatctaaaacccgactacaacctagtgtttttcatgatgttttccctggaacaaaagagcctgcagttcttagtagtaatgatccaagactagaaactgactttgactcagcacttttctccaaatatcgactcggaccgatg

SEQ ID NO: 5405 - DNA, 203 bp, Homo sapiens
  source 1..203: mol_type = other DNA
ggcgcgccagtccttttaatacaataatcaacaatattatcattagaactttggtactagatgcttataagaacatagatctagataaactgaaaatcttagcatatggggatgatgtcatcttttcttataattttaaacttgacatggcagttcttgccaaagaaggagaaaaatatggactaacacgactcggaccgatg

SEQ ID NO: 5406 - DNA, 203 bp, Homo sapiens
  source 1..203: mol_type = other DNA
ggcgcgccagtcctgaacacgtgctatctttgtgtcatttaatgtggcataatggtagacatgcataccaggaattcattaaaggtatacgcagtgtatctgccggtcgggcactgtatataccagcttatgaagttcttgaacatgaatggtatgaaaaattttagatataaaactgttaaatatagcgactcggaccgatg

SEQ ID NO: 5407 - DNA, 203 bp, Homo sapiens
  source 1..203: mol_type = other DNA
ggcgcgccagtcctagacgtgattctggtcgcccggagatcaagcatggaagccgtcataaaggtgatttcgtccgcgtgtaaaacctattgcggaaaaacctctccttctaagaaggaaatcggggccatgttgtccctcttacaaaaagaagggttgcttatgtctccctcagacttatattcccccgactcggaccgatg

SEQ ID NO: 5408 - DNA, 203 bp, Homo sapiens
  source 1..203: mol_type = other DNA
ggcgcgccagtcctgagctgctcccgagtggtaaagattggtgattttggacttgccagagatatctataaaaatgattactacaggaaaagaggagaaggcctactccctgtcagatggatggctcctgaaagcctcattgatggcgtctttacaaatcactctgatgtttgggcttttggagtcttcgactcggaccgatg

SEQ ID NO: 5409 - DNA, 203 bp, Homo sapiens
  source 1..203: mol_type = other DNA
ggcgcgccagtcctagtgtgggaaacattaactttgggtcaacagccatatccgggtctctccaatatagaagttttacaccatgtacgatcaggaggaaggctggaatctccgaataactgtcctgatgacatacgtgatttaatgacaagatgctgggcccaagatcctcacaacagacctactttcgactcggaccgatg

SEQ ID NO: 5410 - DNA, 203 bp, Homo sapiens
  source 1..203: mol_type = other DNA
ggcgcgccagtcctttctagctcacggtcatggctgtgaggacattgccggaatgtgttgtttcaatctgagtgatcacagtgagtctatacagaaaaagttccaactaatgaaggaacatgtcaataagatcggcgtggacagcgacccaatcggaagttggctgcgaggactattcggaggaatagcgactcggaccgatg

SEQ ID NO: 5411 - DNA, 203 bp, Homo sapiens
  source 1..203: mol_type = other DNA
ggcgcgccagtcctcttgcgaatcgggctgtaacggggaaggcttgactaggggaccatggtatgtataggcggaaggcggggcttcggttgtacgcggttaggagtcccctcaggatatagtagttgcgcttctgcatagggagggggaaatgtagtcttatgcaatactcttatgtaacgatgaaacgactcggaccgatg

SEQ ID NO: 5412 - DNA, 203 bp, Homo sapiens
  source 1..203: mol_type = other DNA
ggcgcgccagtcctcctcgacgagtgtcgaaagagaccgcaacgaagacgcgtcaacccagagtccaaatgccaaatgggcttgtgttgatgcgcatgatggggatcttgtggcatgccgtagccggcaccgcgagaaaccccgtattgaaggcgttctggaactcagtccctctgaaacaggcaacacgactcggaccgatg

SEQ ID NO: 5413 - DNA, 203 bp, Homo sapiens
  source 1..203: mol_type = other DNA
ggcgcgccagtcctgcagcactgcggaagatcaaaaggacggtgagtgccctaatggttggcttgcaaaaacgtgggaaaaggaggtcagcgacggactggatgagctggttgctggtcatcactctgttggggatgacgcttgctgcaacggtgaggaaagaaagggatggctcaactgtgatcagacgactcggaccgatg

SEQ ID NO: 5414 - DNA, 203 bp, Homo sapiens
  source 1..203: mol_type = other DNA
ggcgcgccagtcctcttgccttggcaatggttaccgttgtgtggttgaccctggagagtgtggtgaccagggttgccgttcttgttgtgctcctgtgtttggcaccggtttacgcttcgcgttgcacacacttggaaaacagggactttgtgactggtactcaggggactacgagggtcaccttggtgcgactcggaccgatg

SEQ ID NO: 5415 - DNA, 203 bp, Homo sapiens
  source 1..203: mol_type = other DNA
ggcgcgccagtcctatccttgagcttgacaagacagtggaacaccttccaacggcttggcaggtccatagggactggttcaatgatctggctctgccatggaaacatgagggagcgcaaaactggaacaacgcagaaagactggttgaatttggggctcctcacgctgtcaagatggacgtgtacaaccgactcggaccgatg

SEQ ID NO: 5416 - DNA, 203 bp, Homo sapiens
  source 1..203: mol_type = other DNA
ggcgcgccagtcctctcggagaccagactggagtgttactgaaggctctcgctggggttcctgtggcacacattgagggaaccaagtaccacctgaagagtggccacgtgacctgcgaagtgggactggaaaaactgaagatgaaaggtcttacgtacacaatgtgtgacaaaacaaagttcacatggcgactcggaccgatg

SEQ ID NO: 5417 - DNA, 203 bp, Homo sapiens
  source 1..203: mol_type = other DNA
ggcgcgccagtcctagttcaattgggaaggcggtacatacggtccttggtggcgctttcaacagcatcttcgggggagtggggtttctaccaaaacttttattaggagtggcattggcttggttgggcctgaacatgagaaaccctacaatgtccatgagctttctcttggctggaggtctggtcttgcgactcggaccgatg

SEQ ID NO: 5418 - DNA, 203 bp, Homo sapiens
  source 1..203: mol_type = other DNA
ggcgcgccagtccttcatggcctgctagccacactatcgataatgctgacgtggtggactcagagttattccttccggcgagcctggcaggacccagatcctggtacaacaggatacctggctattcagaacaggtgaaagggccatggaagtacacgcctatccgagttatcagagaggagtgtccccgactcggaccgatg

SEQ ID NO: 5419 - DNA, 203 bp, Homo sapiens
  source 1..203: mol_type = other DNA
ggcgcgccagtcctggcacgaccgttaccatcaacgccaagtgtgacaaaagaggagcatctgtgaggagtaccacagagagtggcaaggttatcccagaatggtgctgccgagcgtgcacaatgccaccagtgacgttccggactggaactgattgctggtatgccatggaaatacggccagtccatcgactcggaccgatg

SEQ ID NO: 5420 - DNA, 203 bp, Homo sapiens
  source 1..203: mol_type = other DNA
ggcgcgccagtcctgtcaccgggatggtcaggatagagagcctggtgcgctatgtggtggcagtggggatcacattccaccttgagctggggccagagatcgtggccttgatgctactccaggctgtgtttgagctgagggtgggtttgctcagcgcatttgcattgcgcagaagcctcaccgtccgacgactcggaccgatg

SEQ ID NO: 5421 - DNA, 203 bp, Homo sapiens
  source 1..203: mol_type = other DNA
ggcgcgccagtcctcagcaggatgtggtgactgtgcaccatggactggtgtgcttcctaagtgtagcttcggcatgctcggtctggaggctgctcaagggacacagagagcagaagggattgacctgggttgtccccctggctgggttgcttgggggagagggctctggaatcagactgctggcgtttcgactcggaccgatg

SEQ ID NO: 5422 - DNA, 203 bp, Homo sapiens
  source 1..203: mol_type = other DNA
ggcgcgccagtccttggggtcagaaccaggtgggagttggctacggttccaagggtgtcttgcacacgatgtggcacgtgacgagaggagcggcgctgtctattgatgacgctgtggccggtccctactgggctgatgtgagggaagatgtcgtgtgttacggaggagcctggagcctggaggaaaaacgactcggaccgatg

SEQ ID NO: 5423 - DNA, 203 bp, Homo sapiens
  source 1..203: mol_type = other DNA
ggcgcgccagtcctagagtcctcccggagctcattcgccaatgcattgacaggcgcctgagaacgttggtgttggctccaactcgtgtggtactcaaagaaatggagcgtgctttgaatgggaaacgggtcaggttccactcaccagcagtcagtgaccaacaggctggaggggcaattgtcgatgtgcgactcggaccgatg

SEQ ID NO: 5424 - DNA, 203 bp, Homo sapiens
  source 1..203: mol_type = other DNA
ggcgcgccagtcctatgtgtcacgcaacctatgtcaacagaaggctactcccacagggaagacaaaattgggaggtggcaatcatggatgaggcccactggacggacccccacagcatagctgccagaggtcatttgtatactctggcaaaagaaaacaagtgtgcactggtcttgatgacagcgacacgactcggaccgatg

SEQ ID NO: 5425 - DNA, 203 bp, Homo sapiens
  source 1..203: mol_type = other DNA
ggcgcgccagtcctcctcctggtaagagtgaaccctttccggagtccaatggagccattactagtgaggaaagacagattcctgatggggagtggcgtgacgggtttgactggatcactgagtatgaagggcgcaccgcctggtttgtcccttcgattgcaaaaggtggtgctatagctcgcaccttgcgactcggaccgatg

SEQ ID NO: 5426 - DNA, 203 bp, Homo sapiens
  source 1..203: mol_type = other DNA
ggcgcgccagtcctagacagaaggggaaaagtgtgatttgtttgaacagcaaaacctttgaaaaggactactccagagtgagggatgagaagcctgactttgtggtgacgactgatatctcggagatgggagctaaccttgacgtgagccgcgtcatagatgggaggacaaacatcaagcccgaggagcgactcggaccgatg

SEQ ID NO: 5427 - DNA, 203 bp, Homo sapiens
  source 1..203: mol_type = other DNA
ggcgcgccagtccttttctgactatggttgagatgatggtgctgggtttggcaaccctgggtgtcatctggtgcttcgtcgtccggacttcaatcagccgcatgatgctgggcacgctggtcctgctggcctccttgctactcttgtgggcaggtggcgtcggctatgggaacatggctggagtggctcgactcggaccgatg

SEQ ID NO: 5428 - DNA, 203 bp, Homo sapiens
  source 1..203: mol_type = other DNA
ggcgcgccagtcctctcatcttttacacgttgctgacggtgctgcagcctgaggcgggaaaacagagaagcagtgacgacaacaaactggcatatttcttgctgacgctctgcagccttgctggactggttgcagccaatgagatgggctttctggagaagaccaaggcagacttgtccacggcgctgcgactcggaccgatg

SEQ ID NO: 5429 - DNA, 203 bp, Homo sapiens
  source 1..203: mol_type = other DNA
ggcgcgccagtccttggagtgaacgggaggaaccccggccatggagtgaatggacgaatgtggacatccagccagcgaggtcctgggggacctatgtgctggtggtgtctctgttcacaccttacatcatccaccaactgcagaccaaaatccaacaacttgtcaacagtgccgtggcatctggtgcacgactcggaccgatg

SEQ ID NO: 5430 - DNA, 203 bp, Homo sapiens
  source 1..203: mol_type = other DNA
ggcgcgccagtcctcaggccatgagagaccttgggggaggtgcccccttctttggtgtggcgggacatgtcatgaccctcggggtggtgtcactgattggggctactcccacctcactgatggtgggcgttggcttggcggcactccatctggccattgtggtgtctggtctggaggctgaattaacacgactcggaccgatg

SEQ ID NO: 5431 - DNA, 203 bp, Homo sapiens
  source 1..203: mol_type = other DNA
ggcgcgccagtcctaagatggtaacaagcctgggttggaacttgattaaattcagatcaggaatggacgtgttcagcatgcagccacaccgggctgacactgtcatgtgtgacatcggagagagcagcccagatgccgctgtggagggtgagaggacaaggaaagtgatactgctcatggagcaatggcgactcggaccgatg

SEQ ID NO: 5432 - DNA, 203 bp, Homo sapiens
  source 1..203: mol_type = other DNA
ggcgcgccagtcctgtgaaatcaaatgcagccttgggagcttggtcagatgagcaaaacagatgggcaagtgcaagagaggctgtagaggatcctgcattctggcgcctcgtggatgaagagagagaaaggcacctcatggggagatgtgcgcactgcgtgtacaacatgatgggcaagagagaaaagcgactcggaccgatg

SEQ ID NO: 5433 - DNA, 203 bp, Homo sapiens
  source 1..203: mol_type = other DNA
ggcgcgccagtcctgtcgtgaaggtcgcgaggccttcccgtgatggaggctgcatcatggatgtcatcacaagaagagaccaaagaggttcgggtcaggttgtgacctatgcccttaacaccctcaccaacataaaggtgcaattaatccgaatgatggaaggggaaggggtcatagaggcagcggatcgactcggaccgatg

SEQ ID NO: 5434 - DNA, 203 bp, Homo sapiens
  source 1..203: mol_type = other DNA
ggcgcgccagtcctgaatgggagcactcagccggcttttcaagctgggaggaggtacccttttgttcacaccatttccacgagctagtgatgaaggatggacgcaccctggtggtgccgtgccgagaccaagatgaactcgttgggagggcgcgcatctcaccggggtgcggctggagtgtccgcgagcgactcggaccgatg

SEQ ID NO: 5435 - DNA, 203 bp, Homo sapiens
  source 1..203: mol_type = other DNA
ggcgcgccagtcctacgtgggggagttgatcccccccccccggcactgggtgcaagccccagaaaccgacgcctatctaagtagacgcaatgactcggcgccgactcggcgaccggccaaaaggtggtggatgggtgatgacagggttggtaggtcgtaaatcccggtcaccttggtagccactatagcgactcggaccgatg

SEQ ID NO: 5436 - DNA, 203 bp, Homo sapiens
  source 1..203: mol_type = other DNA
ggcgcgccagtcctagtggcccctttcatgcccccagtatgtctatgggtctgctacagtcacttgcgtgtggggttccgcttcttggtttgcctccaccagtggtcgcgactcgaagatagatgtgtggagtttagtgccagttggctctgccacctgcaccatagccgcacttggatcatcggatccgactcggaccgatg

SEQ ID NO: 5437 - DNA, 203 bp, Homo sapiens
  source 1..203: mol_type = other DNA
ggcgcgccagtcctgcgacacggtgcctgggctctccgagtggggaatcccgtgcgtgacgtgtgttctggaccgtcggcctgcctcctgcggcacctgtgtgagggactgctggcccgagaccgggtcggttaggttcccattccatcggtgcggcgtggggcctcggctgacaaaggacttggaagcgactcggaccgatg

SEQ ID NO: 5438 - DNA, 203 bp, Homo sapiens
  source 1..203: mol_type = other DNA
ggcgcgccagtcctctgtgcccttcgtcaacaggacaactcccttcaccattagggggcccctgggcaaccagggccgaggcaacccggtgcggtcgcccttgggttttgggtcctacgccatgaccaggatccgagataccctacatctggtggagtgtcccacaccagccattgagcctcccaccgcgactcggaccgatg

SEQ ID NO: 5439 - DNA, 203 bp, Homo sapiens
  source 1..203: mol_type = other DNA
ggcgcgccagtcctgcctgatgttcctcgtgttgtggaagcttgctcggggagctttcccgctggccctcttgatggggatttcggcgacccgcgggcgcacctcagtgctcggggccgagttctgcttcgatgctacattcgaggtggacacttcggtgttgggctgggtggtggccagtgtggtagcgactcggaccgatg

SEQ ID NO: 5440 - DNA, 203 bp, Homo sapiens
  source 1..203: mol_type = other DNA
ggcgcgccagtcctcttgggccattgcgctcctgagctcgatgagcgcaggggggtggaggcacaaagccgtgatctataggacgtggtgtaaggggtaccaggcaatccgtcaaagggtggtgaggagccccctcggggaggggcggcctgccaaacccctgacctttgcctggtgcttggcctcgtcgactcggaccgatg

SEQ ID NO: 5441 - DNA, 203 bp, Homo sapiens
  source 1..203: mol_type = other DNA
ggcgcgccagtcctagtgcgtcatgggtttacccgtggttgcgcgccgtggtgatgaggttctcatcggcgtcttccaggatgtgaatcatttgcctcccgggtttgttccgaccgcgcctgttgtcatccgacggtgcggaaagggcttcttgggggtcacaaaggctgccttgacaggtcgggatccgactcggaccgatg

SEQ ID NO: 5442 - DNA, 203 bp, Homo sapiens
  source 1..203: mol_type = other DNA
ggcgcgccagtcctctgacttacatccagggaacgtcatggtgttggggacggctacgtcgcgaagcatgggaacatgcttgaacggcctgctgttcacgaccttccatggggcttcatcccgaaccatcgccacacccgtgggggcccttaatcccagatggtggtcagccagtgatgatgtcacggcgactcggaccgatg

SEQ ID NO: 5443 - DNA, 203 bp, Homo sapiens
  source 1..203: mol_type = other DNA
ggcgcgccagtccttcacaaggatcactgactcccccctgacgtattcaacctatgggaggtttttggccaaccctaggcagatgctacggggcgtttcggtggtcatttgtgatgagtgccacagtcatgactcaaccgtgctgttaggcattgggagagtccgggagctggcgcgtgggtgcggggcgactcggaccgatg

SEQ ID NO: 5444 - DNA, 203 bp, Homo sapiens
  source 1..203: mol_type = other DNA
ggcgcgccagtccttgcaactagtgctctacgccaccgctacacctcccggatcccctatgacgcagcacccttccataattgagacaaaattggacgtgggcgagattcccttttatgggcatggaatacccctcgagcggatgcgaaccggaaggcacctcgtgttctgccattctaaggctgagtcgactcggaccgatg

SEQ ID NO: 5445 - DNA, 203 bp, Homo sapiens
  source 1..203: mol_type = other DNA
ggcgcgccagtcctgcgagcgccttgctggccagttctccgctaggggggtcaatgccattgcctattataggggtaaagacagttctatcatcaaggatggggacctggtggtctgtgctacagacgcgctttccactgggtacactggaaatttcgactccgtcaccgactgtggattagtggtggcgactcggaccgatg

SEQ ID NO: 5446 - DNA, 203 bp, Homo sapiens
  source 1..203: mol_type = other DNA
ggcgcgccagtcctgctgggcaaaagttcgcggcgtcaactggcccctcttggtgggtgttcagcggaccatgtgtcgggaaacactgtctcccggcccatcggatgacccccaatgggcaggtctgaagggcccaaatcctgtcccactcctgctgaggtggggcaatgatttaccatctaaagtggcgactcggaccgatg

SEQ ID NO: 5447 - DNA, 203 bp, Homo sapiens
  source 1..203: mol_type = other DNA
ggcgcgccagtcctgagaagtgttgtccttggctcaggctaagacggccgaggcctacacagcaaccgccaagtggctcgctggctgctatacggggacgcgggccgttcccactgtatccattgttgacaagctcttcgccggagggtgggcggctgtggtgggccattgccacagcgtgattgctgcgactcggaccgatg

SEQ ID NO: 5448 - DNA, 203 bp, Homo sapiens
  source 1..203: mol_type = other DNA
ggcgcgccagtcctgccttgcggggatcgctctcgggttggttttgtattcagctaacaactctggcactaccacttggttgaaccgtctgctgactacgttaccaaggtcttcatgtatcccggacagttactttcagcaagttgactattgcgacaaggtctcagccgtgctccggcgcctgagcccgactcggaccgatg

SEQ ID NO: 5449 - DNA, 203 bp, Homo sapiens
  source 1..203: mol_type = other DNA
ggcgcgccagtccttcacccgcacagtggttgccctggtcaacagggagcctaaggtggatgaggtacaggtggggtatgtctgggacctgtgggagtggatcatgcgccaagtgcgcgtggtcatggccagactcagggccctctgccccgtggtgtcactacccttgtggcattgcggggaggggtcgactcggaccgatg

SEQ ID NO: 5450 - DNA, 203 bp, Homo sapiens
  source 1..203: mol_type = other DNA
ggcgcgccagtcctcatcgccagcacttatctcggttactgagagcagctcagatgagaagaccccgtcggtgtcctcctcgcaggaggataccccgtcctctgactcattcgaggtcatccaagagtccgagacagccgaaggggaggaaagtgtcttcaacgtggctctttccgtattaaaagcctcgactcggaccgatg

SEQ ID NO: 5451 - DNA, 203 bp, Homo sapiens
  source 1..203: mol_type = other DNA
ggcgcgccagtccttatttccacagagcgacgcgaccaggaagcttaccgtcaagatgtcgtgctgcgttgaaaagagcgtcacgcgctttttctcattggggttgacggtggctgatgttgctagcctgtgtgagatggaaatccagaaccatacagcctattgtgaccaggtgcgcactccgcttgcgactcggaccgatg

SEQ ID NO: 5452 - DNA, 203 bp, Homo sapiens
  source 1..203: mol_type = other DNA
ggcgcgccagtcctaattgcaggttgggtgcttggtgggcaatgaacttacctttgaatgtgacaagtgtgaggctaggcaagaaaccttggcctccttctcttacatttggtctggagtgccgctgactagggccacgccggccaagcctcccgtggtgaggccggttggctctttgttagtggccgcgactcggaccgatg

SEQ ID NO: 5453 - DNA, 203 bp, Homo sapiens
  source 1..203: mol_type = other DNA
ggcgcgccagtcctacactactaaggtgtatgttaccaatccagacaatgtgggacggagggtggacaaggtgaccttctggcgtgctcctagggttcatgataagtacctcgtggactctattgagcgcgctaagagggccgctcaagcctgcctaagcatgggttacacttatgaggaagcaataacgactcggaccgatg

SEQ ID NO: 5454 - DNA, 203 bp, Homo sapiens
  source 1..203: mol_type = other DNA
ggcgcgccagtcctggactgtaaggccacatgctgccatgggctggggatctaaggtgtcggttaaggacttagccacccccgcggggaagatggccgtccatgaccggcttcaggagatacttgaagggactccggtcccctttactcttactgtgaaaaaggaggtgttcttcaaagaccggaaggcgactcggaccgatg

SEQ ID NO: 5455 - DNA, 203 bp, Homo sapiens
  source 1..203: mol_type = other DNA
ggcgcgccagtcctgcgacgctttgggcagagccctagcgagctatgggtacgcgtgcgagccctcatatcatgcatcattggacacggcccccttctgctccacttggcttgctgagtgcaatgcagatgggaagcgccatttcttcctgaccacggacttccggaggccgctcgctcgcatgtcgacgactcggaccgatg

SEQ ID NO: 5456 - DNA, 203 bp, Homo sapiens
  source 1..203: mol_type = other DNA
ggcgcgccagtcctgtgagtatagtgacccgatggcttcggcgatcggttacatcctcctttatccttggcaccccatcacacggtgggtcatcatccctcatgtgctaacgtgcgcattcaggggtggaggcacaccgtctgatccggtttggtgccaggtgcatggtaactactacaagtttccaccgactcggaccgatg

SEQ ID NO: 5457 - DNA, 203 bp, Homo sapiens
  source 1..203: mol_type = other DNA
ggcgcgccagtccttggacaaactgcctaacatcatcgtggccctccacggaccagcagcgttgagggttaccgcagacacaactaaaacaaagatggaggctggtaaggttctgagcgacctcaagctccctggcttagcagtccaccgaaagaaggccggggcgttgcgaacacgcatgctccgctcgactcggaccgatg

SEQ ID NO: 5458 - DNA, 203 bp, Homo sapiens
  source 1..203: mol_type = other DNA
ggcgcgccagtcctcgcgcggttgggctgagttggctaggggcttgttgtggcatccaggcctacggcttcctccccctgagattgctggtatcccggggggtttccctctctcccccccctatatgggggtggtacatcaattggatttcacaagccagaggagtcgctggcggtggttggggttctcgactcggaccgatg

SEQ ID NO: 5459 - DNA, 203 bp, Homo sapiens
  source 1..203: mol_type = other DNA
ggcgcgccagtccttagccctgctcatcgtagccctcttcgggtgaactaaattcatctgttgcggcaaggtctggtgactgatcatcaccggaggaggttcccgccctccccgccccaggggtctccccgctgggtaaaaagggcccggccttgggaggcatggtggttactaaccccctggcagggcgactcggaccgatg

SEQ ID NO: 5460 - DNA, 203 bp, Homo sapiens
  source 1..203: mol_type = other DNA
ggcgcgccagtccttgtataaatgtacccgcttcttgcattgtattcagtcgctctgcggagaggctggcagatcgagccctgagaggttctctccagcactagcaggtagagcctgggtgttccctgctggactctcaccagtacttggccggtactgggcagacggctccacgcttgcttgcttaacgactcggaccgatg

SEQ ID NO: 5461 - DNA, 203 bp, Homo sapiens
  source 1..203: mol_type = other DNA
ggcgcgccagtcctagacctcttcaataaagctgccagttagaagcaagttaagtgtgtgttcccatctctcctagtcgccgcctggtcattcggtgttcatctgagtaacaagaccctggtctgttaggacccttctcgctttgggaatccaaggcaggaaaatccctagcaggttggcgcccgaaccgactcggaccgatg

SEQ ID NO: 5462 - DNA, 203 bp, Homo sapiens
  source 1..203: mol_type = other DNA
ggcgcgccagtcctagggacttgaagaggactgagaagccctggaactcggctgagtgaaggcagtaagggcggcaggaacaaaccacgacggagtgctcctagaaaggcgcgggccgaggtaccaaaggcggcgtgtggagcgggagtgaaagaggcctccgggtgaaggtaagtacctacaccaaacgactcggaccgatg

SEQ ID NO: 5463 - DNA, 203 bp, Homo sapiens
  source 1..203: mol_type = other DNA
ggcgcgccagtccttgaggaagcaaagaaactagcacagagacatctagtggcagaaactggaactgcagagaaaatgccaaatacaagtagaccaacagcaccacctagtgggaaaagaggaaactaccccgtgcaacaagcgggtggcaactatgtccatgtgccactgagcccccgaactctaaacgactcggaccgatg

SEQ ID NO: 5464 - DNA, 203 bp, Homo sapiens
  source 1..203: mol_type = other DNA
ggcgcgccagtccttgcatgggtaaaattagtggaggaaaagaagttcggggcagaagtagtgccaggatttcaggcactctcagaaggctgcacgccctatgatattaatcaaatgcttaattgtgtgggcgatcaccaagcagctatgcaaataatcagagagattattaatgaagaagcagcagacgactcggaccgatg

SEQ ID NO: 5465 - DNA, 203 bp, Homo sapiens
  source 1..203: mol_type = other DNA
ggcgcgccagtcctcccagactgcaagttagtactaaaaggactggggatgaatcccaccctagaagagatgctaaccgcctgccagggggtaggcggaccaggccagaaagccaggctaatggctgaagccctaaaagaggctatgggaccaagccctatcccatttgcagcagcccaacaaagaaacgactcggaccgatg

SEQ ID NO: 5466 - DNA, 203 bp, Homo sapiens
  source 1..203: mol_type = other DNA
ggcgcgccagtcctccccgtgacccaagcccctcaggggctgataccaacagcacctccggcagatccagcagcggaactgttggagagatatatgcagcaagggagaaagcagagggagcagagggagagaccatacaaagaggtgacggaggacttgctgcacctcgagcagagagagacacctcacgactcggaccgatg

SEQ ID NO: 5467 - DNA, 203 bp, Homo sapiens
  source 1..203: mol_type = other DNA
ggcgcgccagtccttttgtatctaccccaccactggtcaggttaacatttaacctagtaggagatcctataccaggcgcagagaccttctacacagatggatcatgcaatagacagtcaaaagagggaaaagcaggatatgtaacagatagaggaaaagacaaagtaaaagtattagaacaaactacccgactcggaccgatg

SEQ ID NO: 5468 - DNA, 203 bp, Homo sapiens
  source 1..203: mol_type = other DNA
ggcgcgccagtcctcttctagtagcaagacagatagtaaactcatgtgcccaatgccaacagaaaggagaagccatacatgggcaagtaaatgcagaaataggcgtttggcaaatggactacacacacttagaaggaaaaatcattatagtagcagtacatgttgcaagtggattcatagaagcagaacgactcggaccgatg

SEQ ID NO: 5469 - DNA, 203 bp, Homo sapiens
  source 1..203: mol_type = other DNA
ggcgcgccagtcctgtcatcccacaggaatcaggaaggcagacagcactcttcctattaaaactggccagtaggtggccaataacgcacttgcacacagacaatggccccaacttcacttcacaggaagtgaagatggtggcatggtgggtaggtatagaacaatcctttggagtaccttacaacccacgactcggaccgatg

SEQ ID NO: 5470 - DNA, 203 bp, Homo sapiens
  source 1..203: mol_type = other DNA
ggcgcgccagtcctattaccacagaacaagaaatacaattcctccaaagaaaaaattcaaattttaaaaatttccaggtctattacagagaaggcagagatcagctgtggaaaggacctggtgaactactgtggaagggagaaggagcagtcatagtcaaggtagggacagacataaaagtagtaccacgactcggaccgatg

SEQ ID NO: 5471 - DNA, 203 bp, Homo sapiens
  source 1..203: mol_type = other DNA
ggcgcgccagtcctagaaggaaggccaagattatcagggactatggaggaagacaggaactggatagtagtccccacctggagggtgccagggaggatggagaaatggcatgcccttgtcaagtacctgaaatacagaacaaaagacctagaggaggtgcgctatgttccccaccacaaggtgggatgcgactcggaccgatg

SEQ ID NO: 5472 - DNA, 203 bp, Homo sapiens
  source 1..203: mol_type = other DNA
ggcgcgccagtcctcctaatacatagcacttatttctcttgctttacggcaggtgaagtaagaagagccatcagaggggaaaagttattgtcctgctgcaactatccccaagctcataaagcacaggtaccatcacttcaatacctagccctagtagtagtacaacaaaatgacagaccccagagaaacgactcggaccgatg

SEQ ID NO: 5473 - DNA, 203 bp, Homo sapiens
  source 1..203: mol_type = other DNA
ggcgcgccagtcctgggtaccgccaggaaacagtggagaagagaccattggagaggccttcgagtggctagagaggaccatagaagccttaaacagggaggcagtgaaccatctgccccgagagctcattttccaggtgtggcaaaggtcctggagatattggcatgatgaacaagggatgtcagcaacgactcggaccgatg

SEQ ID NO: 5474 - DNA, 203 bp, Homo sapiens
  source 1..203: mol_type = other DNA
ggcgcgccagtcctgctacacaaagtatagatatttgtgcctaatgcaaaaagctatatttacacatttcaagagagggtgcacttgctggggggaggacatgggccgggaaggattggaagaccaaggacctccccctcctccccctccaggtctagtctaatgactgaagcaccaacagagtttcccgactcggaccgatg

SEQ ID NO: 5475 - DNA, 203 bp, Homo sapiens
  source 1..203: mol_type = other DNA
ggcgcgccagtcctcccagaagatgggaccccacggagggacttagggagtgactgggtaatagaaactctgagggaaataaaggaagaagccttaagacattttgatccccgcttgctaattgctcttggctactatatccataatagacatggagacacccttgaaggcgccagagagctcattaacgactcggaccgatg

SEQ ID NO: 5476 - DNA, 203 bp, Homo sapiens
  source 1..203: mol_type = other DNA
ggcgcgccagtcctggctcggaatatcatatgagcgaaagggcagacgaagaaggactccaaggaaaactaagactccttcgccttctgcaccagacaagtgagtatggagcctggtaggaatcagctgtttgttgtcattttactaacaagtgcttgcttagtatattgtagccagtatgtgactgtcgactcggaccgatg

SEQ ID NO: 5477 - DNA, 203 bp, Homo sapiens
  source 1..203: mol_type = other DNA
ggcgcgccagtcctagtagaagatgtctggcatctatttgagacatcaataaaaccatgtgtcaagctaacacctctatgtgtggcaatgaattgtagcagggttcaagggaataccacgaccccgaatcccaggacctcgagttccacaacctcgagaccacccacatccgcagcctccataataaacgactcggaccgatg

SEQ ID NO: 5478 - DNA, 203 bp, Homo sapiens
  source 1..203: mol_type = other DNA
ggcgcgccagtccttgaaacttctaactgcatagaaaacaacacatgcgcaggattagggtatgaggagatgatgcaatgtgagttcaatatgaaggggttagaacaagataagaaaaggaggtataaggacacatggtatttagaagatgtggtttgtgacaacacaacagctggcacatgttacatcgactcggaccgatg

SEQ ID NO: 5479 - DNA, 203 bp, Homo sapiens
  source 1..203: mol_type = other DNA
ggcgcgccagtcctgagacattgcaacacatcaatcatcaaagagtcatgtgataagcactattgggatgctatgaggtttagatactgtgcaccaccgggctttgccctattaagatgtaatgataccaactattcaggctttgaacctaagtgcactaaagtagtagctgcttcatgcacaaggatcgactcggaccgatg

SEQ ID NO: 5480 - DNA, 203 bp, Homo sapiens
  source 1..203: mol_type = other DNA
ggcgcgccagtcctgtttgacttaacctcctgggtcaagtatattcaatatggagtgcatatagtagtgggaataatagctttaagaatagcaatctatgtagtgcaattgttaagtagatttagaaagggctataggcctgttttctcttccccccccggttatctccaacagatccatatccacaacgactcggaccgatg

SEQ ID NO: 5481 - DNA, 203 bp, Homo sapiens
  source 1..203: mol_type = other DNA
ggcgcgccagtcctcaggaagtagctactaagaaacagctgaggctgcagggactttccagaaggggctgtaaccaagggagggacatgggaggagctggtggggaacgccctcatacttactgtataaatgtacccgcttcttgcattgtattcagtcgctctgcggagaggctggcagatcgagcccgactcggaccgatg

SEQ ID NO: 5482 - DNA, 203 bp, Homo sapiens
  source 1..203: mol_type = other DNA
ggcgcgccagtcctgaaaaatttgtacctttgtttgtggtcaccatgtcccaagcagtaccatattggcggcagaccatgcaggcacgcaatcaaaatggtaaaaagcaaaagaaccgcattgctgaactagaaaaagaggtagcagacttaactagcgccggtaggggagctgatcaggttatagcacgactcggaccgatg

SEQ ID NO: 5483 - DNA, 203 bp, Homo sapiens
  source 1..203: mol_type = other DNA
ggcgcgccagtcctttgactatgcccaccagatcaaaaggaccgaagaaacggggccctgatttgaaacagattagatcgttgcacgtgatggctgattcattgggcatggacagtgatggcatagactgggattggttggctagacaagcctgggactatgaaggagatgaggatccacatgttaagcgactcggaccgatg

SEQ ID NO: 5484 - DNA, 203 bp, Homo sapiens
  source 1..203: mol_type = other DNA
ggcgcgccagtcctgaagcagaggaggaggcatggcgtgagagacaaacatctcaaccatcccaaccctctcagttgagaccttttgtagccgcagggaacggtcatagggaagatcaatggagacccctgacagtcacagaattacccgcagccgttaccgcagtaggaggagcatgggatcccacgcgactcggaccgatg

SEQ ID NO: 5485 - DNA, 203 bp, Homo sapiens
  source 1..203: mol_type = other DNA
ggcgcgccagtcctaagcagggacccggaggaggacagggtttgttggaatttactaagttaagacaaggacccactgagaatcctagtaactacttggaaaaggctctagaattgtacctagactctcaacccggtgatagagacggtaacaaagatgaccccgcatttctgcagcaggctactcaacgactcggaccgatg

SEQ ID NO: 5486 - DNA, 203 bp, Homo sapiens
  source 1..203: mol_type = other DNA
ggcgcgccagtcctggccacaagatcgagtgtctagtggacacaggagcagaggtgtcattaacatcccttcaattacaggcacaacgatttgaacaggtggttggtttgggaggcaaaccggtgagagtagggatagcggatcatgtcgataccacagtaggacaagtaaaaggaaaaggctgctggcgactcggaccgatg

SEQ ID NO: 5487 - DNA, 203 bp, Homo sapiens
  source 1..203: mol_type = other DNA
ggcgcgccagtcctcatgcttcaccaggcatattccaccaagccctgtacaatggactggcctcctgtaaaacagcgattgaaagtcagggttgtaaactattgcaatatgtagatgatatcctgttgatgagtgaagatagggaccatcatttaaggtcgctggcaatattactgcaaggcctcaagcgactcggaccgatg

SEQ ID NO: 5488 - DNA, 203 bp, Homo sapiens
  source 1..203: mol_type = other DNA
ggcgcgccagtcctatccaaggatggtttgtcccggagccttatgagggggaacagcaccagtgccgacctcatgatgacacaataacatggagagtcagcactagagctatgcccacgggtgagaagtggtggatagacggaagtagatattgggatcatgataagggaggctacgttacaggatggcgactcggaccgatg

SEQ ID NO: 5489 - DNA, 203 bp, Homo sapiens
  source 1..203: mol_type = other DNA
ggcgcgccagtccttggaaaaggaggggtatggtcaatgcagatggatcacagatcagcaaccagaatatcctacaagaaatttggcaattgattgaacatgattctacacaaacgcttggtatagtcaaggtaaaagcacatacccagcgtaaatgtagcacgcatgaacaacaactgaataatgatcgactcggaccgatg

SEQ ID NO: 5490 - DNA, 203 bp, Homo sapiens
  source 1..203: mol_type = other DNA
ggcgcgccagtcctgtagatcagccggcaaaacaatatgctaaggaagaacctaacatgtcagtcatagcacctctgcaagtctatccattatggataggtttggtaccatgtaaagaaccaaaattgtgggaaaatatacaacatcacatcacaaaggttgacctgcccgacttccagaaacaacttcgactcggaccgatg

SEQ ID NO: 5491 - DNA, 203 bp, Homo sapiens
  source 1..203: mol_type = other DNA
ggcgcgccagtcctggaaaagtacaaggctacgtcattaagacaaccttaggcatgaaaacatggataatgaatgatcacctggtgactcagagtgaacagactgagggtagggctaagctaagcagcacggaaggctacgccttagcccaacaataccatcatctgtacggtcacccctcagaggaacgactcggaccgatg

SEQ ID NO: 5492 - DNA, 203 bp, Homo sapiens
  source 1..203: mol_type = other DNA
ggcgcgccagtcctgtgggacctttgggacctggtacccatggatacaggtacctcacaaccatggttgatgtgtacacaggttggttctgggccaaaccctgtagaggtccaactacgggtgccactatagcggccttagaggaacacatcagtatttggggggtaccctattctatacaatctgatcgactcggaccgatg

SEQ ID NO: 5493 - DNA, 203 bp, Homo sapiens
  source 1..203: mol_type = other DNA
ggcgcgccagtcctcaaaataagaagtgggaagaacagttagaaaaggtcactaaagcagaagcccactcacactggactcagaggagccctaatttagaacctggctgcattgtgttagtaagaaagttcaccggggatgccttctcacctaaatgggaaggaccatatgtgataacagaaactacccgactcggaccgatg

SEQ ID NO: 5494 - DNA, 203 bp, Homo sapiens
  source 1..203: mol_type = other DNA
ggcgcgccagtcctaccaaggcaaaaacgtagcctaaggaaccaacccacagaatggcatctccatatgtgtggaccaccaggtgattacatatgcatgtggaccaataagaaaccagtgtgtactacctatcatgaaggacaggatacatactccttagggacgcataggaaggtgctccccaaagtcgactcggaccgatg

SEQ ID NO: 5495 - DNA, 203 bp, Homo sapiens
  source 1..203: mol_type = other DNA
ggcgcgccagtcctaactgaagcctgtgcggttggacaacctcctcagatacccggaacctatgtagccagtagtaaaggatggactatgtttaataaatttgaagtccattcctaccccgctaatgtcacccagattaaaacaaacagaacactgcatgacgtaacattatggtggtgtcatgacaacgactcggaccgatg

SEQ ID NO: 5496 - DNA, 203 bp, Homo sapiens
  source 1..203: mol_type = other DNA
ggcgcgccagtcctcaccgccacccgtgtccaaatgcagaaaataggaccaggggaatggaaaatagcaactagcatggtagggctatgcctggacgaatgggaaatagagtgcaccggcttctgtagtggtcctcctccttgcagtttaagcataactcaacagcaggatacagtgggaggatcttacgactcggaccgatg

SEQ ID NO: 5497 - DNA, 203 bp, Homo sapiens
  source 1..203: mol_type = other DNA
ggcgcgccagtcctactgatattaccttttactgtagcaccaaaatatagacgacaacgaaggggacttaacccctcaaccacacctgattattacactaatgaagattatagtggatcaggggggtgggaaataaatgacgagtgggaatatataccaccaacagtgaaaccaaccacgcctagtgtcgactcggaccgatg

SEQ ID NO: 5498 - DNA, 203 bp, Homo sapiens
  source 1..203: mol_type = other DNA
ggcgcgccagtccttacacttatagggaaacactggattaaggtaattcagcggcttttacgggaatatcagaagacaggggttacctttaatctcccacaggttcaatcattacccaattgggaaaccaaaaacaaagataatcctggacatcacattcccaaaagccggcggaagagaattaggcgcgactcggaccgatg

SEQ ID NO: 5499 - DNA, 203 bp, Homo sapiens
  source 1..203: mol_type = other DNA
ggcgcgccagtcctaggattaggtgaagctttaggattaggtaactttgctgataacagatggaaggatttacagatagcaggattaggggtagaacagcagaaattaatgggattaactagagaagccacgtttgaggcatggaatgccctgaagggtatttctaacgaattaattaaatgggaagacgactcggaccgatg

SEQ ID NO: 5500 - DNA, 203 bp, Homo sapiens
  source 1..203: mol_type = other DNA
ggcgcgccagtcctagatatggtagccactctcagacagcttctattacaaattaaaggcactaatactaccctctgtagtgcgatgggaccgttaatggctaccaatatacaacaaataatgttcgcattacaacatggtaatctacctgaaatgtcttactctaaccctgtgttgaaggaaatagccgactcggaccgatg

SEQ ID NO: 5501 - DNA, 203 bp, Homo sapiens
  source 1..203: mol_type = other DNA
ggcgcgccagtcctaaattcaggaacatggtcatcactgaaaaatgagacactgtatgtaagtggacgaaattgctccttctctctcaccagtaggcggcgacctgtgtgttttcacctaaatagcaccgcccaatggcgaggacacgttttgccttttgtaggtaactcccaggaagcacccaacaccgactcggaccgatg

SEQ ID NO: 5502 - DNA, 203 bp, Homo sapiens
  source 1..203: mol_type = other DNA
ggcgcgccagtcctccaaaccagaagaagtgataagtttatataatcctgaattatttgcttgggggggaacactgggagattatgtatggtgtaaaactactactattcgatggggacctattgtaatgaagtatcgtgtgtgtgggcacctcgaatcagattataccacgagtcagtattacagagcgactcggaccgatg

SEQ ID NO: 5503 - DNA, 203 bp, Homo sapiens
  source 1..203: mol_type = other DNA
ggcgcgccagtcctacatatgctcttaatgtacttgtttactgtttatacgcacccaagtaacaactgtatttaattataacctatgtgaatcataaggccaatcacgctaggaggcggcctctagtacttttccattgtatgaactattgttattagcccctccctgaaggaggagccacttgcctacgactcggaccgatg

SEQ ID NO: 5504 - DNA, 203 bp, Homo sapiens
  source 1..203: mol_type = other DNA
ggcgcgccagtcctgaatcataaggccaatcacgctaggaggcggcctctagtacttttccattgtatgaactattgttattagcccctccctgaaggaggagccacttgcctatatattgtagagcacggctgtgctcattgtcttttgctgcacccaacttgaagaataaagattattgcatctgacgactcggaccgatg

SEQ ID NO: 5505 - DNA, 203 bp, Homo sapiens
  source 1..203: mol_type = other DNA
ggcgcgccagtccttgtttagtctaactcaatagacatgtgtttattaccattttagttaatataaaaactcatcaaagggaaatggggcaaataaactcacctaatcaatcaaactatgagcactacaaatgacaacactactatgcaaagattaatgatcacggacatgagacccctgtcgatggacgactcggaccgatg

SEQ ID NO: 5506 - DNA, 203 bp, Homo sapiens
  source 1..203: mol_type = other DNA
ggcgcgccagtccttgaatataatacaaaatatggcactttccccatgcctatatttatcaatcatggcgggtttctagaatgtattggcattaagcctacaaaacacactcctataatatacaaatatgacctcaacccgtaaattccaacaaaaaaaaccaacccaaccaaaccaagctattcctccgactcggaccgatg

SEQ ID NO: 5507 - DNA, 203 bp, Homo sapiens
  source 1..203: mol_type = other DNA
ggcgcgccagtcctaggaatgctccatacattagtagttgcaagtgcaggacccacttcagctcgcgatggaataagagatgctatggttggtctgagagaagaaatgatagaaaaaataagagcggaagcattaatgaccaatgataggttagaggctatggcaagacttaggaatgaggaaagcgacgactcggaccgatg

SEQ ID NO: 5508 - DNA, 203 bp, Homo sapiens
  source 1..203: mol_type = other DNA
ggcgcgccagtcctaaaaatggcaaaagacacctcagatgaagtgcctcttaatccaacttccaaaaaattgagtgacttgttggaagacaacgatagtgacaatgatctgtcacttgatgatttttgatcagtgatcaactcactcagcaatcaacaacatcaataaaacagacatcaatccattgacgactcggaccgatg

SEQ ID NO: 5509 - DNA, 203 bp, Homo sapiens
  source 1..203: mol_type = other DNA
ggcgcgccagtcctgctagacctagagtgcgaataggtaaataaaaccaaaatatggggtaaatagacattagttagagttcaatcaatctcaacaaccatttataccgccaattcaatacatatactataaatcttaaaatgggaaatacatccatcacaatagaattcacaagcaaattttggccccgactcggaccgatg

SEQ ID NO: 5510 - DNA, 203 bp, Homo sapiens
  source 1..203: mol_type = other DNA
ggcgcgccagtcctcacaagaatcaacgcactgccaggactctagaaaagacctgggatactctcaatcatctaattgtaatatcctcttgtttatacagattaaatttaaaatctatagcacaaatagcactatcagttctggcaatgataatctcaacctctctcataattgcagccataatattccgactcggaccgatg

SEQ ID NO: 5511 - DNA, 203 bp, Homo sapiens
  source 1..203: mol_type = other DNA
ggcgcgccagtcctatcatctctgccaatcacaaagttacactaacaacggtcacagttcaaacaataaaaaaccacactgaaaaaaacatcaccacctaccttactcaagtcccaccagaaagggttagctcatccaaacaacctacaaccacatcaccaatccacacaaattcagccacaacatcacgactcggaccgatg

SEQ ID NO: 5512 - DNA, 203 bp, Homo sapiens
  source 1..203: mol_type = other DNA
ggcgcgccagtcctaccctcacgaccacagaaagagacaccagcacctcacaatccactgtgctcgacacaaccacattagaacacacaatccaacagcaatccctccactcaaccacccccgaaaacacacccaactccacacaaacacccacagcatccgagccctctacatcaaattccacccaacgactcggaccgatg

SEQ ID NO: 5513 - DNA, 203 bp, Homo sapiens
  source 1..203: mol_type = other DNA
ggcgcgccagtcctaatacccaatcacatgcttagttattcaaaaactacatcttagcagaaaaccgtgacctatcaagcaagaacgaaattaaacctggggcaaataaccatggagctgctgatccacaggttaagtgcaatcttcctaactcttgctattaatgcattgtacctcacctcaagtcacgactcggaccgatg

SEQ ID NO: 5514 - DNA, 203 bp, Homo sapiens
  source 1..203: mol_type = other DNA
ggcgcgccagtcctaccaaaaataatgatattaccggataaatatccttgtagtatatcatccatattgatttcaagtgaaagcatgattgctacattcaatcataaaaacatattacaatttaaccataaccatttggataaccaccagcgtttattaaataatatatttgatgaaattcattggaccgactcggaccgatg

SEQ ID NO: 5515 - DNA, 203 bp, Homo sapiens
  source 1..203: mol_type = other DNA
ggcgcgccagtcctgataataatctcaataatttgagtgagctatattttctcttcagaatctttggacatccaatggttgatgaaagacaagcaatggatgctgtaagaattaactgtaatgaaactaagttctacttattaagtagtctaagtacgttaagaggtgctttcatttatagaatcatacgactcggaccgatg

SEQ ID NO: 5516 - DNA, 203 bp, Homo sapiens
  source 1..203: mol_type = other DNA
ggcgcgccagtcctaaattcaatcaagcatttagatatgaaacatcatgtatctgcagtgatgtattagatgaactgcatggagtacaatctctgttctcttggttgcatttaacaatacctcttgtcacaataatatgtacatatagacatgcacctcctttcataaaggatcatgttgttaatcttcgactcggaccgatg

SEQ ID NO: 5517 - DNA, 203 bp, Homo sapiens
  source 1..203: mol_type = other DNA
ggcgcgccagtcctaatgaagttgatgaacaaagtggattatacagatatcatatgggtggtattgagggctggtgtcaaaaactgtggaccattgaagctatatcattattagatctaatatctctcaaagggaaattctctatcacagctctgataaatggtgataatcagtcaattgatataagtcgactcggaccgatg

SEQ ID NO: 5518 - DNA, 203 bp, Homo sapiens
  source 1..203: mol_type = other DNA
ggcgcgccagtcctaaaccagttagacttatagagggtcagacccatgctcaagcagattatttgttagcattaaatagccttaaattgctatataaagagtatgcaggtataggccataagcttaagggaacagagacctatatatcccgagatatgcagttcatgagcaaaacaatccagcacaatcgactcggaccgatg

SEQ ID NO: 5519 - DNA, 203 bp, Homo sapiens
  source 1..203: mol_type = other DNA
ggcgcgccagtcctaaaaagcaaagagaccaaatagatttattagcaaaattagactgggtatatgcatccatagacaacaaagatgaattcatggaagaactgagtactggaacacttggactgtcatatgaaaaagccaaaaagttgtttccacaatatctaagtgtcaattatttacaccgtttacgactcggaccgatg

SEQ ID NO: 5520 - DNA, 203 bp, Homo sapiens
  source 1..203: mol_type = other DNA
ggcgcgccagtcctagaaacaaggcagtcaaccacctaccaatcccacaaacagaacgaatcaggacgaaatagatgatctgtttaatgcatttggaagcaactaatcgaatcaacattttgatccaaattaataataaataagaaaaacttaggattaaagaatcctattataccagaatatagggtcgactcggaccgatg

SEQ ID NO: 5521 - DNA, 203 bp, Homo sapiens
  source 1..203: mol_type = other DNA
ggcgcgccagtcctggtaaatttagagtttgcttgcaactcaatcaatagagagttgatggaaagcgatgctaaaaactatcaaatcatggattcttgggaagaggaatcaagagataaatcaactaatatctcctcggccctcaatatcattgaattcatacttagcaccgacccccaagaagacctcgactcggaccgatg

SEQ ID NO: 5522 - DNA, 203 bp, Homo sapiens
  source 1..203: mol_type = other DNA
ggcgcgccagtcctaatgaaaaatagtaggacaaagaaaagttcttcaatacaccaagaagatgacaaaagaattaaaaaagggggaaaagggaaagactggtttaagaaatcaaaagatactgacaaccagataccaacatcagactacagatccacatcaaaagggcagaagaaaatctcaaaaaccgactcggaccgatg

SEQ ID NO: 5523 - DNA, 203 bp, Homo sapiens
  source 1..203: mol_type = other DNA
ggcgcgccagtccttctctcacaaagcacaaaacaatcatatataaacgaactcaaacattgcaaaaatgatgaagaagtatctgaattaatggacatgttcaatgaagatgtcaataattgccaatgatccaacaaagaaacgacaccgaacaaacagacaagaaacaacagtagatcaaaatctatcgactcggaccgatg

SEQ ID NO: 5524 - DNA, 203 bp, Homo sapiens
  source 1..203: mol_type = other DNA
ggcgcgccagtcctacaaagtttgtggctctggatcattaccaatcggattggctaaatacactgggaatgaccaggaattattacaagctgcaaccaaactggacatagaagtgagaagaacagtcaaagcgaaagagatggttgtgtatacagtacaaaatataaaaccagaactatacccatggtcgactcggaccgatg

SEQ ID NO: 5525 - DNA, 203 bp, Homo sapiens
  source 1..203: mol_type = other DNA
ggcgcgccagtcctacacaatatcaatcaatctgcaggtacatatcaaaacaggggttcagactgattccaaagggatagttcaaattttgaatgagaagggcgaaaaatcactgaatttcatgatccatctcggattgatcaagagaaaaataggcagaatgtactctgttgaatactgtaaacagacgactcggaccgatg

SEQ ID NO: 5526 - DNA, 203 bp, Homo sapiens
  source 1..203: mol_type = other DNA
ggcgcgccagtcctccctttattaactaggctgctgaacactcagatctacaaagtagattccatatcatataatatccacaatagagaatggtatattcctcttcccagccatatcatgacgaaaggggcatttctaggtggagcagatgtcaaagaatgtatagaagcattcagcagttatatatgcgactcggaccgatg

SEQ ID NO: 5527 - DNA, 203 bp, Homo sapiens
  source 1..203: mol_type = other DNA
ggcgcgccagtccttatgagacaaaattactgggggtcagaaggaaggttgattctactaggtaacaagatctatatatatacaagatctacaagttggcatagcaaattacaattaggaataattgatattactgattacagtgatataaggataaaatggacatggcataatgtgctatcaagacccgactcggaccgatg

SEQ ID NO: 5528 - DNA, 203 bp, Homo sapiens
  source 1..203: mol_type = other DNA
ggcgcgccagtcctataattaaccataatatgcattaacctatctataatacaagtatatgataagtaatcagcaatcagacaatggacaaaaggaaaatataaaaaacttaggagcaaagcgtgctcggaaaatggacactgaatctaacaatggcactgtatctgacatactctatcctgagtgtccgactcggaccgatg

SEQ ID NO: 5529 - DNA, 203 bp, Homo sapiens
  source 1..203: mol_type = other DNA
ggcgcgccagtccttcacttttaatgttgggaaagattataacttgttagaagaccagaagaatttcttattgatacatccagaattggttttgatattagataaacaaaactataatggttatctaattactcctgaattagtactgatgtattgtgacgtagtcgaaggccgatggaatataagtgcgactcggaccgatg

SEQ ID NO: 5530 - DNA, 203 bp, Homo sapiens
  source 1..203: mol_type = other DNA
ggcgcgccagtcctgaggagcttttttaaatcatgtgttatccgaaatggaattgatatttgaatctggagaatcgattagggaatttctgagtgtagattacattgataaaatcttagatatttttaatgaatctacaatagatgaaatagcagagattttctctttttttagaacatttgggcatccgactcggaccgatg

SEQ ID NO: 5531 - DNA, 203 bp, Homo sapiens
  source 1..203: mol_type = other DNA
ggcgcgccagtcctttctagataattctctcacaggaattagaaatgctatagctggaatgttagatacgacaaaatcattaattcgggttggcataaatagaggaggactgacatatagtttgttgagaaaaatcagtaattatgatctagtgcaatatgaaacactaagtaggactttgcgattaacgactcggaccgatg

SEQ ID NO: 5532 - DNA, 203 bp, Homo sapiens
  source 1..203: mol_type = other DNA
ggcgcgccagtcctctgcaactcagatgaaattctccagtacatcattaatcagagtcagcagattcataacaatgtccaatgataacatgtctattaaagaagctaatgaaaccaaagataccaatcttatttaccaacaaataatgttaacaggattaagtgttttcgaatatttatttagattaacgactcggaccgatg

SEQ ID NO: 5533 - DNA, 203 bp, Homo sapiens
  source 1..203: mol_type = other DNA
ggcgcgccagtccttattaaaagtattatctaatgcattatctcatcctaaagtatttaagaggttctgggattgtggagttttaaaccctatttatggtcctaatactgctagtcaagaccagataaaacttgctctctctatatgtgaatatgcactagatctatttatgagagaatggttgaatgcgactcggaccgatg

SEQ ID NO: 5534 - DNA, 203 bp, Homo sapiens
  source 1..203: mol_type = other DNA
ggcgcgccagtcctatgatgatgttgttttagtttccaaaattatacctacaatcactccgaattggtctagaatactttatctatataaattatattggaaagatgtaagtataatatcacttaaaacttctaatcctgcatcaacagaattatatctaatttcgaaagatgcatattgtactataacgactcggaccgatg

SEQ ID NO: 5535 - DNA, 203 bp, Homo sapiens
  source 1..203: mol_type = other DNA
ggcgcgccagtcctaaatctttggatttcaaatcaacttaaatcatctggcgaaagaatttttatcaactccagatctgaccaatatcaacaatataatccaaagttttcagcgaacaatcaaagatgtcttgtttgaatggattaatataactcatgatgacaagagacataaattaggcgggagatcgactcggaccgatg

SEQ ID NO: 5536 - DNA, 203 bp, Homo sapiens
  source 1..203: mol_type = other DNA
ggcgcgccagtcctaatcattaaaattattgtcgaaaaacatcattaagaattatagagagtgtataggatcaatatcatattggtttctaaccaaagaagttaaaatacttatgaaattgattggtggtgctaaattattaggaattcccagacaatataaagaacccgaagaacagttattagaaacgactcggaccgatg

SEQ ID NO: 5537 - DNA, 203 bp, Homo sapiens
  source 1..203: mol_type = other DNA
ggcgcgccagtcctccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcgactcggaccgatg

SEQ ID NO: 5538 - DNA, 203 bp, Homo sapiens
  source 1..203: mol_type = other DNA
ggcgcgccagtccttaggaggacccggccataaggcaagagttttggctgaagcaatgagccaagtaacaaattcagctaccataatgatgcagagaggcaattttaggaaccaaagaaagattgttaagtgtttcaattgtggcaaagaagggcacacagccagaaattgcagggcccctaggaaaacgactcggaccgatg

SEQ ID NO: 5539 - DNA, 203 bp, Homo sapiens
  source 1..203: mol_type = other DNA
ggcgcgccagtcctagggctgttggaaatgtggaaaggaaggacaccaaatgaaagattgtactgagagacaggctaattttttagggaagatctggccttcctacaagggaaggccagggaattttcttcagagcagaccagagccaacagccccaccagaagagagcttcaggtctggggtagagacgactcggaccgatg

SEQ ID NO: 5540 - DNA, 203 bp, Homo sapiens
  source 1..203: mol_type = other DNA
ggcgcgccagtcctaaattttcccattagccctattgagactgtaccagtaaaattaaagccaggaatggatggcccaaaagttaaacaatggccattgacagaagaaaaaataaaagcattagtagaaatttgtacagagatggaaaaggaagggaaaatttcaaaaattgggcctgaaaatccatacgactcggaccgatg

SEQ ID NO: 5541 - DNA, 203 bp, Homo sapiens
  source 1..203: mol_type = other DNA
ggcgcgccagtcctaataatagagcagttaataaaaaaggaaaaggtctatctggcatgggtaccagcacacaaaggaattggaggaaatgaacaagtagataaattagtcagtgctggaatcaggaaagtactatttttagatggaatagataaggcccaagatgaacatgagaaatatcacagtaacgactcggaccgatg

SEQ ID NO: 5542 - DNA, 203 bp, Homo sapiens
  source 1..203: mol_type = other DNA
ggcgcgccagtcctggttttatagacatcactatgaaagccctcatccaagaataagttcagaagtacacatcccactaggggatgctagattggtaataacaacatattggggtctgcatacaggagaaagagactggcatttgggtcagggagtctccatagaatggaggaaaaagagatatagcacgactcggaccgatg

SEQ ID NO: 5543 - DNA, 203 bp, Homo sapiens
  source 1..203: mol_type = other DNA
ggcgcgccagtccttaacaccaaaaaagataaagccacctttgcctagtgttacgaaactgacagaggatagatggaacaagccccagaagaccaagggccacagagggagccacacaatgaatggacactagagcttttagaggagcttaagaatgaagctgttagacattttcctaggatttggctcgactcggaccgatg

SEQ ID NO: 5544 - DNA, 203 bp, Homo sapiens
  source 1..203: mol_type = other DNA
ggcgcgccagtcctagactagagccctggaagcatccaggaagtcagcctaaaactgcttgtaccaattgctattgtaaaaagtgttgctttcattgccaagtttgtttcataacaaaagccttaggcatctcctatggcaggaagaagcggagacagcgacgaagagctcatcagaacagtcagactcgactcggaccgatg

SEQ ID NO: 5545 - DNA, 203 bp, Homo sapiens
  source 1..203: mol_type = other DNA
ggcgcgccagtcctaagaggtaaggtgcagaaagaatatgcatttttttataaacttgatataataccaatagataatgatactaccagctataagttgacaagttgtaacacctcagtcattacacaggcctgtccaaaggtatcctttgagccaattcccatacattattgtgccccggctggtttcgactcggaccgatg

SEQ ID NO: 5546 - DNA, 203 bp, Homo sapiens
  source 1..203: mol_type = other DNA
ggcgcgccagtccttaacactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaacgactcggaccgatg

SEQ ID NO: 5547 - DNA, 203 bp, Homo sapiens
  source 1..203: mol_type = other DNA
ggcgcgccagtccttagtacttggagtactgaagggtcaaataacactgaaggaagtgacacaatcaccctcccatgcagaataaaacaaattataaacatgtggcagaaagtaggaaaagcaatgtatgcccctcccatcagtggacaaattagatgttcatcaaatattacagggctgctattaaccgactcggaccgatg

SEQ ID NO: 5548 - DNA, 203 bp, Homo sapiens
  source 1..203: mol_type = other DNA
ggcgcgccagtcctgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctgcgactcggaccgatg

SEQ ID NO: 5549 - DNA, 203 bp, Homo sapiens
  source 1..203: mol_type = other DNA
ggcgcgccagtcctgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccgactcggaccgatg

SEQ ID NO: 5550 - DNA, 203 bp, Homo sapiens
  source 1..203: mol_type = other DNA
ggcgcgccagtcctcattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattgcgactcggaccgatg

SEQ ID NO: 5551 - DNA, 203 bp, Homo sapiens
  source 1..203: mol_type = other DNA
ggcgcgccagtcctgagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcacgactcggaccgatg

SEQ ID NO: 5552 - DNA, 203 bp, Homo sapiens
  source 1..203: mol_type = other DNA
ggcgcgccagtcctgagactataataatatcactaaccagagacatcataacacacagatttatatacttgataaatcatgaatgtatagtgagaaaacttgatgaaagacaggccacatttacattcctggtcaactatgaaatgaaactattgcacaaagtgggaagcactaaatacaaaaaatatcgactcggaccgatg

SEQ ID NO: 5553 - DNA, 203 bp, Homo sapiens
  source 1..203: mol_type = other DNA
ggcgcgccagtcctttcctcacttctccagtgtagtattaggcaatgctgctggcctaggcataatgggagaatacagaggtacaccaaggaatcaagatctatatgatgctgcaaaagcatatgctgaacaactcaaagaaaatggtgtgattaactacagtgtattagacttgacagcagaagaaccgactcggaccgatg

SEQ ID NO: 5554 - DNA, 203 bp, Homo sapiens
  source 1..203: mol_type = other DNA
ggcgcgccagtcctagacgatgaccctgcatcacttacaatatgggtgcccatgttccaatcatccatgccagcagatttacttataaaagaactagctaatgtcaacatactagtgaaacaaatatccacacccaatggaccttcattaagagtcatgataaactcaagaagtgcagtgctagcacacgactcggaccgatg

SEQ ID NO: 5555 - DNA, 203 bp, Homo sapiens
  source 1..203: mol_type = other DNA
ggcgcgccagtcctaataatctctttgctaatcataatctccatcatgattgcaatactgaacaaactctgtgaatataacgtattccataacaaaacctttgagctaccaagagctcgagtcaatacatagcattcaccaatctgatggcacaaaacagtaaccttgcatttgtaagtgaacaaccccgactcggaccgatg

SEQ ID NO: 5556 - DNA, 203 bp, Homo sapiens
  source 1..203: mol_type = other DNA
ggcgcgccagtcctcagtcaagaccaaaaacacaacaacaaccaaaatacaacccagcaagcccaccacaaaacaacgccaaaacaaaccaccaaacaaacccaataatgattttcactttgaagtgttcaactttgtaccttgcagcatatgcagcaacaatccaacctgctgggctatctgtaaaacgactcggaccgatg

SEQ ID NO: 5557 - DNA, 203 bp, Homo sapiens
  source 1..203: mol_type = other DNA
ggcgcgccagtcctctcatgcaaagcacaccggcaaccaacaatcgagccagaagagaactaccaaggtttatgaattatacactcaacaataccaaaaataccaatgtaacattaagcaagaaaaggaaaagaagatttcttggctttttgttaggtgttggatctgcaatcgccagtggcattgctcgactcggaccgatg

SEQ ID NO: 5558 - DNA, 203 bp, Homo sapiens
  source 1..203: mol_type = other DNA
ggcgcgccagtcctaataagggggttgacactgtgtctgtaggtaatacattatattatgtaaataagcaagaaggcaaaagtctctatgtaaaaggtgaaccaataataaatttctatgacccattagtgttcccctctgatgaatttgatgcatcaatatctcaagtcaatgagaagattaaccagcgactcggaccgatg

SEQ ID NO: 5559 - DNA, 203 bp, Homo sapiens
  source 1..203: mol_type = other DNA
ggcgcgccagtcctgtgttcaatgcaacatcctccatcatggttaatacattggtttaatttatacacaaaattaaacaacatattaacacagtatcgatcaagtgaggtaaaaaaccatggttttatattgatagacaatcatactctcaatggattccaatttattttgaatcaatatggttgtatcgactcggaccgatg

SEQ ID NO: 5560 - DNA, 203 bp, Homo sapiens
  source 1..203: mol_type = other DNA
ggcgcgccagtcctagtttatcataaggaactcaaaagaattactgtgacaacctataatcaattcttgacatggaaaaatattagccttagtagattaaatgtttgtttaattacatggattagtaactgtttgaacacattaaataaaagcttaggcttaagatgcggattcaataatgttatcttcgactcggaccgatg

SEQ ID NO: 5561 - DNA, 203 bp, Homo sapiens
  source 1..203: mol_type = other DNA
ggcgcgccagtcctgaatgctattgttttacccttaagatggttaacttactataaactaaacacttatccttccttgttggaacttacagaaagagatttgattgttttatcaggactacgtttctatcgtgagtttcggttgcctaaaaaagtggatcttgaaatgatcataaatgataaggctatcgactcggaccgatg

SEQ ID NO: 5562 - DNA, 203 bp, Homo sapiens
  source 1..203: mol_type = other DNA
ggcgcgccagtcctgggtggtatcgaagggtggtgtcaaaaactatggaccatagaagctatatcactattggatctaatatctctcaaagggaaattctcaattactgctttaattaatggtgacaatcaatcaatagatataagtaaaccagtcagactcatggaaggtcaaactcatgctcaagccgactcggaccgatg

SEQ ID NO: 5563 - DNA, 203 bp, Homo sapiens
  source 1..203: mol_type = other DNA
ggcgcgccagtcctcattaatttgaaagttttcttcaatgcttataagacctatctcttgtgttttcataaaggttacggcagagcaaagctggagtgtgatatgaatacttcagatctcctatgtgtattggaattaatagacagtagttattggaagtctatgtctaaggtatttttagaacaaaacgactcggaccgatg

SEQ ID NO: 5564 - DNA, 203 bp, Homo sapiens
  source 1..203: mol_type = other DNA
ggcgcgccagtcctcaattacagcaaacaagatttgtataatttatttcctacggttgtgattgataaaattatagatcattcaggtaatacagccaaatctaaccaactttacactactacttctcatcaaatacctttagtgcacaatagcacatcactttattgcatgcttccttggcatcatatcgactcggaccgatg

SEQ ID NO: 5565 - DNA, 203 bp, Homo sapiens
  source 1..203: mol_type = other DNA
ggcgcgccagtcctaagtctgaaggattgcaatgatcatagtttacctattgagtttttaaggctgtacaatggacatatcaacattgattatggtgaaaatttgaccattcctgctacagatgcaaccaacaacattcattggtcttatttacatataaagtttgctgaacctatcagtctttttgtcgactcggaccgatg

SEQ ID NO: 5566 - DNA, 203 bp, Homo sapiens
  source 1..203: mol_type = other DNA
ggcgcgccagtcctttatgtatgcttaggcagtaagttaaaggggtctgaagtttacttagtccttacaataggtcctgcaaatgtgttcccagtatttaatgtagtacaaaatgctaaattgatactatcaagaaccaaaaatttcatcatgcctaagaaggctgataaagagtctattgatgcaaacgactcggaccgatg

SEQ ID NO: 5567 - DNA, 203 bp, Homo sapiens
  source 1..203: mol_type = other DNA
ggcgcgccagtccttattaaaagtttgataccctttctttgttaccctataacaaaaaaaggaattaatactgcattgtcaaaactaaagagtgttgttagtggagatatactatcatattctatagcaggacgtaatgaagttttcagcaataaacttataaatcataagcatatgaacatcttaaacgactcggaccgatg

SEQ ID NO: 5568 - DNA, 203 bp, Homo sapiens
  source 1..203: mol_type = other DNA
ggcgcgccagtcctgcacttcggaagataaagaggacagtgagtgctttgatggttggcttgcaaaggcgcggaaaaaggaggtcagtgacgaactggatgaactggttgctggtcattgctctgctggggatgacacttgcagcgacagtaaggaaagaaggggacggcaccactgtgatcagggctcgactcggaccgatg

SEQ ID NO: 5569 - DNA, 203 bp, Homo sapiens
  source 1..203: mol_type = other DNA
ggcgcgccagtccttcaattggaaaggcggtgcacacggttcttggtggtgccttcaacagcatctttggaggagtggggttcctgccaaagctcctaatgggagtggcactggcctggttgggactgaacacaaggaaccccacaatgtccatgagctttctcttggctggaggtctggtcttggcccgactcggaccgatg

SEQ ID NO: 5570 - DNA, 203 bp, Homo sapiens
  source 1..203: mol_type = other DNA
ggcgcgccagtcctaaggacatgaaggtctcttggaggagctggggccactcaatgatctggagtatccctgaggctcctcggcgtttcatggtgggtacagagggacaaagtgagtgcccactagagagacgaaaaacaggtgtgttcacggttgcagagtttggggtcggtctgagaacaaaagtccgactcggaccgatg

SEQ ID NO: 5571 - DNA, 203 bp, Homo sapiens
  source 1..203: mol_type = other DNA
ggcgcgccagtccttttctggactttagacaggaaccaacacacgagtgtgacacaggagtgatgggggccgccgtcaaaaacgacatggcggtccacacagatcaaagcctctggatgaaatcgatgagaaatgacacaggtacctacatagttgaactcctggtcactgacctgaggaactgctctcgactcggaccgatg

SEQ ID NO: 5572 - DNA, 203 bp, Homo sapiens
  source 1..203: mol_type = other DNA
ggcgcgccagtcctactggaatggtcaggattgagagcctcgtgcgctacgtggtggcggtggggattgcgttccaccttgagctgggaccagagactgtggccttgatgctgctccaggccgtgtttgagctaagagttgggcttctcagcgcctttgcattgcgcagaggcctcaccgtccgagagcgactcggaccgatg

SEQ ID NO: 5573 - DNA, 203 bp, Homo sapiens
  source 1..203: mol_type = other DNA
ggcgcgccagtcctctccattggtcaggcatccttggtgtgatgggactgtggacactcacagaaataatgaggtcatccagagggtccgacctggtctactcaggacagggaggccaagaacgtggcgacaggccttttgaggtcaaggatggagtttacagaattttcagtcccggcttgttctggcgactcggaccgatg

SEQ ID NO: 5574 - DNA, 203 bp, Homo sapiens
  source 1..203: mol_type = other DNA
ggcgcgccagtcctaaaggtgaaacagtacaggtccatgccttcccaccggggagggcgcacgaggtgcaccagtgccagcccggagaattgatccttgacacaggaaagaggcttggggcaataccaattgacttggcaaagggaacatctggtagccctattcttaacgctcagggagtggttgttcgactcggaccgatg

SEQ ID NO: 5575 - DNA, 203 bp, Homo sapiens
  source 1..203: mol_type = other DNA
ggcgcgccagtcctgggctatacggaaatggtccaaaaaccaatgagagctacgtcagcagcatcgctcagggagaggcggagaagagtcgacccaaccttccacaggcagttgtgggcacgggctggacgtcaaagggtcagatcacagtgttggatatgcacccaggctctggaaagacccacagacgactcggaccgatg

SEQ ID NO: 5576 - DNA, 203 bp, Homo sapiens
  source 1..203: mol_type = other DNA
ggcgcgccagtcctgtcctcccggagctcatccgccaatgcattgacaggcgcctgagtacgttggtgctggctccaactcgcgtggtactgaaggagatggagcgcgctctcagtgggaagcgggtccggttccattcgccagcagtcagtgaccaacaggctggaggggcaattgtcgatgtgatgcgactcggaccgatg

SEQ ID NO: 5577 - DNA, 203 bp, Homo sapiens
  source 1..203: mol_type = other DNA
ggcgcgccagtcctaacataacaaccttgcgggggcccgtggccaccttttatggccctgagcaggacaagatgccggaggtggccggtcactttcgactcactgaggagaagaggaagcacttccgccaccttctcacccattgtgatttcacgccctggctggcatggcacgttgcagcgaacgtgcgactcggaccgatg

SEQ ID NO: 5578 - DNA, 203 bp, Homo sapiens
  source 1..203: mol_type = other DNA
ggcgcgccagtcctctgacggtggttgagatgatggttctgggtctggcgaccctgggtgtcgtctggtgtttcgtcgtccgaacatcaatcagtcgcatgatgctcggcacgctggtcttgctggcctccctgctactcttgtgggcaggtggcgtcggctatgggaacatggctggagtggctctccgactcggaccgatg

SEQ ID NO: 5579 - DNA, 203 bp, Homo sapiens
  source 1..203: mol_type = other DNA
ggcgcgccagtcctgccatgagagacttgggggggggagctcccttctttggtgtggcaggacatgttatgactctcggggtggtgtccctggttggggccacccccacctcactgatagtgggcattggcttagcagctttccatttggccatcgtggtatctggactggaggctgagctgacacagcgactcggaccgatg

SEQ ID NO: 5580 - DNA, 203 bp, Homo sapiens
  source 1..203: mol_type = other DNA
ggcgcgccagtcctaggcgtggtggctctgatggagacacgcttggtgacctctggaagcgcaggctgaacaactgcaccaaggaggaattcttcgtttacaggcgcactggcattctggaaaccgaacgtgacaaggccagagagctgctcaggagaggagagacaaacatgggactggcggtctcgcgactcggaccgatg

SEQ ID NO: 5581 - DNA, 203 bp, Homo sapiens
  source 1..203: mol_type = other DNA
ggcgcgccagtcctcgtggcacggcaaagctcgcttggcttgaagaacgcggatatcgcaccctcaagggagaggtggtagatctcgggtgtggaaggggcggctggtcctactatgcggcttctcgaccggcagtcatgagtgttagggcatataccattggtggaagagggcatgaggttccaaagcgactcggaccgatg

SEQ ID NO: 5582 - DNA, 203 bp, Homo sapiens
  source 1..203: mol_type = other DNA
ggcgcgccagtcctatccgaaacccagcggcggcctgcgtgttcaaggtgctggctccataccgcccagaggtaatagaggcattgcacagattccagctgcagtggggtgggggtctagtgaggactcccttctcaaggaactcaactcacgagatgtactactcgacagctgtcacaggcaatatacgactcggaccgatg

SEQ ID NO: 5583 - DNA, 203 bp, Homo sapiens
  source 1..203: mol_type = other DNA
ggcgcgccagtcctacgacagcctttgggcagcagagagtgtttaaagagaaagttgacacaaaagcacaggagccccaaccggggacaagagtgatcacgagagcagtgaatgattggattctagagcgtctggcccagaaaagcaaaccacgcatgtgcagcagagaggaattcatagcaaaagtgcgactcggaccgatg

SEQ ID NO: 5584 - DNA, 203 bp, Homo sapiens
  source 1..203: mol_type = other DNA
ggcgcgccagtcctcaacccaacttccgcgttcttgtcttattctccgccgaaatcgaaagcacagtgcccctccctgcaccactggcccggggccagcatcctgccagggacgcgcgcctgctaaacccgagggtgttttgggcctctccgggaggggtacccagccacttcgggtccttgttctctcgactcggaccgatg

SEQ ID NO: 5585 - DNA, 203 bp, Homo sapiens
  source 1..203: mol_type = other DNA
ggcgcgccagtcctccgggagagacaaacaagtgggggctcgtccgggatacctacccctgccctctcgcattatgggacaaacctacggcctctcgtccagcccaatccccaaggcccccagggggttatcaacccaccattggttaaacttcctccaagccgcctaccggctacaacctgggccctcgactcggaccgatg

SEQ ID NO: 5586 - DNA, 203 bp, Homo sapiens
  source 1..203: mol_type = other DNA
ggcgcgccagtcctctcctgccccgtctctacccgaaccagctaacccaccgcccctccaacagccctcggctcctccggaaccccatacaccccccccctatataaagcctcccgctacccattgccttcccatactacacccacatggggccccctcggctcacagcccttggcaaatgaaagacccgactcggaccgatg

SEQ ID NO: 5587 - DNA, 203 bp, Homo sapiens
  source 1..203: mol_type = other DNA
ggcgcgccagtccttgcaggccatcaagcaggaggtcagcacctcagcccccgggagtccccagttcatgcaaacagtccggctcgcaattcagcaattcgaccccacggccaaagacttacaagatctcttgcagtacctctgctcctccctagtcgtctcccttcaccatcaacaattccataccccgactcggaccgatg

SEQ ID NO: 5588 - DNA, 203 bp, Homo sapiens
  source 1..203: mol_type = other DNA
ggcgcgccagtcctccctaggggacatgctccgagcctgccaagcatggacacccaaggacaaagcccgggtcctcgtcgtccaaccacgaaagcccccgcccacgcagccctgcttccgctgcgggaaaacagggcattggagccgagactgcaccctcccacgccccccccctggtccgtgtccctcgactcggaccgatg

SEQ ID NO: 5589 - DNA, 203 bp, Homo sapiens
  source 1..203: mol_type = other DNA
ggcgcgccagtccttccgttagagcaacagcaccagccccttctagacgttcaagtctccattgcaggcgccccccctcgacctacccaggcactcttagacacgggggctgatctcaccgtcctgccccaggcccttgcccccgagtcagtaagtgtttctgatacaacggttctgggcgctggcggcgactcggaccgatg

SEQ ID NO: 5590 - DNA, 203 bp, Homo sapiens
  source 1..203: mol_type = other DNA
ggcgcgccagtcctacagaccagctcccagttcaaactccttcaatcccccctgtgcgtctacctacccttccggagggcccctgttaccctcccatcatgccttgtagacaccaatagcaaatgggccattattggccgtgatatcctccagaaatgccagagtgtcctgtaccttccggaggacaacgactcggaccgatg

SEQ ID NO: 5591 - DNA, 203 bp, Homo sapiens
  source 1..203: mol_type = other DNA
ggcgcgccagtccttctgtgcaagggtaccccccggctccccgatggaataactcctccccgattattacccgtgaccacccccaatgtcattggccttgagcacttcccaccacccccacagatagatcagttccctttaaacctgagcgcctccaggccttgactgacctggtctccaaggccctgcgactcggaccgatg

SEQ ID NO: 5592 - DNA, 203 bp, Homo sapiens
  source 1..203: mol_type = other DNA
ggcgcgccagtcctgaggctagctacattgaaccttactctggaccaggtaataaccccgtctttccagtcaaaaaaccaaacggcaaatggagatttattcatgacctaagggccaccaatgccatcacgaccaccttggcctccccgtcccccggacctcccgatctcaccagcttatcaacagcccgactcggaccgatg

SEQ ID NO: 5593 - DNA, 203 bp, Homo sapiens
  source 1..203: mol_type = other DNA
ggcgcgccagtcctctcccatacctgcaaactatagaccttactgacgccttcttccaaatcccccttccaaaacagttccagccatacttcgccttcaccatcccccagccatgtaattatggccctggggctcggtatgcctggactgtccttccacagggatttaaaaacagccccaccctgttccgactcggaccgatg

SEQ ID NO: 5594 - DNA, 203 bp, Homo sapiens
  source 1..203: mol_type = other DNA
ggcgcgccagtcctgaacaacagctggccgccgtcctttcccccatcaggaaaaccttccctatgtctactatcatccaatatatggatgatatactcttggccagtcctacacaagaggaactgcaacaactctccaagatgaccctccaagcgctagtcacccacggccttccagtctctcaggagcgactcggaccgatg

SEQ ID NO: 5595 - DNA, 203 bp, Homo sapiens
  source 1..203: mol_type = other DNA
ggcgcgccagtcctaaaacccaacaaacccctgggcaaatacgtttcctgggtcaagttatatctcccaaccatattacctatgaaaccacccccaccattcccatcaaatcccaatggactctcactgaactacagactgtactaggagagattcaatgggtctcaaaaggaacccccattctccgccgactcggaccgatg

SEQ ID NO: 5596 - DNA, 203 bp, Homo sapiens
  source 1..203: mol_type = other DNA
ggcgcgccagtccttcgtctggcacaacctccgtcctcttccaagcccgacagcgatggcccctggtttggctgcacaccccccatcccccaaccagcctgtgcccctggggtcacttgctggcctgcactatcctgaccttggacaaatactccctccagcactatggccagctgtgccagtccttccgactcggaccgatg

SEQ ID NO: 5597 - DNA, 203 bp, Homo sapiens
  source 1..203: mol_type = other DNA
ggcgcgccagtcctctccaccatattcgtagccacaccaatctccccgaccccatctccactcttaacgaatacacagactcactcattatagcccctctcattcccctaacacctcaggatctgcataaacttacccattgcaactccagggcccttgtttcctcaggggccaccccacagcaagcccgactcggaccgatg

SEQ ID NO: 5598 - DNA, 203 bp, Homo sapiens
  source 1..203: mol_type = other DNA
ggcgcgccagtcctaacgcagtctccattacctgcaagacaaaagagactagttctgaaactgtcagcgccctcctgcacgctatcactatcttaggcaagcccctttctataaacactgacaatggttctgccttcctatctcaagaattccaggccttttgcgcctcatggcacatcaaacattcccgactcggaccgatg

SEQ ID NO: 5599 - DNA, 203 bp, Homo sapiens
  source 1..203: mol_type = other DNA
ggcgcgccagtcctacccatgtgccttacaactctaccagctccgggctagtagaaaggaccaatggcattgttaaggccctcctcaacaaatatcttttagacagcccaaacctccccctagacaatgccatcagtaaagccctatggaccctaaaccaactcaatgtcatgtcgtcccagtggaaacgactcggaccgatg

SEQ ID NO: 5600 - DNA, 203 bp, Homo sapiens
  source 1..203: mol_type = other DNA
ggcgcgccagtcctcacgcttacggtaggtgtctcctcgtatcactctagtccctgcagtcttgcccaacctatctgcacctgggatctcgaccttcattccttaactacagaccaacgtctgtaccctccatgccccaatctagtttcttactctaacttccacaagtcctactccttatatttgttcgactcggaccgatg

SEQ ID NO: 5601 - DNA, 203 bp, Homo sapiens
  source 1..203: mol_type = other DNA
ggcgcgccagtcctagaggtcaaccatgtaaccctccggctacacttctcccgatgtggctcttctatgaccctcctcatagacgccccaggctacgaccccctgtggttcatctcttcggaacccactcagcccccccccacttccccaccattagtccgcgactctgaccttgaacatatcttaaccgactcggaccgatg

SEQ ID NO: 5602 - DNA, 203 bp, Homo sapiens
  source 1..203: mol_type = other DNA
ggcgcgccagtcctcccctcctcctcctgggctactaggatgctaaccctcatccaactaactctacaaagtaccaattattcttgcatggtttgtatagacagaaccagcttgtcgtcctggcacgtactctatacccctaatatctctgcctcacctgggggcgactccttgcctatactttatcccgactcggaccgatg

SEQ ID NO: 5603 - DNA, 203 bp, Homo sapiens
  source 1..203: mol_type = other DNA
ggcgcgccagtcctctccttggccctaccggccccccaaccccagccgttttcctggtctcactgttaccagccccacctacaggcagtaactacagccaattgcaacaattccattgtcctgcccccattctctctcaccccggtgccttcccctgggacaagaagccgccgggctattccagtggccgactcggaccgatg

SEQ ID NO: 5604 - DNA, 203 bp, Homo sapiens
  source 1..203: mol_type = other DNA
ggcgcgccagtccttgtatggctcgtctcagccctagcggccgggactggtattgcagggggaataaccggatccctgtccctagcatcaagccgcagcctgctttttgaagttgacaaagatatttcccacctcacacaagccatcgttaaaaaccatcaaaacatcctccgcgtagcacaatatgccgactcggaccgatg

SEQ ID NO: 5605 - DNA, 203 bp, Homo sapiens
  source 1..203: mol_type = other DNA
ggcgcgccagtcctgctccccctccaagacactgatatatccctctaacatctcacaatacccttcaaaccccagcaaccctatacactctaactgttgatgtctcttttcgcgctctcgacgcttttcttccttctcccgcagccgctcccttctgcgctgctccttctcctcgcgttgtttcagaacgactcggaccgatg

SEQ ID NO: 5606 - DNA, 203 bp, Homo sapiens
  source 1..203: mol_type = other DNA
ggcgcgccagtccttttccatgatttccttctgctcttccgccagcgccctccggcgaccatcccgtacatcctctccgaccgaccctgatcctaagggtcgcccccgtgttgtctttctcaggcctcctccagaacacgatacaccagtcaccaccacctcaggatcccccaatggcagccttctgacgactcggaccgatg

SEQ ID NO: 5607 - DNA, 203 bp, Homo sapiens
  source 1..203: mol_type = other DNA
ggcgcgccagtcctaatactctaaacaaaatacatgcctttcttcagcccactttccaggtttcggacagagcctcctctatggatacccagtctacgtgtttggcgattgtgttcaagccgattggtgtcccgtttcaggtgggctttgttccacccgcctgcaccggcatgcccttctcgccacctcgactcggaccgatg

SEQ ID NO: 5608 - DNA, 203 bp, Homo sapiens
  source 1..203: mol_type = other DNA
ggcgcgccagtcctgcccggagcaccagctcacctgggaccccatcgatggacgcgttgtcggctctcctctccaataccttatccctcggctcccctccttccccacccagagaacctccaagaccctcaaggtcctcactccccctaccactcctgtctcccccaagattccacccgcctttttcccgactcggaccgatg

SEQ ID NO: 5609 - DNA, 203 bp, Homo sapiens
  source 1..203: mol_type = other DNA
ggcgcgccagtcctaatccatgcgtaaactctccccctaccggaacgggtgcctatacccaactctcggagaccagctcccctcccttgccttccccgaccccggtctccggccccaaaacatctacaccacctggggaagaaccgtagtttgcttgtacctctaccaactatctcccccgatgacctcgactcggaccgatg

SEQ ID NO: 5610 - DNA, 203 bp, Homo sapiens
  source 1..203: mol_type = other DNA
ggcgcgccagtcctccccctgcgtccagacggcttgggacacggggcttttaccctaccactctctcataactactccaggcctaatatggacgttcaatgacggttcgcccatgatttccggcccctgccccaaaccggggcagccatctttggtggtacaatcctccctgttaatctttgaaaaatcgactcggaccgatg

SEQ ID NO: 5611 - DNA, 203 bp, Homo sapiens
  source 1..203: mol_type = other DNA
ggcgcgccagtccttttatatcgtgtgtacatataaatatgtacacacggcttttaggtagaatattgttttcaatgttgattttaaaggtaactttggttattatgctttacggttttcattgttgatggtatttgtggcctgcggtccctaattgttgaattatttattctgatacgttgttttcacgactcggaccgatg

SEQ ID NO: 5612 - DNA, 203 bp, Homo sapiens
  source 1..203: mol_type = other DNA
ggcgcgccagtccttgtgtatgatctatacgcacatttagttcccagagggcgttgtcgtctccccctaagcaagggagaaacacgtggcacatgatcttgcgcttaacgataaaaatggaatctgataaaagtatggcctgtttaaatagaattttgatgaataagatgatgtttgtggaagataagcgactcggaccgatg

SEQ ID NO: 5613 - DNA, 203 bp, Homo sapiens
  source 1..203: mol_type = other DNA
ggcgcgccagtcctatctctacccttaagatggttgctgattattatcaaaaagaagtaaagtatgattttgatgcagttgaatctccccgtgaggcacctgtatttagatgtacttgtcgattccttggttataccattatgactcaaggcatcggtaagaagaatccgaaacaggaagctgcacgtcgactcggaccgatg

SEQ ID NO: 5614 - DNA, 203 bp, Homo sapiens
  source 1..203: mol_type = other DNA
ggcgcgccagtcctcagatgttgctcttgttatcaggagatgttgagactaaccctggacccgttcaatcgcgccccgtgtattatcgttacaacgaccctagatatacacggttggaaaaagctattgaacgtcgagacgataaaattaaaacattaattaaagagttgcgtcgacaaatcaaaaatcgactcggaccgatg

SEQ ID NO: 5615 - DNA, 203 bp, Homo sapiens
  source 1..203: mol_type = other DNA
ggcgcgccagtcctgaattggatcaacggaataaaattgatctagatactgaaaccgcaaatcgtgttgaacaactttggataaagggcttgaaattcaagagtgaaccccttttgagtaaggaaatgtcagctttagttcatacaactcttttaccagctaagcaattgtacgagtatgtatcgtgtcgactcggaccgatg

SEQ ID NO: 5616 - DNA, 203 bp, Homo sapiens
  source 1..203: mol_type = other DNA
ggcgcgccagtccttctcctgttaaagggggaggaccacgtatgcgtccaatttgtttatggttggtaggtgaatcaggagttggtaagactgaaatggtatatccattgtgcattgatgttcttcgggaaatggggatgattaagaaagatgattttcatcatcaagtttatggtcgtcaagttgaacgactcggaccgatg

SEQ ID NO: 5617 - DNA, 203 bp, Homo sapiens
  source 1..203: mol_type = other DNA
ggcgcgccagtccttggttaggtcgattctttttgagtcgagatcgcaagaataaggttggaatttgggccgaagtgggacaatcaggtgatgttaaaacaaataaagctcagattaaacgtgttgaagctggagccgaagaattagttactgttgctttaactcaaggttgttctgatgatgctgcacgactcggaccgatg

SEQ ID NO: 5618 - DNA, 203 bp, Homo sapiens
  source 1..203: mol_type = other DNA
ggcgcgccagtcctcaggcagttaattcgtccataattccttctcgaatttatgggaagttgtctgttcctacaatgaaaccagcactactcaagccaacgattctgaataacaaagtacataatcctttattgtcgggacttaagaaatgtggtgtagacactgcggtcttgagtgatgatgaagttcgactcggaccgatg

SEQ ID NO: 5619 - DNA, 203 bp, Homo sapiens
  source 1..203: mol_type = other DNA
ggcgcgccagtcctatgaaaagaaatgctccaggtaaacagcaatggatgggttttggtgaagaatttgattttacaagtaattatgcactagctttgcggaaagatgttgaacaactcattgaagattgtgctagcggaaaaatatctaatgtcatttttgtagatacattgaaagatgagcgacgccgactcggaccgatg

SEQ ID NO: 5620 - DNA, 203 bp, Homo sapiens
  source 1..203: mol_type = other DNA
ggcgcgccagtcctgcaaaacgtcttaaaacaaaaggtagtcacgtcattgcgggggactttggaaatttcgatggatctttagtagcacaaattttgtgggccatattttgggaaatttttgttgtatggcttaagcaatttattgatatagagaattcagaaggaaaacgtattttatgtatctgtcgactcggaccgatg

SEQ ID NO: 5621 - DNA, 203 bp, Homo sapiens
  source 1..203: mol_type = other DNA
ggcgcgccagtcctaaatctcgtaaattagaagatattttctttttgaagagaaaatttcgttttagcccagaattacaacgccatgttgctccattgaagatcgaagttatttatgaaatgttgaattggtctcgccgctctatagatccagatgaaatcttgatgtcgaacattgaaacggcttttcgactcggaccgatg

SEQ ID NO: 5622 - DNA, 203 bp, Homo sapiens
  source 1..203: mol_type = other DNA
ggcgcgccagtcctgtgaatcgaaactgcgtggtcaagttcgaatggcgaattttgatggcgctgatacatcacataaattggctttgtctgcccaaaacgaaattgaaacaaaatctggactttctggaacttctcctgatgaaatggatttatcacacgtcctttccataccaaatttttgggatccgactcggaccgatg

SEQ ID NO: 5623 - DNA, 203 bp, Homo sapiens
  source 1..203: mol_type = other DNA
ggcgcgccagtcctaatttgttaagactcaatttcattctggacgtttacgcattagttttattccattttattataatacgactatatctgcaggagttcccgatgtttctcgtacccaaaaagtaatcgttgatctgcgcacctctacagaagtctctttcactattccgtatgtgtcttcacgaccgactcggaccgatg

SEQ ID NO: 5624 - DNA, 203 bp, Homo sapiens
  source 1..203: mol_type = other DNA
ggcgcgccagtccttgggtgaagatttagctattcaaagaaacgatgctcaacatggtgttcatccaatgactatagacactcataagatcgactcaaattggtctccggaagcgcattgtattggtgaaaagattatgtctattcgccaattgattaagcgttttggcatggctttgaactccttgacgactcggaccgatg

SEQ ID NO: 5625 - DNA, 203 bp, Homo sapiens
  source 1..203: mol_type = other DNA
ggcgcgccagtcctaagtttctttttggttttgggttttattcagtaactatctgccctgcttacacgggtattatttttaattcttgtcccttctggactcttttattttgtattttcaaaatttttactaatttttagtcagagtccttaggggctaccaggtttttcgcaattttcctgcttactcgactcggaccgatg

SEQ ID NO: 5626 - DNA, 203 bp, Homo sapiens
  source 1..203: mol_type = other DNA
ggcgcgccagtcctgccgggtggaaggcccggaaccgccccaccacctcaactaggtggtaagggtacgtctatgggtccggctggcccgaaaggcggtggatcctgtgtgttagggttcgtaggtggtaaatcccagcacaggtggtaatcgctatagggcaggcttatcccggtgaccgcttccctcgactcggaccgatg

SEQ ID NO: 5627 - DNA, 203 bp, Homo sapiens
  source 1..203: mol_type = other DNA
ggcgcgccagtcctactgtgtgtacacagtcttgctggactctctacagacctggagttgctacgcggcctggctcccagcccggagagcttcttgggaagtttggcggagccttaggcccggtggcctcagctgcttacacagcaggggtcttgggcctgggtgaaccattctccctcgctttctgtcgactcggaccgatg

SEQ ID NO: 5628 - DNA, 203 bp, Homo sapiens
  source 1..203: mol_type = other DNA
ggcgcgccagtccttttggcgactgggtgccattgtatgatgagctgcccaggagtgctctttgcaccttctatgcggggaccggcaggtatccggctgatgttgatgtcttgaatccctccggtcctccatgtgctagttgtgtcgtggaccagagaccacggaaatgtggtgactgtgtccgcgaccgactcggaccgatg

SEQ ID NO: 5629 - DNA, 203 bp, Homo sapiens
  source 1..203: mol_type = other DNA
ggcgcgccagtcctaagaagcttggggtcaacatgactgtgagccagataggaggttattggcacgcccttcagtgtccatgtgattttacacctggtccgctaccagagcggattcccggaatcccagtgaatgcttgcatcaccggaaaggccgcgcacccattctctgcgtgggcgccggggggtcgactcggaccgatg

SEQ ID NO: 5630 - DNA, 203 bp, Homo sapiens
  source 1..203: mol_type = other DNA
ggcgcgccagtcctgtcaagcctttgccctgcccgaactcgaccacgggcttgggtgattcagtcagtaacgccgcctgcttcgctggttccgacttgtggctcggggtcggtggtgcttggtcggccctttctggcgccacgtccgctgtcgccagttgggtcggctcggcctaccggaccttgcaccgactcggaccgatg

SEQ ID NO: 5631 - DNA, 203 bp, Homo sapiens
  source 1..203: mol_type = other DNA
ggcgcgccagtcctaatgtgggtctcggcgtgagatggttggcatcggtgggctcttacctaccgaccgtggaggccgcgctggctcctgagctggtgtgtgctcccgtggttggttggggggcacaggagtcttggttcgtggggttcctagcagtgtgttgtgtggtcgcttaccttggggttctccgactcggaccgatg

SEQ ID NO: 5632 - DNA, 203 bp, Homo sapiens
  source 1..203: mol_type = other DNA
ggcgcgccagtcctggcactgccagatgctgcgtgctggtggcgatgcacttcgcaagaggtgcgctgcccctagtcatgctagtgttggcaggggtgtcgcgagagcggcattccgtcttgggtctcgaggtttgcttcaacttggagggcactggttgggactggagtgactactggtggtgtgtgcgactcggaccgatg

SEQ ID NO: 5633 - DNA, 203 bp, Homo sapiens
  source 1..203: mol_type = other DNA
ggcgcgccagtcctgctggggtggtgtcttgggcccttgtcaccatgggtctcttgacccacggtggcaaggaggtgaagcttaggtggtatcgcacctggtgcgtgttctaccaaaaggttcgcctgcgcctgttggacactcccataggcaaccgcccccgccggcctttgtgcaaactgtggctgcgactcggaccgatg

SEQ ID NO: 5634 - DNA, 203 bp, Homo sapiens
  source 1..203: mol_type = other DNA
ggcgcgccagtcctggtgccacacacctggccgagcgcctacgtcgcaggggggtattcctgtttgagcacgctggacatgtcacacggccagcggcagagcggttgcgggaatggggttttgccctagagcccgtcgctgtgaagccagaggactgtgccatagttcgggatgccgcacgagtgttgcgactcggaccgatg

SEQ ID NO: 5635 - DNA, 203 bp, Homo sapiens
  source 1..203: mol_type = other DNA
ggcgcgccagtcctggttgtggtcagagagtgaatggtgtgcctgtggtcgcccgtaggggagacgaagtgctcatagggtgcttgtccagcaggttcgacctcccacccgggttcgtgccgacggctcctgtcgtcgtgcaccaccaggggaaggggttttttggggtcgtcaagacctcaatgacccgactcggaccgatg

SEQ ID NO: 5636 - DNA, 203 bp, Homo sapiens
  source 1..203: mol_type = other DNA
ggcgcgccagtcctgatgtgtgtgtatacccattgccaatgggggctacctgcttggaaccttgcaaatgctcaccgcagggcgtttgggtcgtgagaaacgacggagcgctctgccatggcactctcgggaagactgttgagctggacctaccagctgagctgtgtgacttccgggggtcgtctggccgactcggaccgatg

SEQ ID NO: 5637 - DNA, 203 bp, Homo sapiens
  source 1..203: mol_type = other DNA
ggcgcgccagtcctactgcttattctaggactactcaatctaacctgacttactgtacttatggaagattcatggcaaatcccagaaagtacctccgcggccatgacgtggtgatctgcgacgagtgtcactcgactgacggcgttagtgttctgggcatgggacgtgcccggttgctggcgaaagaacgactcggaccgatg

SEQ ID NO: 5638 - DNA, 203 bp, Homo sapiens
  source 1..203: mol_type = other DNA
ggcgcgccagtccttgtcgggttcgcttgttgctgtttgccactgcgacccctccgggggccccaatggccgcacatgacaatattactgaggagccccttgacaccgaaggggagatcaccttttatggacacaggttgccagttgcaagatacgccactgggagacacctgcttttctgccactcacgactcggaccgatg

SEQ ID NO: 5639 - DNA, 203 bp, Homo sapiens
  source 1..203: mol_type = other DNA
ggcgcgccagtcctatggtggaggaggtggtcgaggtcaccttggaccccaccataacaatttcactgcggacagtgccagcaccagcagagttgaggatgcaacgcagggggcggtgtggacgtggtaggaccggacactactactccgcgctggctgctgcagcgccggcaggtaccgtgcgctctcgactcggaccgatg

SEQ ID NO: 5640 - DNA, 203 bp, Homo sapiens
  source 1..203: mol_type = other DNA
ggcgcgccagtcctcaggcctcaacgggtctggccatggcgggtgcttacttcgccggggggtcgataaccagctcttggttgagcatcatcataaccctgcttggtggttgggagggcgccgttaacgcggcctctctcacttttgacctcctttctggcaaggcagaggccaaggacgcctggtgccgactcggaccgatg

SEQ ID NO: 5641 - DNA, 203 bp, Homo sapiens
  source 1..203: mol_type = other DNA
ggcgcgccagtcctgctgttaaagccagtccctgcttcgccggtgatttgcctgtctcttgggaggccccaatctgtaggccagcaatggtctataggggaggccagactatccagctggatggagtgcgccgtacgttgccttgtggcttgccacttggagcgcgcccccctcctcggcaggagcaacgactcggaccgatg

SEQ ID NO: 5642 - DNA, 203 bp, Homo sapiens
  source 1..203: mol_type = other DNA
ggcgcgccagtcctcccacccatgtgagcaactggagcaaggaggaggaagctgagcttcagtgtgcgaaggctgctgctattgaggctatagggtctgcactgcatctccctagccaagaggctgcggaagcagccttgcaggctctggaggatgctgctgtgtccctactgccccatgtgcctgtccgactcggaccgatg

SEQ ID NO: 5643 - DNA, 203 bp, Homo sapiens
  source 1..203: mol_type = other DNA
ggcgcgccagtcctcgtgcggaatcaatcaacgatctgcgcgcgcccctcgcgagcttcgacagcatgccaagccttgaaacgtcagactccatgccatcattggagtccagctctggatccagctttgaggttgtctcgttgaccgagtctgaaccagaaactgtgatcgagggaggtttgaccctccgactcggaccgatg

SEQ ID NO: 5644 - DNA, 203 bp, Homo sapiens
  source 1..203: mol_type = other DNA
ggcgcgccagtcctaagaaacatccggctgcgataactgtggatgccacttgctttgattcgtcaatcgacgaacatgacatgcaggtggaagctgcaatcttcgcggccgctagtgacgaccccgtccgggtgcatgctttgtgcaggtactatgtcgagggccccatggtgtcaccggatggcgtgcgactcggaccgatg

SEQ ID NO: 5645 - DNA, 203 bp, Homo sapiens
  source 1..203: mol_type = other DNA
ggcgcgccagtcctaggacccttctacggattggtatgagttccccaccccgtaacttagaagtactagcaaaaccgaccaataggagcgtggcacccagctgcgttaaggtcaagcacttctgtctccccggccagaaatggtcgtcacccgccctctctactacgagaagcctattaaccattgaacgactcggaccgatg

SEQ ID NO: 5646 - DNA, 203 bp, Homo sapiens
  source 1..203: mol_type = other DNA
ggcgcgccagtcctattcagcaaccctgatattaccatacgtgaatgccattccgatggactcggccattaggcattcaaattggacactagctatcattccagttgcacccttgaaatatgcagccgagaccacgccgcttgtccccattactgtgactatcgcaccgatggagacggagtacaacgcgactcggaccgatg

SEQ ID NO: 5647 - DNA, 203 bp, Homo sapiens
  source 1..203: mol_type = other DNA
ggcgcgccagtcctttgagtctatccttgaggccaacaacagggaaggggtagagggtgttgagcggtatgtcatcccagtaagtgttcaggacgcattggatgcccagatttatgccctaagacttgagcttggcggaagtggccctctctcctccagccttctaggtaccttagcaaagcattatacgactcggaccgatg

SEQ ID NO: 5648 - DNA, 203 bp, Homo sapiens
  source 1..203: mol_type = other DNA
ggcgcgccagtcctcccaatggagtgggtcagtggagatcacctgcatgttcactggcaccttcatgacaacaggaaaggtcctcttggcatacacacctccaggtggagatatgcctaggaatagagaagaagccatgcttggaacgcatgttgtctgggactttggtctacaatcatcaataacctcgactcggaccgatg

SEQ ID NO: 5649 - DNA, 203 bp, Homo sapiens
  source 1..203: mol_type = other DNA
ggcgcgccagtccttggtcataccttggatctctgcatcacattttagaggagtcagtaatgacgatgtgctgaattaccaatattatgcagcaggtcatgtcaccatctggtaccaaacaaacatggtaatccctccgggattccctaacacggcaggcataatcatgatgattgccgcacagccaacgactcggaccgatg

SEQ ID NO: 5650 - DNA, 203 bp, Homo sapiens
  source 1..203: mol_type = other DNA
ggcgcgccagtcctaggccgctgagactggtgccacgtcaactgccagggatgagagcatgattgagacccgcactattgtgccgactcacggtatccacgagacaagtgtggagagtttctttggacgctcctcactcgtgggtatgccgctgctggccactggcaccagtatcaccaactggcgcacgactcggaccgatg

SEQ ID NO: 5651 - DNA, 203 bp, Homo sapiens
  source 1..203: mol_type = other DNA
ggcgcgccagtcctatcaagactcatttcagtggcaatctgggtgcaacccctcggtattcgcggacacggacggaccacctgcccaattctcagtacccttcatgagctcagccaatgcgtattccacggtttatgatgggtacgcacgattcatggacactgacccagatagatatggcatcctcccgactcggaccgatg

SEQ ID NO: 5652 - DNA, 203 bp, Homo sapiens
  source 1..203: mol_type = other DNA
ggcgcgccagtcctacgggtgtgacaccatcgctcgatgcaattgcagatctggtatctattactgcaaatccacagccaagcactatcctattgtagtcacgcccccatctatctacaagattgaggccaacgattattacccagaaagaatgcaaactcacatccttcttgggattggcttcgctgcgactcggaccgatg

SEQ ID NO: 5653 - DNA, 203 bp, Homo sapiens
  source 1..203: mol_type = other DNA
ggcgcgccagtcctttctaggttgtgaaggctctccatggaaatggctgaagagaaaggtttgccaaattcttggaatcaacatggcagaaaggcagtcagacaactggatgaaaaagttcactgagatgtgcaacgccttcagaggcctagactggatcgcagcaaaaatctccaagtttattgattcgactcggaccgatg

SEQ ID NO: 5654 - DNA, 203 bp, Homo sapiens
  source 1..203: mol_type = other DNA
ggcgcgccagtcctagaacgccccgctttatgccgcagaagctaagcgcgtctaccatctagagaagcgcgtcctccgtgccatgcagttcaagaccaagaaccgcattgaacctgtatgtgcactgattcatggctcacctggtaccggtcagtcgttggctactatgatagtaggaagaaaactggcgactcggaccgatg

SEQ ID NO: 5655 - DNA, 203 bp, Homo sapiens
  source 1..203: mol_type = other DNA
ggcgcgccagtccttcactgaacttaagcttgagcgcaacgtgaaccgtgcgctggcagtcattcagagtgtgtctctcattgctgcagtggctgggaccatttacatagtttatcgcctcttttctggtatgcagggcccttactcaggtatcggcacaaactacgccacaaagaaaccagtggtaacgactcggaccgatg

SEQ ID NO: 5656 - DNA, 203 bp, Homo sapiens
  source 1..203: mol_type = other DNA
ggcgcgccagtcctagctttttacctgcgtggggcgtgtcaaggactacggattcctgaaccttgctggcaggccaacacatagagttttgatgtatgaattccccaccaaggcaggccaatgcggtggtgtggttattagcatgggtaagatagtgggtgtccacgtaggaggtaacggtgcccaagcgactcggaccgatg

SEQ ID NO: 5657 - DNA, 203 bp, Homo sapiens
  source 1..203: mol_type = other DNA
ggcgcgccagtcctgttttgccgcctcccttctacgcaggtactttacagcagaacaaggacaaattgaatatatcgagaagagtaaagatgccgggtaccccgtgatcaatgcacccacccaaaccaaattagagcccagtgttttctttgatgttttccccggggtgaaagaaccagcggtactcccgactcggaccgatg

SEQ ID NO: 5658 - DNA, 203 bp, Homo sapiens
  source 1..203: mol_type = other DNA
ggcgcgccagtcctatgaactcagggcgccagataagatcaggaaaggaaaaagccgtttgatagaggcatctagcttgaatgattcagtagccatgcggtgctactttgggaacctctacaaggttttccacaccaaccctggaaccatctccggctgtgccgttggatgcgaccctgaaaccttctcgactcggaccgatg

SEQ ID NO: 5659 - DNA, 203 bp, Homo sapiens
  source 1..203: mol_type = other DNA
ggcgcgccagtcctctaacgattacgcgaacctgaatgaagcagaaggcttcatttggtgaccccgacgtgatcgttagggaatagtggtcggccacaggcgtggcgatcctgccctcatccgtctcgcttaacggagcaggacgatgaccctagtagagggggctgcggcttaggagggcagaagctcgactcggaccgatg

SEQ ID NO: 5660 - DNA, 203 bp, Homo sapiens
  source 1..203: mol_type = other DNA
ggcgcgccagtcctgagtgacgtcggagggagctccacggccggggggcaagataacctaccgagaactcagagagtcgttggaagacgggaaggaagcccgacgactgagcagtccaccccaggcgttgattctggtcgcccggtggatcaaagcatggaagccgtcataaaggtgatttcgtccgccgactcggaccgatg

SEQ ID NO: 5661 - DNA, 203 bp, Homo sapiens
  source 1..203: mol_type = other DNA
ggcgcgccagtcctacctgccccatatgccttatggatggacgcttggggagtccaactccagacggttatagcggcggccactcgcgacccccgacacccagcgaacggtcaaggacggggggaacggactaacttggatcgcttaaagggcttagctgatgggatggtgggcaacccacagggtcacgactcggaccgatg

SEQ ID NO: 5662 - DNA, 203 bp, Homo sapiens
  source 1..203: mol_type = other DNA
ggcgcgccagtcctagacctcccgccttccgcgcgggctccggtgatcattgactgctttaggcagaagtcacagccagatatccagcagcttatacgggcagcaccctccacagtgcacggccaggcagcagccgccgcgatgccgctcagcgccagcctccccagcaagaactacgattacgactacgactcggaccgatg

SEQ ID NO: 5663 - DNA, 203 bp, Homo sapiens
  source 1..203: mol_type = other DNA
ggcgcgccagtcctcgactcggtgcagccctacttctacttcgaggaggaggaggagaacttctacctggcggcgcagcagcggggcagcgagctgcagcctcccgccccgtccgaggacatctggaagaagtttgagctcctgcccatgccgcccctctcgcccagccgccgctccagcctggccgccgactcggaccgatg

SEQ ID NO: 5664 - DNA, 203 bp, Homo sapiens
  source 1..203: mol_type = other DNA
ggcgcgccagtcctcgagtctgaatccagcacagagtccagcacagaagcatcagaggagcactgtaagccccaccacagtccgctggtcctcaagcggtgtcacgtcaacatccaccaacacaactacgctgctcctccctccaccaaggtggaatacccagccgccaagaggctaaagttggacagcgactcggaccgatg

SEQ ID NO: 5665 - DNA, 203 bp, Homo sapiens
  source 1..203: mol_type = other DNA
ggcgcgccagtcctcgagaaggcgcccaaggttgtcatcctgaaaaaagccacggagtacgttctgtctctccaatcggacgagcacaaactgatcgcagagaaagagcagttgaggcggaggagagaacagttgaaacacaaccttgagcagctaaggaactctcgtgcataggaactcttggacatcgactcggaccgatg

SEQ ID NO: 5666 - DNA, 203 bp, Homo sapiens
  source 1..203: mol_type = other DNA
ggcgcgccagtcctaaaactgcctcataattgatactttgggcataagggatgatgggacattcttcatgcttggggatgaactcttcaacttttttcttttaaaattttgtatttaaggcattcctggtggccctgataacagcacaaccctcacctatcggaaggtttcgtgcttgttgttaaagccgactcggaccgatg

SEQ ID NO: 5667 - DNA, 203 bp, Homo sapiens
  source 1..203: mol_type = other DNA
ggcgcgccagtcctttaaaattttgtatttaaggcattcctggtggccctgataacagcacaaccctcacctatcggaaggtttcgtgcttgttgttaaagctgaacgtttctctttagacgagccatcagaactacaactattaggttcccagtctctccccattataactaatattactcggatcccgactcggaccgatg

SEQ ID NO: 5668 - DNA, 203 bp, Homo sapiens
  source 1..203: mol_type = other DNA
ggcgcgccagtcctggtctcactccctcacagttgctgtggtgttgtgattcctcttctgcagaagatattaataaagtgtataacagacaaatgtgactggcctgggctgctttcctttcttcgaacatggatataatttagataagtgaatttgaattaacattttggtgccgtgacccggattctcgactcggaccgatg

SEQ ID NO: 5669 - DNA, 203 bp, Homo sapiens
  source 1..203: mol_type = other DNA
ggcgcgccagtcctcatacccctcatgcagcattacctaaacttgcaaagcagacaggatgcaaaaattaaacaaactcccctagtcttacagcttgcgatgccagcgcagaccatgaacgggaataaaggatatgtaggctcttaccctacaaacgaaccatattattcgttccagcaacaacagcgcgactcggaccgatg

SEQ ID NO: 5670 - DNA, 203 bp, Homo sapiens
  source 1..203: mol_type = other DNA
ggcgcgccagtcctacctgcaccaagggccccacctggaaatgtacccagcaatacctgcttcttttgcaaacaaccgggtcattggaaagctgactgccccaataaaacacgtaatcttagaaacatgggaaatatgggacgaggcggaaggatgggaggccctccgtataggtcacaaccataccccgactcggaccgatg

SEQ ID NO: 5671 - DNA, 203 bp, Homo sapiens
  source 1..203: mol_type = other DNA
ggcgcgccagtcctcgcatttatacaacctcctcaaaaccaccaaaaccaatataatggccgcatggaccggtcacagctacaagcctctgctcaagagtggcttcccggtacatatcctgcataggatccaattgactgtccttatgaaaaatctggtacaaaaacaacccaagatgtaattaccaccgactcggaccgatg

SEQ ID NO: 5672 - DNA, 203 bp, Homo sapiens
  source 1..203: mol_type = other DNA
ggcgcgccagtccttaaaaatgctgaaattatggttacagtaaaccacacgaaaattcctatgttggtagatacaggcgcctgcctgactgcaataggaggggcggccacagtggttcccgacctcaaattaacaaacacagaaattatagctgttggtatttccgctgaaccagttccacatgtcttcgactcggaccgatg

SEQ ID NO: 5673 - DNA, 203 bp, Homo sapiens
  source 1..203: mol_type = other DNA
ggcgcgccagtccttaaagataaaaccgaaggactaaggccattaattagttcactagaaaatcaaggaatattgataaaatgccatagcccatgtaatacaccaatctttcctattaagaaagcaggtcgggatgagtatcgaatgatacatgacttacgcgcaataaataatatagttgcccccctcgactcggaccgatg

SEQ ID NO: 5674 - DNA, 203 bp, Homo sapiens
  source 1..203: mol_type = other DNA
ggcgcgccagtccttccggcgcacttatatatgcagtcttgtgaaaataatattccgcctcatgactgcgttttacttacccacacgatctccaggccccgacctgatttatctgatctcccaatacctgaccctgatatgactctgttttctgatggctcttatacaaccggcagaggaggagcggccgactcggaccgatg

SEQ ID NO: 5675 - DNA, 203 bp, Homo sapiens
  source 1..203: mol_type = other DNA
ggcgcgccagtcctaccttttctgatcctcctctctacaccaacggcggtaaaagttgaaggacgaccaacatggatacacctggatcattgcaagttattgcgatcatctctctcctcctcgttgggggggccagtcaaccagctactttcttagagaaagcacttccgactgatggtcccagcctgcgactcggaccgatg

SEQ ID NO: 5676 - DNA, 203 bp, Homo sapiens
  source 1..203: mol_type = other DNA
ggcgcgccagtcctttcgtaataaaacaatgcagaaagaaacgaggaaaaagacagatcacggtacctaacagcaccctttcccccacaggtactacagacttcacaaaatttacccctaatcctatatctcccaacagtacggccctgaatgagcttgagcaaaagactacaccaataggaacagagcgactcggaccgatg

SEQ ID NO: 5677 - DNA, 203 bp, Homo sapiens
  source 1..203: mol_type = other DNA
ggcgcgccagtcctctaaaacagggccagatagcattgattcgacatcacgaggctattactaccattcttggacaagaggcaacatatagcattaaagaaacacaggcattaatttcatctatcgaacaagaggcatggtataataatttattctcttggtatgacggctctgtatggtcacagctacgactcggaccgatg

SEQ ID NO: 5678 - DNA, 203 bp, Homo sapiens
  source 1..203: mol_type = other DNA
ggcgcgccagtcctttcactctggcttatggatgtgacgagtcagcaggatgggttaaccaacatgctgaatacatgggaaagccggtaatcgtgacattggcgggcctagtaattacgcctgtgggtttggcttggataccactcccacaacaagaaccattggaaaagttatttatggtccccaatcgactcggaccgatg

SEQ ID NO: 5679 - DNA, 203 bp, Homo sapiens
  source 1..203: mol_type = other DNA
ggcgcgccagtcctagcatgccacatgtcaccgtggccatggccgattatcatgagacaaaagaaatgggcaaaattgtgaaagacataaacaacgaagaacttcttttggtaaaaccacaactctttaagtgggaccgaagggttttttgtagcctgtccccttgttataagaggagttgtcactggcgactcggaccgatg

SEQ ID NO: 5680 - DNA, 203 bp, Homo sapiens
  source 1..203: mol_type = other DNA
ggcgcgccagtcctccaagccgaaaatgacttactacacccttacatgtaccattacattaaactatcttatcgacacagaacacccgactatcactccagtccggcccttcgagcggcagtagttattgctgcggccgtaaaaggtgcagatctgttagaaatgaatatgctcttcataatgatgtacgactcggaccgatg

SEQ ID NO: 5681 - DNA, 203 bp, Homo sapiens
  source 1..203: mol_type = other DNA
ggcgcgccagtcctattagatgatgtgatggcagtactggaggcagaggttgcaatcacgataaccacagccactgaaggcacggacgctgaagacacgagtgaggtcgacgtcatcaacgtcgtcgatccaataggataactatgttttcagactcagattcctcggacgaggaactaagcagaatacgactcggaccgatg

SEQ ID NO: 5682 - DNA, 203 bp, Homo sapiens
  source 1..203: mol_type = other DNA
ggcgcgccagtccttacacaatcatgaatagatacacgggggaatcaatagcagaaatgcacactgggtttaggtgtttcagggatcaaatgatagcctatgatatggagtttaccaattttctcagggatctgacagaggaagaaactccagtattagagataaccgaaccagagcccagccctacgcgactcggaccgatg

SEQ ID NO: 5683 - DNA, 203 bp, Homo sapiens
  source 1..203: mol_type = other DNA
ggcgcgccagtcctgtttgtcattatattgttgacacttaggaaagtgctgtataggcctaaagtagaaataacaactgatcgtggaacagttggtgctgaatgcatgttgccttcaaacagtgttttcttcaaacagtatttacttctgagaatccatgaaagtatataacggttgcttgttggtaacgactcggaccgatg

SEQ ID NO: 5684 - DNA, 203 bp, Homo sapiens
  source 1..203: mol_type = other DNA
ggcgcgccagtcctcattatattgttgacacttaggaaagtgctgtataggcctaaagtagaaataacaactgatcgtggaacagttggtgctgaatgcatgttgccttcaaacagtgttttcttcaaacagtatttacttctgagaatccatgaaagtatataacggttgcttgttggtaagaacggcgactcggaccgatg

SEQ ID NO: 5685 - DNA, 203 bp, Homo sapiens
  source 1..203: mol_type = other DNA
ggcgcgccagtcctggaccttaccttactgaggaaggatggctcgagaattaaatcctctccaattacagcaactgtatataaataatggcttacaacctaatccaggacatggagatattattgctgtcagatttacaggaggaccttggggtccaggtgatagatgggctagagtgacaatacgatcgactcggaccgatg

SEQ ID NO: 5686 - DNA, 203 bp, Homo sapiens
  source 1..203: mol_type = other DNA
ggcgcgccagtccttagtagcatctcatcccggcctaacgttgactgagaatgaggccgggagctggaatgctgccatatcagctttatggaggaaagctcacggtgctgcagctcagcatgaattggcaggagtattaagtgatattaataaaaaggaaggcatacaaactgcattcaacctaggaacgactcggaccgatg

SEQ ID NO: 5687 - DNA, 203 bp, Homo sapiens
  source 1..203: mol_type = other DNA
ggcgcgccagtcctagagagatcagagaggaccgtcgcaacctcctcgtggaagtggaggaggatataattttagaagaaatccgcagcagcctcagcgctacggccaaggaccaccaggaccaaacccgtaccgacgattcggagacggcggtaatcctcaacagcagggaccaccaccaaaccgagcgactcggaccgatg

SEQ ID NO: 5688 - DNA, 203 bp, Homo sapiens
  source 1..203: mol_type = other DNA
ggcgcgccagtcctgatttatccaatggtttctgggcacaccccatagtcccagaggattattggattactgcattcacttggcaaggaaaacaatattgttggactgttttaccacaaggttttttaaacagccctgggttgtttactggagatgttgtagatcttctacagggaattcccaacgtgcgactcggaccgatg

SEQ ID NO: 5689 - DNA, 203 bp, Homo sapiens
  source 1..203: mol_type = other DNA
ggcgcgccagtcctcccacctgctctggttggtcaccatacgttggccagctggtccaggagagggtgtacaggccgtcacaattaaggcctaagtggaggaagcctacaaaggtcttggaaatattgaatcctagaactgtgattatagtggaccatctaggccaacggaaatctgtgagtattgaccgactcggaccgatg

SEQ ID NO: 5690 - DNA, 203 bp, Homo sapiens
  source 1..203: mol_type = other DNA
ggcgcgccagtccttttggttttatcaagtactacagactgtggcataccagcttacgtgcctgtggttataacggtgaatgacacaatcagctgttttgataaagagtttaaaaggccacttaaacaggaactaaaagtaacaaaatatgcaccatccgttcctcaattagaactaagagttcctcgcgactcggaccgatg

SEQ ID NO: 5691 - DNA, 203 bp, Homo sapiens
  source 1..203: mol_type = other DNA
ggcgcgccagtcctttatcctttggagggaagcaaaagttgtattatatatgcaaccaatgtcataaaggaattcctgaaagtggatacataactctcaatactaaatattatctatatgagaaaggacctactgagactggcaccaaaggtctaactcttatgagaaggcatgtgcaaaattcccctcgactcggaccgatg

SEQ ID NO: 5692 - DNA, 203 bp, Homo sapiens
  source 1..203: mol_type = other DNA
ggcgcgccagtccttgtttcctgaacagtcggaaagaatccggaacacccaagacggatcctactcgtcctgcaacatcttatagcctatgccgaagcgactatcaagaagcaggatgttcccggcccactccttccaattctgagtccgtatgtaatggcttgggacaaccctcagaacgtggtcaccgactcggaccgatg

SEQ ID NO: 5693 - DNA, 203 bp, Homo sapiens
  source 1..203: mol_type = other DNA
ggcgcgccagtccttccatactcagaaaacgaatgcaagagcgtttgttttttttttatagaggttcccgaactattgtacctttgaatatggtttatcccttatttaaagatacgttaaatagtatcaggcatccagcgaattatacgcggtggggtttcgaatatttggacggaacagatattcgtcgactcggaccgatg

SEQ ID NO: 5694 - DNA, 203 bp, Homo sapiens
  source 1..203: mol_type = other DNA
ggcgcgccagtcctcaacgtttacagattgaatcattgaattgtccggaagcggtgtcacgtcgtatagattttgcttttaacgttcgtatagtaccagaataccaaatggaatatatgagcgctaatggtgataaattgtatagactagacgctgccaaggcaaggcaagattttggagacgttttacgactcggaccgatg

SEQ ID NO: 5695 - DNA, 203 bp, Homo sapiens
  source 1..203: mol_type = other DNA
ggcgcgccagtccttcttgtcctggaatacttgccaaatattattttgccaatgcggaaactgaaaagtcccgtgtttgcatcagtgctattggtgtttcagaacgagatgaagttgatgtaatgtctgtacctggatgcatggagatagtgcgtaatcgtgacttctacacttacacggcgccaactcgactcggaccgatg

SEQ ID NO: 5696 - DNA, 203 bp, Homo sapiens
  source 1..203: mol_type = other DNA
ggcgcgccagtccttttgatcaagccatattgggtatcgatggtgacccgtttatcaattctttggatcgtaatacggcacctgggttcccttactcaactatgaggaagggaacgaaaggtaaaacgttatggttcggcaatggtatggattatgaccttacgggaccgtatgcggttgcgttacgacgactcggaccgatg

SEQ ID NO: 5697 - DNA, 203 bp, Homo sapiens
  source 1..203: mol_type = other DNA
ggcgcgccagtcctccttttgttgctcatttatcacgtatgcgtattagaaatacgatatgtgtgggtgtcaaccctttttctagtgaatggagtgctgtagcacaaaaactcttagttaaaggaccgcacgttatagctggcgactattctaattttgacggttcgttacccgcccaactagtctatcgactcggaccgatg

SEQ ID NO: 5698 - DNA, 203 bp, Homo sapiens
  source 1..203: mol_type = other DNA
ggcgcgccagtccttgctgacgtgaaaacgttgcgtattgctacaacacttggttagctatttagctttactaatcaagacgccgtcgtgcagcccacaaaagtctagatacgtcacaggagagcatacgctaggtcgcgttgactatccttatatatgacctgcaaatataaacgaaaacactacaacgactcggaccgatg

SEQ ID NO: 5699 - DNA, 203 bp, Homo sapiens
  source 1..203: mol_type = other DNA
ggcgcgccagtcctcaaaaatacaacagcaaatcctttcttttagttcggaaggtgaatccccgtcgtcatccacagttttagcaccactcaaattgcaagatcctatattggattgcgcgagagatggaaaaactcatacagttaattcttttcttgagaggcctataaactttagaaccgcgacttcgactcggaccgatg

SEQ ID NO: 5700 - DNA, 203 bp, Homo sapiens
  source 1..203: mol_type = other DNA
ggcgcgccagtcctggagtaatcaaccagctggcgaaaggttattttcttttaattacccttctaatgttgttacgaatcctatgtacagcagaaaattgcaaaattttctaggtttgcgtgctgatttagttgttcgcgttcaagtcaacgctcaaccatttcatgcaggtagattaatgctgtcctcgactcggaccgatg

SEQ ID NO: 5701 - DNA, 203 bp, Homo sapiens
  source 1..203: mol_type = other DNA
ggcgcgccagtccttgacggggtcaggcgatattggaactttccaattaatcgtttattctccgttagtcgatttagtctcgggaggtaatatagactatacgatatgggttaatatgacaaacgtaagaacagagtttccaaccggtatgccaacttctatcgctcaggtgggagaagaaggcagtacgactcggaccgatg

SEQ ID NO: 5702 - DNA, 203 bp, Homo sapiens
  source 1..203: mol_type = other DNA
ggcgcgccagtcctggttacatgtcaactctacaccttgggtcactgcattttcgcagatccatgcgtgtaggtcgattgtcgtcgaggttcttaatgagctagttaacacatctaccgtatctgatactattgaagttttagtggaagtatgtgctgctgaagatattgaatttgccattcctatagcgactcggaccgatg

SEQ ID NO: 5703 - DNA, 203 bp, Homo sapiens
  source 1..203: mol_type = other DNA
ggcgcgccagtccttgccatctttaacaccgcgtgctgccccgcaaggttcatctcgtcgtactgcttacgatttgatcacaagcattgcgcaagtaggaactgatacgggagatacaccactcgaggtatctcgtgaagagccaacaacttttaacgatgtacctctccaaccaactacgactacatcgactcggaccgatg

SEQ ID NO: 5704 - DNA, 203 bp, Homo sapiens
  source 1..203: mol_type = other DNA
ggcgcgccagtccttcgaggcgggccctcatgtgttccacatgcagacttaaagaagtctacccccggcccgtctgggggatctaagtttttatcagttttcttagacctgaccttaattggttgggaggcgtaactgttactttatgtctggcgaacatgagaggtgctgtaatgtcatttttcgtccgactcggaccgatg

SEQ ID NO: 5705 - DNA, 203 bp, Homo sapiens
  source 1..203: mol_type = other DNA
ggcgcgccagtcctccgggtgaatcactctgcgagtgacgtgtgagtagcgaacagacgtgttcggggctcaccgcctggtaatccagggagacgtcccaggatcaggggaggaccagggacgcctggtggacccctcggtaacgggtcgttgtgacccgatttcatcgcccgtctggtaagacgcgccgactcggaccgatg

SEQ ID NO: 5706 - DNA, 203 bp, Homo sapiens
  source 1..203: mol_type = other DNA
ggcgcgccagtcctcccccgccctatccggcggcactgccaccccctctggcccctcaggcgatgggaccgccgtcaggccagatgcccgatagtagcgatcctgaggggccagccgctgggaccaggagtcgccgtgcccgcagtccagcagacaactcgggtcctgactccactgtgattttgccccgactcggaccgatg

SEQ ID NO: 5707 - DNA, 203 bp, Homo sapiens
  source 1..203: mol_type = other DNA
ggcgcgccagtcctctccgagccataggacccccggccgagcccaatggcctggtccctctacaatattggcctttttcctcagcagatctttataattggaaatctaatcatccctctttttctgaaaacccagcaggtctcacggggctccttgagtctcttatgttctcccatcagcccacttggcgactcggaccgatg

SEQ ID NO: 5708 - DNA, 203 bp, Homo sapiens
  source 1..203: mol_type = other DNA
ggcgcgccagtcctgacgattgccaacagctcctacagattcttttcaccactgaggaacgggaaagaattctcctggaggcccgcaaaaatgtccttggggacaatggggcccctacacagctcgagaacctcattaatgaggccttccccctcaatcgacctcactgggattacaacacagccgcacgactcggaccgatg

SEQ ID NO: 5709 - DNA, 203 bp, Homo sapiens
  source 1..203: mol_type = other DNA
ggcgcgccagtcctggtagggagcgtcttctggtctaccgccggactctagtggcaggtctcaaaggggcagctcggcgtcctaccaatttggctaaggtaagagaggtcttgcagggaccggcagaacccccttcggttttcttagaacgcctgatggaggcctataggagatacactccgtttgatcgactcggaccgatg

SEQ ID NO: 5710 - DNA, 203 bp, Homo sapiens
  source 1..203: mol_type = other DNA
ggcgcgccagtcctgacaaagaccagtgcgcatactgtaaagagaagggccattgggcaagagaatgtccccgaaaaaaacacgtcagagaagccaaggttctagccctagataactaggggagtcagggttcggaccccctccccgaacctagggtaacactgactgtggaggggacccccattgagcgactcggaccgatg

SEQ ID NO: 5711 - DNA, 203 bp, Homo sapiens
  source 1..203: mol_type = other DNA
ggcgcgccagtcctttcctggtcgacaccggagctgaacattcagtattgacccaacccatgggaaaagtagggtccagacggacggtcgtggaaggagcgacaggcagcaaggtctacccctggaccacaaaaagacttttaaaaattggacataaacaagtgacccactccttcctggtcataccccgactcggaccgatg

SEQ ID NO: 5712 - DNA, 203 bp, Homo sapiens
  source 1..203: mol_type = other DNA
ggcgcgccagtcctgagtgccctgctcctctgttgggcagggacctcctaaccaaactaaaggcccagatccagttttccgctgagggcccacaggtaacatggggagaacgccctactatgtgcctggtcctaaacctggaagaagaataccgactacatgaaaagccagtaccctcctctatcgaccgactcggaccgatg

SEQ ID NO: 5713 - DNA, 203 bp, Homo sapiens
  source 1..203: mol_type = other DNA
ggcgcgccagtcctccatcctggctccagcttttccccactgtatgggcagaaagagccggcatgggactagccaatcaagtcccaccagtggtagtagagctaagatcaggtgcctcaccagtggctgttcgacaatatccaatgagcaaagaagctcgggaaggtatcagaccccacatccagaagcgactcggaccgatg

SEQ ID NO: 5714 - DNA, 203 bp, Homo sapiens
  source 1..203: mol_type = other DNA
ggcgcgccagtcctcttccgcctagctatacttggtactcagtcttagatctcaaggatgcctttttctgcctcaggctacatcccaacagccagccgctgttcgcgttcgagtggaaagacccagaaaaaggtaacacaggtcagctgacctggacgcggctaccacaagggttcaagaactctccccgactcggaccgatg

SEQ ID NO: 5715 - DNA, 203 bp, Homo sapiens
  source 1..203: mol_type = other DNA
ggcgcgccagtccttcggctaagaaggcccagctctgccagagagaagtcacctatctggggtacctactcaaggaaggaaaaagatggctaaccccagcccgaaaggctactgttatgaaaatccctgttcctacgacccccagacaggtccgtgaatttctaggcactgccggattctgcaggctccgactcggaccgatg

SEQ ID NO: 5716 - DNA, 203 bp, Homo sapiens
  source 1..203: mol_type = other DNA
ggcgcgccagtccttggatccctgggtttgcttccctggctgcacccttgtaccccctaacaaaagagagcatcccttttatttggactgaggaacatcagcaggcttttgaccacataaaaaaagccttgctgtcagcccctgcattggccctcccagacctcaccaagccattcactctatatatacgactcggaccgatg

SEQ ID NO: 5717 - DNA, 203 bp, Homo sapiens
  source 1..203: mol_type = other DNA
ggcgcgccagtcctagggccaggaatacccctggccggtttggtttaactccttatgaaattctctatggaggaccaccccccatacttgagtctggagaaactttgggtcccgatgatagatttctccctgtcttatttactcacttaaaggctttagaaattgtaaggacccaaatctgggaccagcgactcggaccgatg

SEQ ID NO: 5718 - DNA, 203 bp, Homo sapiens
  source 1..203: mol_type = other DNA
ggcgcgccagtcctatcaaagaggtgtataagcctggtaccgtaacaatccctcacccgttccaggtcggggatcaagtgcttgtcagacgccatcgacccagcagccttgagcctcggtggaaaggcccatacctggtgttgctgactaccccgaccgcggtaaaagtcgatggtattgctgcctggcgactcggaccgatg

SEQ ID NO: 5719 - DNA, 203 bp, Homo sapiens
  source 1..203: mol_type = other DNA
ggcgcgccagtcctgtccatgcttctcacctcaaacctgcaccaccttcggcaccagatgagtcctgggagctggaaaagactgatcatcctcttaagctgcgtattcggcggcggcgggacgagtctgcaaaataagaacccccaccagcccatgaccctcacttggcaggtactgtcccaaactggcgactcggaccgatg

SEQ ID NO: 5720 - DNA, 203 bp, Homo sapiens
  source 1..203: mol_type = other DNA
ggcgcgccagtccttctccccgactctaactccacagccctggcgactagtgcacaaactcccacggtgagaaaaacaattgttaccctaaacactccgcctcccaccacaggcgacagactttttgatcttgtgcagggggccttcctaaccttaaatgctaccaacccaggggccactgagtcttgcgactcggaccgatg

SEQ ID NO: 5721 - DNA, 203 bp, Homo sapiens
  source 1..203: mol_type = other DNA
ggcgcgccagtcctctggctttgtttggccatgggccccccttattatgaagcaatagcctcatcaggagaggtcgcctactccaccgaccttgaccggtgccgctgggggacccaaggaaagctcaccctcactgaggtctcaggacacgggttgtgcataggaaaggtgccctttacccatcagcacgactcggaccgatg

SEQ ID NO: 5722 - DNA, 203 bp, Homo sapiens
  source 1..203: mol_type = other DNA
ggcgcgccagtcctgttgctcatcctcgggccatgcatcatcaataagttagttcaattcatcaatgataggataagtgcagttaaaattctggtccttagacagaaatatcaggccctagagaacgaaggtaacctttaattttgctctaagattagagctattcacaagagaaatgggggaatgaacgactcggaccgatg

SEQ ID NO: 5723 - DNA, 203 bp, Homo sapiens
  source 1..203: mol_type = other DNA
ggcgcgccagtccttttgaaaggggtctcctagagagcttggccgtcgggccttacaccccgacttgctgagtttctctaggagagtccctttcccagccagaggtggctggtcaaacaataccaaacgtaactaaacatctaagataacatagccctatgcctggtctccaccagttgaaggcatctcgactcggaccgatg

SEQ ID NO: 5724 - DNA, 203 bp, Homo sapiens
  source 1..203: mol_type = other DNA
ggcgcgccagtcctaacttagttcatttaaatctatttccaaatttgaaggtctttgaaaacagttattcatacttcagaggttctcttataatcaggttaagtgtttatgctagtacattcaacagaggccgtttgaatgggttctttccaaattccagtacagatgaaacttctgaaattgataatcgactcggaccgatg

SEQ ID NO: 5725 - DNA, 203 bp, Homo sapiens
  source 1..203: mol_type = other DNA
ggcgcgccagtcctcaagatgatggccctttaggaaatgacaaaccaaattattttcttaactttaagtctatgaatgttgatatctttactgtcagtcacaccaaagtagacaatatttttggacgtgcttggtttgcccatgttcatgacttcactaatgatggcctatggagacagggattggaacgactcggaccgatg

SEQ ID NO: 5726 - DNA, 203 bp, Homo sapiens
  source 1..203: mol_type = other DNA
ggcgcgccagtccttttccaaaggaagggcacggtgccctatcacttctgtttgcctactttactggtgaattaaacatccatgttctatttcttagtgataggggttttctcagagttggacatacatatgacactgagacaaacagaaccaattttttatcatccagtggcataattacagtaccacgactcggaccgatg

SEQ ID NO: 5727 - DNA, 203 bp, Homo sapiens
  source 1..203: mol_type = other DNA
ggcgcgccagtcctgcaggagaacagatgacactatctgtcccctcttattccaacaagccattacggacagttagatcatccaatgctttaggttatttactgtgtaaaccattgctaactggtaccagctctggtagaatagagatattccttagcttgagatgtccaaatttcttctttcccttacgactcggaccgatg

SEQ ID NO: 5728 - DNA, 203 bp, Homo sapiens
  source 1..203: mol_type = other DNA
ggcgcgccagtcctcttgattatgcttctgacattatagttaagtcaaaggaccagacaaaaatgaaaacacaagaattttatcagcgttacaatgattgtttgtctaaatttaaacccattatggcaatgtgctttagaagctgtcacaatagtattagtaacacagtctacagattattccaggaacgactcggaccgatg

SEQ ID NO: 5729 - DNA, 203 bp, Homo sapiens
  source 1..203: mol_type = other DNA
ggcgcgccagtcctagtgaattcatggatggatatgataatcaggatatacatttgattgatgatttgggccaaacaaggaaggagagggacattgagatgttgtgtaattgtatatcatcagatcccgatatagtccctatggcccaccttgaggaaaaaggcaaattctacacaagcaaattagttcgactcggaccgatg

SEQ ID NO: 5730 - DNA, 203 bp, Homo sapiens
  source 1..203: mol_type = other DNA
ggcgcgccagtcctatagccaccacaaataaacctgatttttccagtacagtcttattagattcaggtgctctgaggagaaggtttccatacattatgcatattagagctgctaaacattatagcaaatcaggcaaactaaatgtctcccaagctatgccacatatgtcaaccggcgagtgttgggaacgactcggaccgatg

SEQ ID NO: 5731 - DNA, 203 bp, Homo sapiens
  source 1..203: mol_type = other DNA
ggcgcgccagtcctgtggaagttaaaatgggcccagctgtactgagtaaatcggacactagactagaagaaccagtggattgtttggtcaagaagtcagcatcaaaatatagggtcaataaatttcaggtcaacaatgagctatggcagggggttaaagcttgtgttaagtcaaagtttagagaaatacgactcggaccgatg

SEQ ID NO: 5732 - DNA, 203 bp, Homo sapiens
  source 1..203: mol_type = other DNA
ggcgcgccagtcctcaagagaaattccacaacctcctaaaaggaaatcagattacaaccatttttaatacatgtctcaaggatgagttgaggaagctggataaaatcgcaaccggtaaaactcgatgtattgaggcttgtgaaatagactattgcattgtttacagaatgattatgatggagatatatcgactcggaccgatg

SEQ ID NO: 5733 - DNA, 203 bp, Homo sapiens
  source 1..203: mol_type = other DNA
ggcgcgccagtccttgggcgggcaagtgcggcaacagctactttgactactaagataagaatttttgtaccagcaactaatagcccagaactgagatgggagttgactttgttcgctctcgatgtaatcagatcaccaagtgcagcagaatcaatgaagattggtgctgctttcactctgatatcaatcgactcggaccgatg

SEQ ID NO: 5734 - DNA, 203 bp, Homo sapiens
  source 1..203: mol_type = other DNA
ggcgcgccagtcctgtactcagaaagacctggcgctttaatcaggagcctccttaacgacccagacatagaagctgtcatcatagatgtgggttccatgctcaacgggatccctgtgatggaaaggagaggggacaaagcacaagaggagatggaaggtttgatgaggattctgaagactgcacgtgacgactcggaccgatg

SEQ ID NO: 5735 - DNA, 203 bp, Homo sapiens
  source 1..203: mol_type = other DNA
ggcgcgccagtcctaagcagcaagggaaagaccccgtttgtagatagcagagcctatggactgaggatcaccgatatgagcactcttgtgtcagccgtcattaccatcgaagcccaaatttggatcctgattgcaaaggcagtgactgctccagatacagccgaggaaagtgagaccagaagatgggccgactcggaccgatg

SEQ ID NO: 5736 - DNA, 203 bp, Homo sapiens
  source 1..203: mol_type = other DNA
ggcgcgccagtccttgacataggaaattatgtcgaggaaacaggaatggccggcttctttgcgactatcagattcggtcttgaaacaagataccctgcacttgccctcaatgagttccagagtgatctcaataccatcaaagggctgatgctgctctacagagaaatagggcctcgagcgccatacatcgactcggaccgatg

SEQ ID NO: 5737 - DNA, 203 bp, Homo sapiens
  source 1..203: mol_type = other DNA
ggcgcgccagtcctggtgctccttgaggaatctattcagacaaagtttgcaccaggtggttatccactcctgtggagctttgctatgggtgttgcaaccactatcgaccgatccatgggtgctctcaacatcaatcgtggttatcttgaacctatgtatttcagacttggacagaaatcagcaagacacgactcggaccgatg

SEQ ID NO: 5738 - DNA, 203 bp, Homo sapiens
  source 1..203: mol_type = other DNA
ggcgcgccagtcctagatattgatgaggaagaagagcctatcgaacatagtggtaggcagtcagtgactttcaagagagaaatgagcatgtcatctctcgcagacagtgtcccaagcagttcagtgagtacatccggaggaacgagattgacaaattctctattgaatctcagatccagattagctgccgactcggaccgatg

SEQ ID NO: 5739 - DNA, 203 bp, Homo sapiens
  source 1..203: mol_type = other DNA
ggcgcgccagtcctcattatattaagaaaaacttaggatccaagaccataaatctaggatcctttacaatctcagaccctggtgcaaggttatatatagagcccaattctcctaattaaacagtgtctcaggttgacaaatggacaagttggatctagtcaatgatggcctcgatattattgactttacgactcggaccgatg

SEQ ID NO: 5740 - DNA, 203 bp, Homo sapiens
  source 1..203: mol_type = other DNA
ggcgcgccagtcctttcagaagaaccaaaaagaaatacaaaagacatacggacgatcaagcatccaacaaccaagtaccaaagacaggacaagagcatgggaggacttcttgcagagcaccagtggagaacatgaacaggctgaggggggaatgcctaagaatgatggaggtactgaaggaagaaatgcgactcggaccgatg

SEQ ID NO: 5741 - DNA, 203 bp, Homo sapiens
  source 1..203: mol_type = other DNA
ggcgcgccagtccttggaggatctatccagtgttacttcctcagatggaactattggacaaagagtgtcaaacacccgagcttgggcagaagacccagatgacatacaactggacccaatggttacagacgttgtataccatgatcatggaggagaatgtaccggacatggaccttcttcaagccctgcgactcggaccgatg

SEQ ID NO: 5742 - DNA, 203 bp, Homo sapiens
  source 1..203: mol_type = other DNA
ggcgcgccagtcctttccctttgtccccaagaatcaatcaaccccaactgaggagcctccagtcatcccggagtattactatggatctgggaggagaggagatctctcaaaatctcctcctagaggtaatgtcaatctggacagcatcaagatttacacttcggacgacgaggatgaaaatcagctggcgactcggaccgatg

SEQ ID NO: 5743 - DNA, 203 bp, Homo sapiens
  source 1..203: mol_type = other DNA
ggcgcgccagtcctagtatgaggatgagtttgccaaaagctcaagtgaggttgtcattgacactactcctgaggacaatgattctatcaaccaggaggaagtagttggggacccgtctgatcagggtttagagcatcctttccctttggggaaattcccggagaaagaagaaactcctgatgtacgcacgactcggaccgatg

SEQ ID NO: 5744 - DNA, 203 bp, Homo sapiens
  source 1..203: mol_type = other DNA
ggcgcgccagtcctattttgctaacactttcttaccccatgacactgataggttaaattatcatgcagaccatctcaatgattacgatttagagaccttgtgtgaggagtcagtattgatgggcatcgttaacgcaatcaaactcatcaacattgatatgaggttgaatcacattgaggaacagatgacgactcggaccgatg

SEQ ID NO: 5745 - DNA, 203 bp, Homo sapiens
  source 1..203: mol_type = other DNA
ggcgcgccagtcctttgatagagtagcagtcagaccaagatcatatattagaggtacacatcataatggccagtgtcttaatctcaaccattcataaaccgtcagtgtttcccttataaactccattatgtagtttattaatatctagagctattctttattaagtaataaatctgtattagattattcgactcggaccgatg

SEQ ID NO: 5746 - DNA, 203 bp, Homo sapiens
  source 1..203: mol_type = other DNA
ggcgcgccagtcctggatcttttagaagagctatgttctttgaaagtcactgtcagaagaacagctggggctacagagaaaattgtgttcgggtcctctggcccgcttcatcatctcttaccatggaagaagattctgactggcggatcaatattcaatgctgtcaaggtttgccgcaatgtggatcacgactcggaccgatg

SEQ ID NO: 5747 - DNA, 203 bp, Homo sapiens
  source 1..203: mol_type = other DNA
ggcgcgccagtcctgatctatgacgatgtgttcattgacaacacagggaagatcctaaaggggtgaaataaaacattcacttggttattgtagattgataaattaaccagataaccactttaatcttcattctaaagaatgccacagtgtcagtaagttacacaggtacaatacataatctaaattcacgactcggaccgatg

SEQ ID NO: 5748 - DNA, 203 bp, Homo sapiens
  source 1..203: mol_type = other DNA
ggcgcgccagtcctaagcaatggctacacaagaggtcaggctaaagtgtttgctctgtgggatcatagttctggttttgtcattagaagggctagggatactacattatgagaaacttagtaagatagggctggttaaaggtattacaagaaagtacaagattaagagtaaccctttgaccaaggatacgactcggaccgatg

SEQ ID NO: 5749 - DNA, 203 bp, Homo sapiens
  source 1..203: mol_type = other DNA
ggcgcgccagtcctttgtgatcaaaatgatccctaatgtctcgaatgtctcaaagtgcaccgggactgttatggagaattacaaaagcagactcacagggattctctcaccaatcaaaggcgccatcgaactgtacaataataacacgcatgacctagttggtgatgtcaagcttgcaggtgtggtgacgactcggaccgatg

SEQ ID NO: 5750 - DNA, 203 bp, Homo sapiens
  source 1..203: mol_type = other DNA
ggcgcgccagtccttggcagggattgcaatcgggatagctactgctgcacaaatcacagcaggtgttgccttatatgaggcaatgaagaacgcagacaatatcaataaactcaagagcagcatagagtctacaaatgaggctgttgtcaaattacaggaaacagctgagaaaacagtctacgtccttacgactcggaccgatg

SEQ ID NO: 5751 - DNA, 203 bp, Homo sapiens
  source 1..203: mol_type = other DNA
ggcgcgccagtcctctgctcttcaagattacatcaacactaaccttgttcctacaatagatcaaattagctgcaagcaaacagagctcgcattagacttggcgttgtctaagtatctgtctgatctgctctttgttttcggacctaacttacaggatccagtctctaattccatgactatccaagcaacgactcggaccgatg

SEQ ID NO: 5752 - DNA, 203 bp, Homo sapiens
  source 1..203: mol_type = other DNA
ggcgcgccagtcctaacaggcttatgtgcaggagttgcttccagtgagttttaataacgataattcagaatggatcagcattgtcccgaatttcgtgctgattaggaacacgctgatttcaaatatagaagtcaagtactgcttaatcaccaagaaaagtgtgatttgtaatcaggactatgctacaccgactcggaccgatg

SEQ ID NO: 5753 - DNA, 203 bp, Homo sapiens
  source 1..203: mol_type = other DNA
ggcgcgccagtcctagataggccccaaagtctcactaattgacacatccagcaccatcacaattcctgctaacatagggttactgggatccaagataagtcagtctaccagcagtattaatgagaatgttaacgataaatgcaaatttactcttcctcctttaaagattcatgagtgtaatatctcttcgactcggaccgatg

SEQ ID NO: 5754 - DNA, 203 bp, Homo sapiens
  source 1..203: mol_type = other DNA
ggcgcgccagtcctctataactaaagttgaaagagggaagtacgataaggtgatgccttacggtccatcaggtatcaagcaaggggatacattgtactttccggccgtcggttttttgccaaggaccgaatttcaatataatgactctaattgtcccataattcattgcaagtacagcaaagcagaaacgactcggaccgatg

SEQ ID NO: 5755 - DNA, 203 bp, Homo sapiens
  source 1..203: mol_type = other DNA
ggcgcgccagtcctttttctaccaggcatcatattcttgggatacgatgattaaattaggcgatgttgataccgttgaccctctaagagtacagtggagaaataacagtgtgatttctagacctggacagtcacagtgtcctcgatttaatgtctgtcccgaggtatgctgggaagggacatataatgcgactcggaccgatg

SEQ ID NO: 5756 - DNA, 203 bp, Homo sapiens
  source 1..203: mol_type = other DNA
ggcgcgccagtcctcttataatatactcaaaaaattaaaaattcccccaagaaaatactaaatgtaatcaaactcaataaaccctgaaatattgatagtttacagagatcatatgactctttgtataattctttatagaactcctaaatatcaaagagcgataaacttgctaccctgtacacttaaagcgactcggaccgatg

SEQ ID NO: 5757 - DNA, 203 bp, Homo sapiens
  source 1..203: mol_type = other DNA
ggcgcgccagtcctttttaggtatttatgagcaggacagactcagtaacatagggaaatacatgagtcaatcgcaatggtatgagtgttttctcttctggttcacaatcaagacagagatgagagctgttatcaagaactcacagaaacctaagtttagatctgactcttgtattattcatatgaaagcgactcggaccgatg

SEQ ID NO: 5758 - DNA, 203 bp, Homo sapiens
  source 1..203: mol_type = other DNA
ggcgcgccagtcctttagagagcatatgctagcagataaggtccttgaatacgggccaatcatgaaagcacacgcagtcttttgtggtacaattataaatgggtaccgtgacaggcatcggggagcttggcctccactttatctgccatcgcatgcatcgaaacacataataagactcaagaattctgcgactcggaccgatg

SEQ ID NO: 5759 - DNA, 203 bp, Homo sapiens
  source 1..203: mol_type = other DNA
ggcgcgccagtcctatcgccacaagtgtgataacactagccaaacattccttgactatcatatggaattcagtccctacaagtcagacagaatggataggacagagacatctgatttctcgaaatatgatgatggaacaggaacaaaatttgacacggtgagtgctttcctaactactgacttgaagacgactcggaccgatg

SEQ ID NO: 5760 - DNA, 203 bp, Homo sapiens
  source 1..203: mol_type = other DNA
ggcgcgccagtcctaattctgtctcaattggcgatatgaatccatggctatttttgcagaaagacttgacgaaatttatggcttacccggtttctttaactggatgcacaaacgattagagaagtcagtcatttatgtcgcagatcctaattgcccaccagacatcgggaaacatataaaccttgatgcgactcggaccgatg

SEQ ID NO: 5761 - DNA, 203 bp, Homo sapiens
  source 1..203: mol_type = other DNA
ggcgcgccagtcctaggtccaccctaatttaccttacaaagtcaagaaagaaatttgtgcaaggcaagctcaattatattttgacaggctcagaatgaatcttagggccttaggactcaacttaaaagcaacagagaccattataagtacacacttatttgtctactctaagaaaatacattatgatgcgactcggaccgatg

SEQ ID NO: 5762 - DNA, 203 bp, Homo sapiens
  source 1..203: mol_type = other DNA
ggcgcgccagtcctgagaggaaattgctggattacttgacacaacaaaggggctaataagatcaggattgaaaaagagcgggatacaacctaagttagtgtctagactgtctaaccatgattataatcagttcctgatactcaatagacttttgtccaataaaaagagaaacgatcttatatcccctacgactcggaccgatg

SEQ ID NO: 5763 - DNA, 203 bp, Homo sapiens
  source 1..203: mol_type = other DNA
ggcgcgccagtcctgttggtttttcgtgccacgagattcacaattagaccaagtgaataaagagcactcatccattagagtaccttacgtcggctcaagcactgatgagaggtcagatatcaaactaggaaacgtcaagagaccgacaagagcactgagatctgccatcgaattgcaactgtttataccgactcggaccgatg

SEQ ID NO: 5764 - DNA, 203 bp, Homo sapiens
  source 1..203: mol_type = other DNA
ggcgcgccagtccttggatcctgagctttttgccctttatttaggtcaatcaatttcagtcaagtgggcatttgaaatccatcatagacgcccacatggacgacatacaatggtagatttgttgtctgatctcatatccaatacatcgaaacatacatacaaagtcttgtctaatgcactgtcacatccgactcggaccgatg

SEQ ID NO: 5765 - DNA, 203 bp, Homo sapiens
  source 1..203: mol_type = other DNA
ggcgcgccagtccttactagatattagaggttgcataatatataatctagaagaaatcttatcaatgaatactaagtccacgtcaagaaaggtgttcaatttgggttcaaagttgtcagttgaaaaccacaaatatagaaggataggattaaattcgtcttcttgctacaaggcattaaatctgtcaccgactcggaccgatg

SEQ ID NO: 5766 - DNA, 203 bp, Homo sapiens
  source 1..203: mol_type = other DNA
ggcgcgccagtcctctaaaagcccggaactttataacatcaaaaattacataaggagaaaagttttgattctagacttcagatcccatactatgattaaactgctacctaaaggaatgaaagagagaagagagaaaagcggattcaaagaaatttggatatttgacttatctaatagggaagtcaaaacgactcggaccgatg

SEQ ID NO: 5767 - DNA, 203 bp, Homo sapiens
  source 1..203: mol_type = other DNA
ggcgcgccagtccttcaccctctttcccggtggtctggtcccggaccaccgttactccattcagcttcttcggaacctgttcggaggaattaaacgggcacccatactccccccacccccctttggtaactaagtatgtgtgctcgtgatcttggctcccacggaggggaccgatccgttggtgaacacgactcggaccgatg

SEQ ID NO: 5768 - DNA, 203 bp, Homo sapiens
  source 1..203: mol_type = other DNA
ggcgcgccagtcctaacagctaggtccacatcctcccttcccctgggagggcccccgccctcccacatcctccccccagcctgacgtatcacaggctgtgtgaagcccccgcgaaagctgctcacgtggcaattgtgggtccccccttcatcaagacaccaggtctttcctccttaaggctagccccgcgactcggaccgatg

SEQ ID NO: 5769 - DNA, 203 bp, Homo sapiens
  source 1..203: mol_type = other DNA
ggcgcgccagtcctgcgtgtgaattcacgttgggcaactagtggtgtcactgtgcgctcccaatctcggccgcggagtgctgttccccaagccaaacccctggcccttcactatgtgcctggcaagcatatctgagaaggtgttccgctgtggctgccaacctggtaacaggtgccccagtgtgcgtacgactcggaccgatg

SEQ ID NO: 5770 - DNA, 203 bp, Homo sapiens
  source 1..203: mol_type = other DNA
ggcgcgccagtcctaccttcttccgtctccggacggtagtgattggttaagatttggtgtaaggttcatgtgccaacgccctgtgcgggatgaaacctctactgccctaggaatgccaggcaggtaccccacctccgggtgggatctgagcctgggctaattgtctacgggtagtttcatttccaatccgactcggaccgatg

SEQ ID NO: 5771 - DNA, 203 bp, Homo sapiens
  source 1..203: mol_type = other DNA
ggcgcgccagtcctcttttatgtcggagtcatggctgcaacacgggtttcacgatctgtgctcgctgctgtggctcactctgccgctcaccgcacctaccacactgtccttgactgctatgataggctttacctcaacaccaacccccatctctcttatccccttcccaaaaactcttccttcccttgcgactcggaccgatg

SEQ ID NO: 5772 - DNA, 203 bp, Homo sapiens
  source 1..203: mol_type = other DNA
ggcgcgccagtcctaacatactactctgaccttcagcaaaagttctttgacaaattggctctcctctctcttccaggtgcctaccaagcaaagaccccggaggagcgtgccctcgcgggcgcgctcacccaactcctcaacttcccctccaccccccctctcacactccctaccactaacctccaacgcgactcggaccgatg

SEQ ID NO: 5773 - DNA, 203 bp, Homo sapiens
  source 1..203: mol_type = other DNA
ggcgcgccagtcctccgcacctggttgttggatacagtcacctggtcccaggagttcacccgcggctggaacatcgcaggctccaatggcatgcaatggaccggcctggaatcccttatcttccctgtctccactgacaccaattggacctccacctccagtcctaccgcatatcccctccctttctccgactcggaccgatg

SEQ ID NO: 5774 - DNA, 203 bp, Homo sapiens
  source 1..203: mol_type = other DNA
ggcgcgccagtcctcttcgtgcgtgcttacccagactcctcctgggctgccatgtacaacacccactccatgtggaattgcggttggcgcgttcaagtgaccgtcaacggctcacagttccatgccggagcccttatcctctacatggtccctgaagccaccacccatgccatccaaacggctcgggacgactcggaccgatg

SEQ ID NO: 5775 - DNA, 203 bp, Homo sapiens
  source 1..203: mol_type = other DNA
ggcgcgccagtcctcaacgctggctttgtcttcccctatgtcatcctcaatctctatgaaagcaacaccgctaccatagaggtcccctacatctcccccacccccaatacctcgagtggactccacgccccgtggacgttctacctccaggtgctctcacccctcaatcctcccccttctctccccaccgactcggaccgatg

SEQ ID NO: 5776 - DNA, 203 bp, Homo sapiens
  source 1..203: mol_type = other DNA
ggcgcgccagtcctttccttatcctgctctatctatgtcacccccgttgactcctctttccacggtctccgctacctcgccccacagcactggaagactcgcgccgtcccaggtgcgggcactttcggatctgccgtggctggccaggaactccctctctgtggagtccgtgcctactacccccccaacgactcggaccgatg

SEQ ID NO: 5777 - DNA, 203 bp, Homo sapiens
  source 1..203: mol_type = other DNA
ggcgcgccagtccttgcctacatccctgcccaggtacgcgactggcttgagttcgcccaccggcctggtctcatggccacagtgccgtggaccatggcggacgagccggccgagcgcctcggtatcttccccgtctctcccagtgctatcgctgggactggcgcccccatctcctatgttatttctctcgactcggaccgatg

SEQ ID NO: 5778 - DNA, 203 bp, Homo sapiens
  source 1..203: mol_type = other DNA
ggcgcgccagtcctcttctcccagtggcgcggtgaactcgccgcccacctcctcttcactggctccgctcagcactacggccgcctggtcgtgtgctacactcctgctgccccccaacccccctccaccatgcaggaagcgatgcgcggaacatacaccgtatgggacgtcaacgctgcctcaaccctcgactcggaccgatg

SEQ ID NO: 5779 - DNA, 203 bp, Homo sapiens
  source 1..203: mol_type = other DNA
ggcgcgccagtcctatccttcaacgtacgactgatgcaaaaccccgccctcacttcccaaaccctcaccgaagacctcgatgcaccccaagacaccgggaacattgagaacggtgcggctgacaactccccgcagccccgcaccaccttcgactacaccggaaaccccctccctccagacaccaaactcgactcggaccgatg

SEQ ID NO: 5780 - DNA, 203 bp, Homo sapiens
  source 1..203: mol_type = other DNA
ggcgcgccagtcctggacctgcgaatcacgctccgcttctccaacccaaatgacaaccctgccaccatgcttgttgccttcgctccccctggcgccaccatccccctcaaacccacgcgccaaatgctctccaacttctacatggcggaggtcccagtctccgctgccacctccaccatggtctctttcgactcggaccgatg

SEQ ID NO: 5781 - DNA, 203 bp, Homo sapiens
  source 1..203: mol_type = other DNA
ggcgcgccagtcctctccatcccctacacctcccccctctctgccatccccacctcatacttcggatgggaggactggtcaggtaccaactttggccagctctcctccgggtcatggggaaacctcatgctcatcccctctctctctgtcgactctgctatccccttcgacttccagctctcttgctgcgactcggaccgatg

SEQ ID NO: 5782 - DNA, 203 bp, Homo sapiens
  source 1..203: mol_type = other DNA
ggcgcgccagtcctccccacctacgtccactgggccatccgcaaggtggcccccgacggcagtgccaaacagatctcgctgtcccgcagcgggatccaggcactggtcgccctcgaaccccccgagggtgaaccttacctcgaaattctcccctcccattggacccttgctgaactccaacttggcaacgactcggaccgatg

SEQ ID NO: 5783 - DNA, 203 bp, Homo sapiens
  source 1..203: mol_type = other DNA
ggcgcgccagtcctcaagtgggagtacagcgccaccaacaactgtacccacttcgtcagctccatcactggcgaatccctccccaacaccggcttctccctggccctcggaatcggtgccctcaccgccatcgcagcctcggctgctgttgccgtgaaagcgctcccaggcatcaggcgacagggtctcgactcggaccgatg

SEQ ID NO: 5784 - DNA, 203 bp, Homo sapiens
  source 1..203: mol_type = other DNA
ggcgcgccagtcctcattgatcacatcactaaatccatctcccgctgccgtgaattggtctccatcgcccaggaggccaaatccggccctcactcttccttcctcaaccaagcagtcaaaaactacacccttgccatctcccaacaccgcaaatgccagacaggtcccaggcctgaacccgtggtggtcgactcggaccgatg

SEQ ID NO: 5785 - DNA, 203 bp, Homo sapiens
  source 1..203: mol_type = other DNA
ggcgcgccagtcctctacctctacggaccccccggcactggcaaatccctccttgcttcactcctcgctcaaaccctttcccagcgtcttgctgggacccccgatgacgtctactccccctcctccgcctcctgtgagtacttcgatgggtacacgggtcaaaccgtgcactttatcgatgacatcggcgactcggaccgatg

SEQ ID NO: 5786 - DNA, 203 bp, Homo sapiens
  source 1..203: mol_type = other DNA
ggcgcgccagtcctgcaggatccggaggggcgggactgggctaatttcccaaacctcgtctcctctgcccccttcattgtcccaatggcctccctcgaggagaagggcacccactacacctccaaggtcatcgtggttacctccaacttccacgagcctaacgagcgcgccgcgcgctcgatgggcgccgactcggaccgatg

SEQ ID NO: 5787 - DNA, 203 bp, Homo sapiens
  source 1..203: mol_type = other DNA
ggcgcgccagtcctggcgcaccaccgccctgtaccatgctcccttggcctctcccaagccatcgcaaacaacacccccatccaacaaatctctgaaaccttctggaagtaccgcaaacccatcttcacttgcaccactttcctcgctgtcctcggtttcctctgctctgtcatccctcttgctcgctccgactcggaccgatg

SEQ ID NO: 5788 - DNA, 203 bp, Homo sapiens
  source 1..203: mol_type = other DNA
ggcgcgccagtccttcccacctcccgccagtacaaggacatgcggcgcttcatcggcgcccatccccaccccactggactccttgtttcccaattcaaagctgcccccctctatgtccgcatctccgacaaccggatcctggaccttgacttccccggagtcgtcgtctgtaagcaggcgtacggatacgactcggaccgatg

SEQ ID NO: 5789 - DNA, 203 bp, Homo sapiens
  source 1..203: mol_type = other DNA
ggcgcgccagtcctcattgttcccactgctgaagtccggcctggcgtcaacgtcaaccggatgtcccgcttgcacccctctcccgcctacggtgccttccctgtcaagaaacaacccgctcccctcaagcgcaacgacaagcgcctgcaggagggcgtcgatcttgacacccagctcttcctcaaacacgactcggaccgatg

SEQ ID NO: 5790 - DNA, 203 bp, Homo sapiens
  source 1..203: mol_type = other DNA
ggcgcgccagtcctcgtcgaagctgctcccatccatgctatcgtcgctggccggatgctcctcggtggtctcatcgactacatgcaggggcgtcccggcgagcacggtagtgcggttggttgcaacccagacgttcactggacttccttcttttacgccttcagcgagttctctcaggtatacgatctcgactcggaccgatg

SEQ ID NO: 5791 - DNA, 203 bp, Homo sapiens
  source 1..203: mol_type = other DNA
ggcgcgccagtcctggactacaagtgttttgatgctacccttccttctgctgtcttcacccttgttgctgaccatcttacccgcatcaccggagatccccgcgtcggtcgctacatccactccatccgccattcacaccacatttatggcaaccggatgtacgacatgatcggggggaatccctccggcgactcggaccgatg

SEQ ID NO: 5792 - DNA, 203 bp, Homo sapiens
  source 1..203: mol_type = other DNA
ggcgcgccagtcctttgtgtggccacctccatcctcaacaccatcatcaacaacatctgtgtcctctctgccctcatccaacaccctgatttctctccctcccgcttccacatcctggcgtacggtgacgacgtcatctacgctacggaaccccccatccatccttccttccttcgggagttctaccacgactcggaccgatg

SEQ ID NO: 5793 - DNA, 203 bp, Homo sapiens
  source 1..203: mol_type = other DNA
ggcgcgccagtcctgaaacacacccctctggtggtcacccccgcaaacaaaggccaggatttcccacccacgtctacgatctatgaagtcaccttcctcaaacgctggttcgttccggacgatgttagacccatctacattcaccctgtgatggaccccgacacgtacgagcaatcggtaatgtggttcgactcggaccgatg

SEQ ID NO: 5794 - DNA, 203 bp, Homo sapiens
  source 1..203: mol_type = other DNA
ggcgcgccagtcctggctgcctgatagttagggaacacagtgcctcggcacgcttagttagttagaaccctttgcccactcctccatggtgatataaagaccacccacttccttcgggtgagcccctaagccatggttgtactgcactatcatcctaagacggtccttcttcggatcgcaatctcacccgactcggaccgatg

SEQ ID NO: 5795 - DNA, 203 bp, Homo sapiens
  source 1..203: mol_type = other DNA
ggcgcgccagtcctggtgatataaagaccacccacttccttcgggtgagcccctaagccatggttgtactgcactatcatcctaagacggtccttcttcggatcgcaatctcaccctggtgccgcgcttccttcgggaactgcacccgcggaccagggccgtctttgaacttttctaactgttcttaccgactcggaccgatg

SEQ ID NO: 5796 - DNA, 203 bp, Homo sapiens
  source 1..203: mol_type = other DNA
ggcgcgccagtccttctttgctgagacttgaccgccccgggtacccgtgtacgaataaacctcttgctgattgcatctgactcgtggtctcggtgttctgtgggcgcggggtctcatcgccgaggaagacctagttcaggggtctttcatttgggggctcgtccgggatcgagacccccgacccccggcgactcggaccgatg

SEQ ID NO: 5797 - DNA, 203 bp, Homo sapiens
  source 1..203: mol_type = other DNA
ggcgcgccagtcctgaccaccgacccaccatcaggaggtaagctggccggcgaccatacctgttgtccttgtataagtgtctctgtcaattgatctgattttggcggtgggatcgaaggagctgacgagctcgtacttcgcccccgcaaccctggaagacgttccacgggtgtctgatgtctggagcccgactcggaccgatg

SEQ ID NO: 5798 - DNA, 203 bp, Homo sapiens
  source 1..203: mol_type = other DNA
ggcgcgccagtcctggccaggaccccccccctgagcccaggataaccttaaaaataggggggcaaccggtgactttcctggtggacacgggagcccagcactcagtactaactcgaccagatggacctctcagtgaccgcacagccctggtgcaaggagccacgggaagcaaaaactaccggtggacccgactcggaccgatg

SEQ ID NO: 5799 - DNA, 203 bp, Homo sapiens
  source 1..203: mol_type = other DNA
ggcgcgccagtcctccagaaataggactgtcagggcagctaacctggacacgccttcctcaagggttcaagaatagccccaccctatttgatgaggccctgcactcagacctggccgatttcagggtaaggtacccggctctagtcctcctacaatatgtagatgacctcttgctggctgcggcaacccgactcggaccgatg

SEQ ID NO: 5800 - DNA, 203 bp, Homo sapiens
  source 1..203: mol_type = other DNA
ggcgcgccagtcctaggactgaatgcctggaagggactaaggcactccttgagactttgggcaataaggggtaccgagcctctgcaaagaaggcccaaatttgcctgcaagaagtcacatacctggggtactctttaaaagatggccaaaggtggcttaccaaagctcgcaaggaagccatcctatcccgactcggaccgatg

SEQ ID NO: 5801 - DNA, 203 bp, Homo sapiens
  source 1..203: mol_type = other DNA
ggcgcgccagtcctcccccttgtttacgcatggttgcagccatcgccatcctagtcaaggatgcagggaagctaaccctaggacagccgctaactatcctgacctcccacccagttgaggcacttgtccgacagcctccaaataaatggctctctaatgctagaatgactcattaccaagctatgctccgactcggaccgatg

SEQ ID NO: 5802 - DNA, 203 bp, Homo sapiens
  source 1..203: mol_type = other DNA
ggcgcgccagtcctctcgatgcagagcgagtccatttcgggccgacagtctcccttaaccctgctaccttgctccccctccccagcgggggaaaccaccacgactgtctccagattttagccgagacccatggcaccagacccgacttaactgaccagccgttgccggatgcagacctgacctggtaccgactcggaccgatg

SEQ ID NO: 5803 - DNA, 203 bp, Homo sapiens
  source 1..203: mol_type = other DNA
ggcgcgccagtcctgaagctcattatgagccaaagagaggtacctgggagtaccgaggaaaaactatcatgcctgaaaaatacgcaaaagagttgattagccatctgcataagttaacacacctcagtgctaggaaaatgaaaactttactagaaagagaagaaactgggttttacctccctaacagacgactcggaccgatg

SEQ ID NO: 5804 - DNA, 203 bp, Homo sapiens
  source 1..203: mol_type = other DNA
ggcgcgccagtcctgacttacacctccggcaagtaacagagagctgccgggcatgtgctcaaatcaacgccggaaagataaagtttggacctgatgtaagggcccgaggccgccggcccggaacacattgggaagtagacttcactgaaatcaagccaggaatgtatggatataaatacctcttggtgcgactcggaccgatg

SEQ ID NO: 5805 - DNA, 203 bp, Homo sapiens
  source 1..203: mol_type = other DNA
ggcgcgccagtcctccaatgtaaaacacggggcacgttactcctcctcaaagtatggatgtaaaactacagatagaaaaaaacagcaacaaacataccccttttacgtctgccccggacatgccccctcgctggggccaaagggaacacattgtggaggggcacaagatgggttttgtgccgcatgggcgactcggaccgatg

SEQ ID NO: 5806 - DNA, 203 bp, Homo sapiens
  source 1..203: mol_type = other DNA
ggcgcgccagtcctctgaaagcgccccaaggtctgttgcccccaccaccgtgggtcccaaacggattgggaccggagataggttaataaatttagtacaagggacatacctagccttaaatgccaccgaccccaacaaaactaaagactgttggctctgcctggtttctcgaccaccctattacgaagcgactcggaccgatg

SEQ ID NO: 5807 - DNA, 203 bp, Homo sapiens
  source 1..203: mol_type = other DNA
ggcgcgccagtcctggattgcaatcttaggtaactacagcaaccaaacaaacccccccccatcctgcctatctactccgcaacacaaactgaccatatctgaagtatcagggcaaggactgtgcatagggactgttcctaagacccaccaggctttgtgcaatgagacacaacagggacatacaggggcgactcggaccgatg

SEQ ID NO: 5808 - DNA, 203 bp, Homo sapiens
  source 1..203: mol_type = other DNA
ggcgcgccagtcctcgcactatctagccgcccccaatggcgcctattgggcctgtaacactggactcaccccatgcatttccatggcggtgctcaattggacctctgatttttgtgtcttaatcgaattatggcccagagtgacttaccatcaacccgaatatgtgtacacacattttgccaaagctgcgactcggaccgatg

SEQ ID NO: 5809 - DNA, 203 bp, Homo sapiens
  source 1..203: mol_type = other DNA
ggcgcgccagtcctttagtgccttagaaaagtccctgacctccctttctgaagtagtcttacaaaacagacggggcctagatattctattcttacaagagggagggctctgtgccgcattaaaagaagaatgttgcttctatgcggatcacaccggactcgtccgagacaatatggctaaattgagagcgactcggaccgatg

SEQ ID NO: 5810 - DNA, 203 bp, Homo sapiens
  source 1..203: mol_type = other DNA
ggcgcgccagtcctaaagactaaaacagcggcaacaactgtttgactcccaacagggatggtttgaaggatggttcaacaagtccccctggttcacaaccttaatttcctccattatgggccccttactaatcctactcctaattctcctcttcggcccatgcatccttaacagattagtacaattcgcgactcggaccgatg

SEQ ID NO: 5811 - DNA, 203 bp, Homo sapiens
  source 1..203: mol_type = other DNA
ggcgcgccagtcctgtggtgccatttcacaaggcatggaaaattactcaagtatgttcccatgagatacaaggaagttagaggctaaaacaggatatctgtggttaagcacctgggccccggcttgaggccaagaacagttaaaccccggatatagctgaaacagcagaagtttcaaggccgctaccacgactcggaccgatg

SEQ ID NO: 5812 - DNA, 203 bp, Homo sapiens
  source 1..203: mol_type = other DNA
ggcgcgccagtcctgctataaaacgagccatcagcccccaacgggcgcgcaagtctttgctgagacttgaccgccccgggtacccgtgtacgaataaacctcttgctgattgcatctgactcgtggtctcggtgttctgtgggcgcggggtctcatcgccgaggaagacctagttcaggggtctttcacgactcggaccgatg

SEQ ID NO: 5813 - DNA, 203 bp, Homo sapiens
  source 1..203: mol_type = other DNA
ggcgcgccagtccttgatgaacacgctgagtggtttgatgccggtggcttaggtccaagtacactacccactagtcatgaacggtacacacatgagaatgatgaaggccaccaggtaaagtggtcggctagggaaggtgtagaccttggcatatccgggctcacgacggtgtctgggcctgagtggaacgactcggaccgatg

SEQ ID NO: 5814 - DNA, 203 bp, Homo sapiens
  source 1..203: mol_type = other DNA
ggcgcgccagtcctgcaaaggaagctcatctcctctggccggttttaccacccgacccaagattggtcccgagacactccagaattccaacaagacagcaagttagagatggttagggatgcagtgctagccgctataaatgggttggtgtcgcggccatttaaagatcttctgggtaagctcaaacccgactcggaccgatg

SEQ ID NO: 5815 - DNA, 203 bp, Homo sapiens
  source 1..203: mol_type = other DNA
ggcgcgccagtcctcgtagtatcctctaccaatgctctcatatcccggatctcaatggctagggctgcattggccaaggctcaagctgaaatgaccagcaggatgcgtcctgtggtcattatgatgtgtgggccccctggtataggtaaaaccaaggcagcagaacatctggctaaacgcctagccaacgactcggaccgatg

SEQ ID NO: 5816 - DNA, 203 bp, Homo sapiens
  source 1..203: mol_type = other DNA
ggcgcgccagtccttgagatacggcctggtggtaaggttgggctggtcccacgggaggcagtggatcattgggatggatatcacggagaggaagtgatgctgtgggacgactatggaatgacaaagatacaggaagactgtaataaactgcaagccatagccgactcagcccccctaacactcaattgcgactcggaccgatg

SEQ ID NO: 5817 - DNA, 203 bp, Homo sapiens
  source 1..203: mol_type = other DNA
ggcgcgccagtccttgaccgaatagaaaacaagggaatgcaatttgtgtctgatgctatagtcatcaccaccaatgctcctggcccagccccagtggactttgtcaacctcgggcctgtttgccgaagggtggacttccttgtgtattgcacggcacctgaagttgaacacacgaggaaagtcagtcccgactcggaccgatg

SEQ ID NO: 5818 - DNA, 203 bp, Homo sapiens
  source 1..203: mol_type = other DNA
ggcgcgccagtccttggggacacaactgcactgaaagactgcttcaagcccgatttctcacatctaaaaatggagttggctccccaagggggctttgataaccaagggaataccccgtttggtaagggtgtgatgaagcccaccaccataaacaggctgttaatccaggctgtagccttgacgatggacgactcggaccgatg

SEQ ID NO: 5819 - DNA, 203 bp, Homo sapiens
  source 1..203: mol_type = other DNA
ggcgcgccagtcctcgcttcatgtttccagtccgccataactaccatactacaaatggcgggatctgcgctcgttattaatcgagcggtcaagcgtatgtttggtacccgtacagcagccatggcattagaaggacctgggaaagaacataattgcagggtccataaggctaaggaagctggaaagggcgactcggaccgatg

SEQ ID NO: 5820 - DNA, 203 bp, Homo sapiens
  source 1..203: mol_type = other DNA
ggcgcgccagtcctggtcttctataaatccaagagtaagaaacaccaacaagagcaacggcgacaacttggtctagtgactggatcagacatcagaaaacgtaagcccattgactggaccccgccaaagaatgaatgggcagatgatgacagagaggtggattataatgaaaagatcaattttgaagccgactcggaccgatg

SEQ ID NO: 5821 - DNA, 203 bp, Homo sapiens
  source 1..203: mol_type = other DNA
ggcgcgccagtccttcccccgacactatggagccgagtcacaaagtttggatcaggatggggcttttgggtcagcccgacagtgttcatcacaaccacacatgtagtgccaactggtgtgaaagaattctttggtgagcccctatctagtatagcaatccaccaagcaggtgagttcacacaattcagcgactcggaccgatg

SEQ ID NO: 5822 - DNA, 203 bp, Homo sapiens
  source 1..203: mol_type = other DNA
ggcgcgccagtcctgttctcaaagaaaatgcgccctgacttgacaggtatggtccttgaagaaggttgccctgaagggacagtctgctcagtcctaattaaacgggattcgggtgaactacttccgctagccgtccgtatgggggctattgcctccatgaggatacagggtcggcttgtccatggccacgactcggaccgatg

SEQ ID NO: 5823 - DNA, 203 bp, Homo sapiens
  source 1..203: mol_type = other DNA
ggcgcgccagtcctgggcgaaaccgcactagaaggtggagacaaggggcattatgccggccacgagattgtgaggtatggaagtggcccagcactgtcaactaaaacaaaattctggaggtcctccccagaaccactgccccccggagtatatgagccagcatacctggggggcaaggacccccgtgtcgactcggaccgatg

SEQ ID NO: 5824 - DNA, 203 bp, Homo sapiens
  source 1..203: mol_type = other DNA
ggcgcgccagtcctatctcttgacaaaactactagttcggggtaccctcaccataaaaggaagaatgatgattggaatggcaccaccttcgttggagagctcggtgagcaagctgcacacgccaacaatatgtatgagaatgctaaacatatgaaacccatttacactgcagccttaaaagatgaactcgactcggaccgatg

SEQ ID NO: 5825 - DNA, 203 bp, Homo sapiens
  source 1..203: mol_type = other DNA
ggcgcgccagtcctagtcaagccagaaaagatttatcaaaaagtcaagaagcgtctactatggggcgccgatctcggaacagtggtcagggccgcccgggcttttggcccattttgtgacgctataaaatcacatgtcatcaaattgccaataaaagttggcatgaacacaatagaagatggccccctcgactcggaccgatg

SEQ ID NO: 5826 - DNA, 203 bp, Homo sapiens
  source 1..203: mol_type = other DNA
ggcgcgccagtcctcatctatgctgagcatgctaaatataagaatcattttgatgcagattatacagcatgggactcaacacaaaatagacaaattatgacagaatccttctccattatgtcgcgccttacggcctcaccagaattggccgaggttgtggcccaagatttgctagcaccatctgagatcgactcggaccgatg

SEQ ID NO: 5827 - DNA, 203 bp, Homo sapiens
  source 1..203: mol_type = other DNA
ggcgcgccagtcctggatgtaggtgattatgtcatcagggtcaaagaggggctgccatctggattcccatgtacttcccaggtgaacagcataaatcactggataattactctctgtgcactgtctgaggccactggtttatcacctgatgtggtgcaatccatgtcatatttctcattttatggtgacgactcggaccgatg

SEQ ID NO: 5828 - DNA, 203 bp, Homo sapiens
  source 1..203: mol_type = other DNA
ggcgcgccagtcctgttccaaggcaggttagatagggcttcgattgaacgccaaatcttctggacccgcgggcccaatcattcagatccatcagagactctagtgccacacactcaaagaaaaatacagttgatttcacttctaggggaagcttcactccatggtgagaaattttacagaaagatttccgactcggaccgatg

SEQ ID NO: 5829 - DNA, 203 bp, Homo sapiens
  source 1..203: mol_type = other DNA
ggcgcgccagtcctgtgcccctctcccaatcagtagtatgggcatttccccagacaatgtccagagtgtgcagttccaaaatggtcggtgtactctggatggccgcctggttggcaccaccccagtttcattgtcacatgttgccaagataagagggacctccaatggcactgtaatcaaccttactgcgactcggaccgatg

SEQ ID NO: 5830 - DNA, 203 bp, Homo sapiens
  source 1..203: mol_type = other DNA
ggcgcgccagtcctaattggatggcacaccctttcacccttttgagggccctgcccccattgggtttccagacctcggtggttgtgattggcatatcaatatgacacagtttggccattctagccagacccagtatgatgtagacaccacccctgacacttttgtcccccatcttggttcaattcaggcgactcggaccgatg

SEQ ID NO: 5831 - DNA, 203 bp, Homo sapiens
  source 1..203: mol_type = other DNA
ggcgcgccagtcctcaaatggcattggcagtggtaattatgttggtgttcttagctggatttcccccccatcacacccgtctggctcccaagttgacctttggaagatccccaattatgggtcaagtattacggaggcaacacatctagccccttctgtatacccccctggtttcggagaggtattggcgactcggaccgatg

SEQ ID NO: 5832 - DNA, 203 bp, Homo sapiens
  source 1..203: mol_type = other DNA
ggcgcgccagtcctcataattggtgcaattgctgcttccacagcaggtagtgctctgggagcgggcatacaggttggtggcgaagcggccctccaaagccaaaggtatcaacaaaatttgcaactgcaagaaaattcttttaaacatgacagggaaatgattgggtatcaggttgaagcttcaaatcacgactcggaccgatg

SEQ ID NO: 5833 - DNA, 203 bp, Homo sapiens
  source 1..203: mol_type = other DNA
ggcgcgccagtcctattattggctaaaaatttggcaactagatattcactcctccgtgctgggggtttgaccagtgctgatgcagcaagatctgtggcaggagctccagtcacccgcattgtagattggaatggcgtgagagtgtctgctcccgagtcctctgctaccacattgagatccggtggcttcgactcggaccgatg

SEQ ID NO: 5834 - DNA, 203 bp, Homo sapiens
  source 1..203: mol_type = other DNA
ggcgcgccagtcctgacaacaaccaacccactaatcagacatgagaacagaatggttttagccagcactacagctaaggctatggagcaaatggctggatcgagtgagcaagcagcagaggccatggaggttgctagtcaggctaggcaaatggtgcaagcgatgagaaccattgggactcatcctagcgactcggaccgatg

SEQ ID NO: 5835 - DNA, 203 bp, Homo sapiens
  source 1..203: mol_type = other DNA
ggcgcgccagtcctctccagtgctggtctgaaaaatgatcttcttgaaaatttgcaggcctatcagaaacgaatgggggtgcagatgcaacggttcaagtgatcctctcgctattgccgcaaatatcattgggatcttgcacttgatattgtggattcttgatcgtctttttttcaaatgcatttacccgactcggaccgatg

SEQ ID NO: 5836 - DNA, 203 bp, Homo sapiens
  source 1..203: mol_type = other DNA
ggcgcgccagtccttatgttatccaggagatttcatcgactatgaggagctgagggagcaattgagctcagtgtcatcattcgaaagattcgaaatatttcccaaagaaagctcatggcccaaccacaacacaaccaaaggagtaacggcagcatgctcccatgcggggaaaagcagtttttacagaacgactcggaccgatg

SEQ ID NO: 5837 - DNA, 203 bp, Homo sapiens
  source 1..203: mol_type = other DNA
ggcgcgccagtcctattataacaggagatttaccccggaaatagcagaaagacccaaagtaagagatcaagctgggaggatgaactattactggaccttgctaaaacccggagacacaataatatttgaggcaaatggaaatctaatagcaccaaggtatgctttcgcactgagtagaggctttgggtcgactcggaccgatg

SEQ ID NO: 5838 - DNA, 203 bp, Homo sapiens
  source 1..203: mol_type = other DNA
ggcgcgccagtcctatggggatctatcagattctggcgatctactcaactgtcgccagttcactggtgcttttggtctccctgggggcaatcagtttctggatgtgttctaatggatctttgcagtgcagaatatgcatctgagattagaatttcagaaatatgaggaaaaacacccttgtttctactcgactcggaccgatg

SEQ ID NO: 5839 - DNA, 203 bp, Homo sapiens
  source 1..203: mol_type = other DNA
ggcgcgccagtcctctcacttggaatgcaggaccttttttctgacccaaggtgccttactgaatgacaggcattcaaatgggactgttaaggacagaagcccttatagggccttaatgagctgccctgtcggtgaagctccgtccccgtacaattcaagatttgaatcggttgcttggtcagcaagtgcgactcggaccgatg

SEQ ID NO: 5840 - DNA, 203 bp, Homo sapiens
  source 1..203: mol_type = other DNA
ggcgcgccagtcctcatgtcatgatggcatgggctggctaacaatcggaatttcaggtccagataatggagcagtggctgtattaaaatacaacggcataataactgaaaccataaaaagttggaggaagaaaatattgaggacacaagagtctgaatgtgcctgtgtaaatggttcatgttttactacgactcggaccgatg

SEQ ID NO: 5841 - DNA, 203 bp, Homo sapiens
  source 1..203: mol_type = other DNA
ggcgcgccagtccttagactgtataaggccgtgcttctgggttgaattaatcaggggacgacctaaagaaaaaacaatctggactagtgcgagcagcatttctttttgtggcgtgaatagtgatactgtagattggtcttggccagacggtgctgagttgccattcaccattgacaagtagtctgttccgactcggaccgatg

SEQ ID NO: 5842 - DNA, 203 bp, Homo sapiens
  source 1..203: mol_type = other DNA
ggcgcgccagtcctgatcccaggatgtgctctctgatgcaaggttcaactctccctaggaggtctggagccgcaggtgctgcagtcaaaggagttggaacaatggtgatggaattggtcaggatgatcaaacgtgggatcaatgatcggaacttctggaggggtgagaatggacgaaaaacaagaattcgactcggaccgatg

SEQ ID NO: 5843 - DNA, 203 bp, Homo sapiens
  source 1..203: mol_type = other DNA
ggcgcgccagtcctcattctgccgcatttgaagatctaagagtattgagcttcatcaaagggacgaaggtggtcccaagagggaagctttccactagaggagttcaaattgcttccaatgaaaatatggagactatggaatcaagtacacttgaactgagaagcaggtactgggccataaggaccagacgactcggaccgatg

SEQ ID NO: 5844 - DNA, 203 bp, Homo sapiens
  source 1..203: mol_type = other DNA
ggcgcgccagtcctgcaaatgttgtaaggaagatgatgaccaattctcaggacaccgaactttctttgaccatcactggagataacaccaaatggaacgaaaatcagaatcctcggatgtttttggccatgatcacatatatgaccagaaatcagcccgaatggttcagaaatgttctaagtattgctcgactcggaccgatg

SEQ ID NO: 5845 - DNA, 203 bp, Homo sapiens
  source 1..203: mol_type = other DNA
ggcgcgccagtccttcatttgaaataaagaaactgtgggagcaaacccgttccaaagctggactgctggtctccgacggaggcccaaatttatacaacattagaaatctccacattcctgaagtctgcctaaaatgggaattgatggatgaggattaccaggggcgtttatgcaacccactgaacccacgactcggaccgatg

SEQ ID NO: 5846 - DNA, 203 bp, Homo sapiens
  source 1..203: mol_type = other DNA
ggcgcgccagtcctctgctgatggatgccttaaaattaagcattgaggacccaagtcatgaaggagagggaataccgctatatgatgcaatcaaatgcatgagaacattctttggatggaaggaacccaatgttgttaaaccacacgaaaagggaataaatccaaattatcttctgtcatggaagcaacgactcggaccgatg

SEQ ID NO: 5847 - DNA, 203 bp, Homo sapiens
  source 1..203: mol_type = other DNA
ggcgcgccagtcctattaaaatgaaatggggaatggagatgaggcgttgtctcctccagtcacttcaacaaattgagagtatgattgaagctgagtcctctgtcaaagagaaagacatgaccaaagagttctttgagaacaaatcagaaacatggcccattggagagtctcccaaaggagtggaggaacgactcggaccgatg

SEQ ID NO: 5848 - DNA, 203 bp, Homo sapiens
  source 1..203: mol_type = other DNA
ggcgcgccagtcctagttccattgggaaggtctgcaggactttattagcaaagtcggtatttaacagcttgtatgcatctccacaactagaaggattttcagctgaatcaagaaaactgcttcttatcgttcaggctcttagggacaatctggaacctgggacctttgatcttggggggctatatgaacgactcggaccgatg

SEQ ID NO: 5849 - DNA, 203 bp, Homo sapiens
  source 1..203: mol_type = other DNA
ggcgcgccagtcctacaagcagtgtgtacattgaagtgttgcatttgactcaaggaacatgctgggaacagatgtatactccaggaggggaagtgaagaatgatgatgttgatcaaagcttgattattgctgctaggaacatagtgagaagagctgcagtatcagcagacccactagcatctttattgcgactcggaccgatg

SEQ ID NO: 5850 - DNA, 203 bp, Homo sapiens
  source 1..203: mol_type = other DNA
ggcgcgccagtcctgagatgtgccacagcacacagattggtggaattaggatggtagacatccttaagcagaacccaacagaagagcaagccgtgggtatatgcaaggctgcaatgggactgagaattagctcatccttcagttttggtggattcacatttaagagaacaagcggatcatcagtcaagcgactcggaccgatg

SEQ ID NO: 5851 - DNA, 203 bp, Homo sapiens
  source 1..203: mol_type = other DNA
ggcgcgccagtcctagagaggaagaggtgcttacgggcaatcttcaaacattgaagataagagtgcatgagggatatgaagagttcacaatggttgggagaagagcaacagccatactcagaaaagcaaccaggagattgattcagctgatagtgagtgggagagacgaacagtcgattgccgaagcacgactcggaccgatg

SEQ ID NO: 5852 - DNA, 203 bp, Homo sapiens
  source 1..203: mol_type = other DNA
ggcgcgccagtccttctcccgaggaggtcagtgaaacacagggaacagagaaactgacaataacttactcatcgtcaatgatgtgggagattaatggtcctgaatcagtgttggtcaatacctatcaatggatcatcagaaactgggaaactgttaaaattcagtggtcccagaaccctacaatgctacgactcggaccgatg

SEQ ID NO: 5853 - DNA, 203 bp, Homo sapiens
  source 1..203: mol_type = other DNA
ggcgcgccagtccttccgctgttctgaggggattcctcattctgggcaaagaagacaggagatatgggccagcattaagcatcaatgaactgagcaaccttgcgaaaggagagaaggctaatgtgctaattgggcaaggagacgtggtgttggtaatgaaacgaaaacgggactctagcatacttactcgactcggaccgatg

SEQ ID NO: 5854 - DNA, 203 bp, Homo sapiens
  source 1..203: mol_type = other DNA
ggcgcgccagtcctcttggctgttctaaggaaagtcaagagagtggtggccagtttgatgagaggattgtcctcaaggaaacgccgttcccatgatgttctgactgtgcaattcctaattttgggaatgctgttgatgacgggtggagtgaccttggtgcggaaaaacagatggttgctcctaaatgtcgactcggaccgatg

SEQ ID NO: 5855 - DNA, 203 bp, Homo sapiens
  source 1..203: mol_type = other DNA
ggcgcgccagtcctttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccgactcggaccgatg

SEQ ID NO: 5856 - DNA, 203 bp, Homo sapiens
  source 1..203: mol_type = other DNA
ggcgcgccagtcctcctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctcgactcggaccgatg

SEQ ID NO: 5857 - DNA, 203 bp, Homo sapiens
  source 1..203: mol_type = other DNA
ggcgcgccagtcctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagcgactcggaccgatg

SEQ ID NO: 5858 - DNA, 203 bp, Homo sapiens
  source 1..203: mol_type = other DNA
ggcgcgccagtcctccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggcgactcggaccgatg

SEQ ID NO: 5859 - DNA, 203 bp, Homo sapiens
  source 1..203: mol_type = other DNA
ggcgcgccagtccttctaggagttggggcggatcaaggatgcgccatcaactttggcaagagagagctcaagtgcggagatggtatcttcatatttagagactctgatgactggctgaacaagtactcatactatccagaagatcctgtgaagcttgcatcaatagtgaaagcctcttttgaagaaggcgactcggaccgatg

SEQ ID NO: 5860 - DNA, 203 bp, Homo sapiens
  source 1..203: mol_type = other DNA
ggcgcgccagtcctgcagtatggttggaagacttggggtaagaaccttgtgttctccccagggaggaagaatggaagcttcatcatagatggaaagtccaggaaagaatgcccgttttcaaaccgggtctggaattctttccagatagaggagtttgggacgggagtgttcaccacacgcgtgtacatcgactcggaccgatg

SEQ ID NO: 5861 - DNA, 203 bp, Homo sapiens
  source 1..203: mol_type = other DNA
ggcgcgccagtcctgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagcgactcggaccgatg

SEQ ID NO: 5862 - DNA, 203 bp, Homo sapiens
  source 1..203: mol_type = other DNA
ggcgcgccagtccttgatttgctgaaactcacagtggctgtgggattgcatttccatgagatgaacaatggaggagacgccatgtatatggcgttgattgctgccttttcaatcagaccagggctgctcatcggctttgggctcaggaccctatggagccctcgggaacgccttgtgctgaccctaggcgactcggaccgatg

SEQ ID NO: 5863 - DNA, 203 bp, Homo sapiens
  source 1..203: mol_type = other DNA
ggcgcgccagtcctggaaccaactagggttgttaactgggaagtgatcattatggatgaagcccattttttggatccagctagcatagccgctagaggttgggcagcgcacagagctagggcaaatgaaagtgcaacaatcttgatgacagccacaccgcctgggactagtgatgaatttccacattccgactcggaccgatg

SEQ ID NO: 5864 - DNA, 203 bp, Homo sapiens
  source 1..203: mol_type = other DNA
ggcgcgccagtcctgccacttcgtatctccgcatcctctgctgctcaaaggagggggcgcattgggagaaatcccaacagagatggagactcatactactattctgagcctacaagtgaaaataatgcccaccacgtctgctggttggaggcctcaatgctcttggacaacatggaggtgaggggtggcgactcggaccgatg

SEQ ID NO: 5865 - DNA, 203 bp, Homo sapiens
  source 1..203: mol_type = other DNA
ggcgcgccagtcctaatggtcgccccactctatggcgttgaaggaactaaaacaccagtttcccctggtgaaatgagactgagggatgaccagaggaaagtcttcagagaactagtgaggaattgtgacctgcccgtttggctttcgtggcaagtggccaaggctggtttgaagacgaatgatcgtaacgactcggaccgatg

SEQ ID NO: 5866 - DNA, 203 bp, Homo sapiens
  source 1..203: mol_type = other DNA
ggcgcgccagtcctgtggtgttttgaaggccctgaggaacatgagatcttgaatgacagcggtgaaacagtgaagtgcagggctcctggaggagcaaagaagcctctgcgcccaaggtggtgtgatgaaagggtgtcatctgaccagagtgcgctgtctgaatttattaagtttgctgaaggtaggagcgactcggaccgatg

SEQ ID NO: 5867 - DNA, 203 bp, Homo sapiens
  source 1..203: mol_type = other DNA
ggcgcgccagtcctgggagctgctgaagtgctagttgtgctgagtgaactccctgatttcctggctaaaaaaggtggagaggcaatggataccatcagtgtgttcctccactctgaggaaggctctagggcttaccgcaatgcactatcaatgatgcctgaggcaatgacaatagtcatgctgtttatcgactcggaccgatg

SEQ ID NO: 5868 - DNA, 203 bp, Homo sapiens
  source 1..203: mol_type = other DNA
ggcgcgccagtcctggttgtgatccccgagccagggcaacaaaggtccatccaagacaaccaagtggcatacctcattattggcatcctgacgctggtttcagcggtggcagccaacgagctaggcatgctggagaaaaccaaagaggacctctttgggaagaagaacttaattccatctagtgcttccgactcggaccgatg

SEQ ID NO: 5869 - DNA, 203 bp, Homo sapiens
  source 1..203: mol_type = other DNA
ggcgcgccagtcctaccctggagttggccggatcttgacctgaagccaggagctgcctggacagtgtacgttggcattgttacaatgctctctccaatgttgcaccactggatcaaagtcgaatatggcaacctgtctctgtctggaatagcccagtcagcctcagtcctttctttcatggacaagggcgactcggaccgatg

SEQ ID NO: 5870 - DNA, 203 bp, Homo sapiens
  source 1..203: mol_type = other DNA
ggcgcgccagtcctgataccattcatgaagatgaatatctcggtcataatgctgctggtcagtggctggaattcaataacagtgatgcctctgctctgtggcatagggtgcgccatgctccactggtctctcattttacctggaatcaaagcgcagcagtcaaagcttgcacagagaagggtgttccacgactcggaccgatg

SEQ ID NO: 5871 - DNA, 203 bp, Homo sapiens
  source 1..203: mol_type = other DNA
ggcgcgccagtccttggcgttgccgagaaccctgtggttgatgggaatccaacagttgacattgaggaagctcctgaaatgcctgccctttatgagaagaaactggctctatatctccttcttgctctcagcctagcttctgttgccatgtgcagaacgcccttttcattggctgaaggcattgtcctcgactcggaccgatg

SEQ ID NO: 5872 - DNA, 203 bp, Homo sapiens
  source 1..203: mol_type = other DNA
ggcgcgccagtccttttgggtgaagtctggaagagggaactgaatctgttggacaagcgacagtttgagttgtataaaaggaccgacattgtggaggtggatcgtgatacggcacgcaggcatttggccgaagggaaggtggacaccggggtggcggtctccagggggaccgcaaagttaaggtggttcgactcggaccgatg

SEQ ID NO: 5873 - DNA, 203 bp, Homo sapiens
  source 1..203: mol_type = other DNA
ggcgcgccagtcctcatcaccttcaaggacaaaactgatatccaccgcctagaaccagtgaaatgtgacacccttttgtgtgacattggagagtcatcatcgtcatcggtcacagagggggaaaggaccgtgagagttcttgatactgtagaaaaatggctggcttgtggggttgacaacttctgtgtcgactcggaccgatg

SEQ ID NO: 5874 - DNA, 203 bp, Homo sapiens
  source 1..203: mol_type = other DNA
ggcgcgccagtcctaagccgtgccatatggtatatgtggctgggagcgcggtatcttgagtttgaggccctgggattcctgaatgaggaccattgggcttccagggaaaactcaggaggaggagtggaaggcattggcttacaatacctaggatatgtgatcagagacctggctgcaatggatggtggcgactcggaccgatg

SEQ ID NO: 5875 - DNA, 203 bp, Homo sapiens
  source 1..203: mol_type = other DNA
ggcgcgccagtccttggattctacgcggatgacaccgctggatgggacacgcgcatcacagaggcagaccttgatgatgaacaggagatcttgaactacatgagcccacatcacaaaaaactggcacaagcagtgatggaaatgacatacaagaacaaagtggtgaaagtgttgagaccagccccaggcgactcggaccgatg

SEQ ID NO: 5876 - DNA, 203 bp, Homo sapiens
  source 1..203: mol_type = other DNA
ggcgcgccagtcctcaggctggaggcatggctcactgagcacggatgtgacagactgaagaggatggcggtgagtggagacgactgtgtggtccggcccatcgatgacaggttcggcctggccctgtcccatctcaacgccatgtccaaggttagaaaggacatatctgaatggcagccatcaaaaggcgactcggaccgatg

SEQ ID NO: 5877 - DNA, 203 bp, Homo sapiens
  source 1..203: mol_type = other DNA
ggcgcgccagtcctgtggaatgattgggagaatgtgcccttctgttcccaccacttccatgaactacagctgaaggatggcaggaggattgtggtgccttgccgagaacaggacgagctcattgggagaggaagggtgtctccaggaaacggctggatgatcaaggaaacagcttgcctcagcaaagccgactcggaccgatg

SEQ ID NO: 5878 - DNA, 203 bp, Homo sapiens
  source 1..203: mol_type = other DNA
ggcgcgccagtcctagtatggataaccaacaacccacacatgcaggacaagacaatggtgaaaaaatggagagatgtcccttatctaaccaagagacaagacaagctgtgcggatcactgattggaatgaccaatagggccacctgggcctcccacatccatttagtcatccatcgtatccgaacgctcgactcggaccgatg

SEQ ID NO: 5879 - DNA, 203 bp, Homo sapiens
  source 1..203: mol_type = other DNA
ggcgcgccagtcctgattggacaggagaaatacactgactacctaacagtcatggacaggtattctgtggatgctgacctgcaactgggtgagcttatctgaaacaccatctaacaggaataaccgggatacaaaccacgggtggagaaccggactccccacaacctgaaaccgggatataaaccacgcgactcggaccgatg

SEQ ID NO: 5880 - DNA, 203 bp, Homo sapiens
  source 1..203: mol_type = other DNA
ggcgcgccagtcctgctggagaaccgggctccgcacttaaaatgaaacagaaaccgggataaaaactacggatggagaaccggactccacacattgagacagaagaagttgtcagcccagaaccccacacgagttttgccactgctaagctgtgaggcagtgcaggctgggacagccgacctccaggtcgactcggaccgatg

SEQ ID NO: 5881 - DNA, 203 bp, Homo sapiens
  source 1..203: mol_type = other DNA
ggcgcgccagtcctatggcacatggagttgttttcaaatgaacttttatacaaaacatataaacaaaaaccagcaggcgtcgtggaacctgtttacgacgtcaacgggcgtccactgtttggagagagcagtgacttgcacccgcagtccacactaaaactaccacaccaacgaggcagcgccaacatcgactcggaccgatg

SEQ ID NO: 5882 - DNA, 203 bp, Homo sapiens
  source 1..203: mol_type = other DNA
ggcgcgccagtcctcctgaccaatgctaggtccctaccgcggaaaggtgactgccggagaggtaatgtgaatggagcggtgagtggcatctatatcaaaccaggaccgatctactaccaggactatgtggggcccgtctatcatagagccccactggaactatgtagggaggcaagtatgtgtgaaaccgactcggaccgatg

SEQ ID NO: 5883 - DNA, 203 bp, Homo sapiens
  source 1..203: mol_type = other DNA
ggcgcgccagtcctgaacaaacatggttggtgtaactggtttcatatagaaccgtggatatggctgatgaacaaaacccaaaacaacctgacagaagggcagccgcttagggagtgtgctgtgacttgtaggtatgacaaggaagcagaattgaacattgtgacacaggctagggacaggcctacaaccgactcggaccgatg

SEQ ID NO: 5884 - DNA, 203 bp, Homo sapiens
  source 1..203: mol_type = other DNA
ggcgcgccagtccttctgacaggctgcaacaaaggcaagaatttctccttcgcaggtgttgtactggacaggccctgtaactttaaagtatcggttgaagatgtgctgttcaaggagcacgattgcggcaacatgctgcaagagaccgcgatacagatactcgatggggcaaccaacaccattgagggcgactcggaccgatg

SEQ ID NO: 5885 - DNA, 203 bp, Homo sapiens
  source 1..203: mol_type = other DNA
ggcgcgccagtcctagcaagggtagggacggccaagttgacaacctggttagggaagcaattagggatccttggtaagaagttggagaataaaagcaaagcatggtttggtgcacatgcagcaagtccatactgcggagtggagaagaagatcggttacgtctggtatacaaaaaactgcactccagccgactcggaccgatg

SEQ ID NO: 5886 - DNA, 203 bp, Homo sapiens
  source 1..203: mol_type = other DNA
ggcgcgccagtcctgaagaggtacctagtggctgtgcacgagagagccctatcaaccagtgctgagtttatgcagatcagtgatgggacaatagccccagatgtgatagatatgactgatgactttgagtttggactctgcccttgtgactcaaaaccagtgataaagggcaaatttaatgccagcttcgactcggaccgatg

SEQ ID NO: 5887 - DNA, 203 bp, Homo sapiens
  source 1..203: mol_type = other DNA
ggcgcgccagtcctagtttatgacatctgtgacaatgaagaagcagtgtacctgtttccatcaaggcataagagtggaagcagaccggatttcatattaccttttttgaaagccgtgttaataagctgcatcagtagccaatggcaattggtttacattacttacctaatactggaaattacatactacgactcggaccgatg

SEQ ID NO: 5888 - DNA, 203 bp, Homo sapiens
  source 1..203: mol_type = other DNA
ggcgcgccagtccttgtaaaaaaattgactagtatgaacagaggagagttcaaacagataacattggccactggggcaggaaaaactacggaactgccaagatccgtcatagaggagatagggaggcacaaaagggtcttagtcctgataccattgagagctgcagcagagtcagtgtatcagtatatcgactcggaccgatg

SEQ ID NO: 5889 - DNA, 203 bp, Homo sapiens
  source 1..203: mol_type = other DNA
ggcgcgccagtcctgagagtgaagtacccaagtatatctttcaatttgagaataggagatatgaaggaaggtgacatggctactggtatcacttactcctcatatcggtactttttccagcttccccagcccaaactgaaaactgccatggtagagtattcatatatattcttagatgagtaccactgcgactcggaccgatg

SEQ ID NO: 5890 - DNA, 203 bp, Homo sapiens
  source 1..203: mol_type = other DNA
ggcgcgccagtccttgctacacccgagcaattagcaataattggaaagatacacaggtttgctgaaaatcttagagtggtagcaatgacagcaaccccagctggaacggtcacaacgactggtcagaaacaccctatagaggagttcatagccccagaggtgatgaagggtgaagatctaggtagtgacgactcggaccgatg

SEQ ID NO: 5891 - DNA, 203 bp, Homo sapiens
  source 1..203: mol_type = other DNA
ggcgcgccagtcctctcgcaatccccgtatgtggtagtaagcaccaatgccatagagtcaggtgtgacattgccagacttagacacagttgtagacactggactaaggtgtgaaaagagggtgaggatatcttcaaaaatgcccttcattgtaacaggacttaagagaatggcagtcacaataggagacgactcggaccgatg

SEQ ID NO: 5892 - DNA, 203 bp, Homo sapiens
  source 1..203: mol_type = other DNA
ggcgcgccagtcctgagcctttatgaagaggacagcctgatgataactcaactcgaggtcctcaacaacctccttatatcagaagacctgcctgccgcagtgaagaacatcatggccgggaccgatcacccagaacccatacaactggcctataacagttatgaaaaccaaattccagtgctgttccccgactcggaccgatg

SEQ ID NO: 5893 - DNA, 203 bp, Homo sapiens
  source 1..203: mol_type = other DNA
ggcgcgccagtcctaaagatcaaaaatggtgaggtgacagacagttacgagaattacacatacctcaatgcaagaaaactaggagaggacgtgccggcatatgtgtacgccacagaggatgaggatctagcagtggatcttctgggtatggattggccggacccaggcagccaacaggtggtggagaccgactcggaccgatg

SEQ ID NO: 5894 - DNA, 203 bp, Homo sapiens
  source 1..203: mol_type = other DNA
ggcgcgccagtcctcccaaacgccataaggactgacggcaaggacacagagttgaaggaattagctgtgggagaccttgataaatatgtggatgcactggtagactactccaaacaagggatgaaatttatcaaagtccaagctgaaaaggtcaaagactcccagtctacaaaggaaggcttgcaaaccgactcggaccgatg

SEQ ID NO: 5895 - DNA, 203 bp, Homo sapiens
  source 1..203: mol_type = other DNA
ggcgcgccagtccttctgcaacgcgtcgtcgaacctgccttagcatacctcccatatgctacaagttccttgaagtcgttcgcacccacaagattagagagtgtggtcatactcagttctacaatttacaagacatacctatccataaggaagggtaagagtgacggcttgctaggtacaggcataagcgactcggaccgatg

SEQ ID NO: 5896 - DNA, 203 bp, Homo sapiens
  source 1..203: mol_type = other DNA
ggcgcgccagtcctgataggttttaaaggtgcatatttgggtgaccgaccagactatcaagatcttgtcgatagagattgtgcaactataacgaagaactcagtacagttcctaaaaatgaagaagggttgcgctttcacatatgacctaacaatctctaaccttgtcaggcttattgaactagtccacgactcggaccgatg

SEQ ID NO: 5897 - DNA, 203 bp, Homo sapiens
  source 1..203: mol_type = other DNA
ggcgcgccagtcctagatgagaaagtagacaggccttttgttctaattattggaaacaaaggttctacctcaaatagagcaagaacggccaagaatatacggctttataaaggaaataacccaagagagatcagggatctgatgagccaaggaagaatattgacggttgctctaaaagagttggaccccgactcggaccgatg

SEQ ID NO: 5898 - DNA, 203 bp, Homo sapiens
  source 1..203: mol_type = other DNA
ggcgcgccagtcctacagatgagtctagcccccctctttgaagagctgttattaaagtgccctccatgtagtaaaatttcaaagggacatatggtgtcagactaccaactggctcaaggaaactgggaacccttcgggtgtggggtctatatgggaaccataccagctaggcgtctcaagatccaccccgactcggaccgatg

SEQ ID NO: 5899 - DNA, 203 bp, Homo sapiens
  source 1..203: mol_type = other DNA
ggcgcgccagtcctcagagatggacacaaaagaaacatatataataagatcataggctcaacaatggcctctgctggtattaggctggagaaactgccagtagtccgagcccaaaccgacacaaccagtttccaccaggctataagagaaaaaattgataaaccagaaaacaagcagacccctggattcgactcggaccgatg

SEQ ID NO: 5900 - DNA, 203 bp, Homo sapiens
  source 1..203: mol_type = other DNA
ggcgcgccagtcctagtgatgtacaagtgggtaaagcaaaaaccagtggtgatacccggctatgaaggtaaaacaccgcattttgacatattcaacaaagtgaagaaggaatgggattcattccaggaccccgtggcagtgagctttgacaccaaagcatgggatacacaagtcaccagtagagacctcgactcggaccgatg

SEQ ID NO: 5901 - DNA, 203 bp, Homo sapiens
  source 1..203: mol_type = other DNA
ggcgcgccagtcctgaagccccagaaaataactgaaggggacaaaatgaaagtggcatatagatttgaggacatcgagttttgttcccatactcccgtgccagtaagatgggcagataacaccagtagttacatggcagggaggagcacagccactatactagctaagatggcaaccaggttggattccgactcggaccgatg

SEQ ID NO: 5902 - DNA, 203 bp, Homo sapiens
  source 1..203: mol_type = other DNA
ggcgcgccagtcctttccccggtgatgtcgtatagactgcttgcgtggttgaaagcgacggatccgttatccgcttatgtacttcgagaagcccagtaccacctcggaatcttcgatgcgttgcgctcagcactcaaccccagagtgtagcttaggctgatgagtctggacatccctcaccggtgacgcgactcggaccgatg

SEQ ID NO: 5903 - DNA, 203 bp, Homo sapiens
  source 1..203: mol_type = other DNA
ggcgcgccagtcctgtggtccaggctgcgttggcggcctacctatggctaacgccatgggacgctagttgtgaacaaggtgtgaagagcctattgagctacataagaatcctccggcccctgaatgcggctaatcccaacctcggagcaggtggtcacaaaccagtgattggcctgtcgtaacgcgcacgactcggaccgatg

SEQ ID NO: 5904 - DNA, 203 bp, Homo sapiens
  source 1..203: mol_type = other DNA
ggcgcgccagtcctactctttgggcaaaatatgtactaccactacctaggtaggtccgggtacaccgtgcatgtacagtgtaacgcctccaaattccaccagggggcactaggggtattcgccgtaccagagatgtgtctggccggggatagcaacaccactaccatgcacaccagctatcaaaatgccgactcggaccgatg

SEQ ID NO: 5905 - DNA, 203 bp, Homo sapiens
  source 1..203: mol_type = other DNA
ggcgcgccagtcctggtagtgccatggattagcaacaccacgtatcggcaaaccatagatgatagtttcaccgaaggcggatacatcagcgtcttctaccaaactagaatagtcgtccctctttcgacacccagagagatggacatccttggttttgtgtcagcgtgtaatgacttcagcgtgcgcttcgactcggaccgatg

SEQ ID NO: 5906 - DNA, 203 bp, Homo sapiens
  source 1..203: mol_type = other DNA
ggcgcgccagtcctgttgcgagataccacacatatagagcaaaaagcgctagcacaggggttaggtcagatgcttgaaagcatgattgacaacacagtccgtgaaacggtgggggcggcaacatctagagacgctctcccaaacactgaagccagtggaccaacacactccaaggaaattccggcactcgactcggaccgatg

SEQ ID NO: 5907 - DNA, 203 bp, Homo sapiens
  source 1..203: mol_type = other DNA
ggcgcgccagtcctcaccgcagtggaaactggggccacaaatccactagtcccttctgatacagtgcaaaccagacatgttgtacaacataggtcaaggtcagagtctagcatagagtctttcttcgcgcggggtgcatgcgtgaccattatgaccgtggataacccagcttccaccacgaataaggacgactcggaccgatg

SEQ ID NO: 5908 - DNA, 203 bp, Homo sapiens
  source 1..203: mol_type = other DNA
ggcgcgccagtccttaagctatttgcagtgtggaagatcacttataaagatactgtccagttacggaggaaattggagttcttcacctattctagatttgatatggaacttacctttgtggttactgcaaatttcactgagactaacaatgggcatgccttaaatcaagtgtaccaaattatgtacgtcgactcggaccgatg

SEQ ID NO: 5909 - DNA, 203 bp, Homo sapiens
  source 1..203: mol_type = other DNA
ggcgcgccagtcctggaccagtcggcagcactaggtgactccctttatggtgcagcatctctaaatgacttcggtattttggctgttagagtagtcaatgatcacaacccgaccaaggtcacctccaaaatcagagtgtatctaaaacccaaacacatcagagtctggtgcccgcgtccaccgagggccgactcggaccgatg

SEQ ID NO: 5910 - DNA, 203 bp, Homo sapiens
  source 1..203: mol_type = other DNA
ggcgcgccagtcctagtggcgtactacggccctggagtggattacaaggatggtacgcttacacccctctccaccaaggatctgaccacatatggattcggacaccaaaacaaagcggtgtacactgcaggttacaaaatttgcaactaccacttggccactcaggatgatttgcaaaacgcagtgaacgactcggaccgatg

SEQ ID NO: 5911 - DNA, 203 bp, Homo sapiens
  source 1..203: mol_type = other DNA
ggcgcgccagtcctcgtcatgtggagtagagacctcttagtcacagaatcaagagcccagggcaccgattcaatcgcaaggtgcaattgcaacgcaggggtgtactactgcgagtctagaaggaaatactacccagtatccttcgttggcccaacgttccagtacatggaggctaataactattaccccgactcggaccgatg

SEQ ID NO: 5912 - DNA, 203 bp, Homo sapiens
  source 1..203: mol_type = other DNA
ggcgcgccagtcctctatgaagacaccacaacagtgctcgctaccctggcccttcttgggtgtgatgcttcaccatggcagtggcttagaaagaaagcatgcgatgttctggagataccttatgtcatcaagcaaggtgacagttggttgaagaagtttactgaagcatgcaacgcagctaagggactcgactcggaccgatg

SEQ ID NO: 5913 - DNA, 203 bp, Homo sapiens
  source 1..203: mol_type = other DNA
ggcgcgccagtcctgatggtatcaacagtggagtttataccacccatggcatccctggaggagaaaggaatcctgtttacttcaaattacgttctagcatccacaaactcaagcagaatttccccccccactgtggcacacagtgatgcattagccaggcgctttgcgttcgacatggacattcaggtcgactcggaccgatg

SEQ ID NO: 5914 - DNA, 203 bp, Homo sapiens
  source 1..203: mol_type = other DNA
ggcgcgccagtcctcaaaaaacccaacgtgcccaccattcggacagcaaaggtacaaggaccagggttcgattacgcagtggctatggctaaaagaaacattgttacagcaactactagcaagggagagttcactatgttaggagtccacgacaacgtggctattttaccaacccacgcttcacctggcgactcggaccgatg

SEQ ID NO: 5915 - DNA, 203 bp, Homo sapiens
  source 1..203: mol_type = other DNA
ggcgcgccagtcctcctcccactggtgacttatgtaaaggatgaacttagatccaaaacaaaggttgagcaggggaaatccagattaattgaagcttctagtttgaatgactcagtggcaatgagaatggcttttgggaacctatatgctgcttttcacaaaaacccaggagtgataacaggttcagccgactcggaccgatg

SEQ ID NO: 5916 - DNA, 203 bp, Homo sapiens
  source 1..203: mol_type = other DNA
ggcgcgccagtcctcagggtaggtgcattgataacattattctctcttccctcagcaggcatgcaaaatcatattagattggcagatagatcacctgaagctcagatagaacgctgtgagattgacggttttgagccaggcacatataggctaattccgaatgcacgcgccaatcttactgccaatgacgactcggaccgatg

SEQ ID NO: 5917 - DNA, 203 bp, Homo sapiens
  source 1..203: mol_type = other DNA
ggcgcgccagtcctaattgctgcctatgctttgcttgcagatgacctccctccaaccataaataatggaactccctatgtacatgcagatgttgaaggacagccatgtgatgagattgagcaattcctagatcgatgctacagtgtactaatccaggcttgggtgatggtctgtaaatgtatgacagccgactcggaccgatg

SEQ ID NO: 5918 - DNA, 203 bp, Homo sapiens
  source 1..203: mol_type = other DNA
ggcgcgccagtccttggttattatttccagattggggttgagactgcacgacggcaacaaggcactgttgacaacagagtagcagatgatctaggcctgactcctgagcaaaggactgaggttactcagcttattgacaggcttgcaaggggcagaggtgcggggataccaggtgggcccgtgaatcccgactcggaccgatg

SEQ ID NO: 5919 - DNA, 203 bp, Homo sapiens
  source 1..203: mol_type = other DNA
ggcgcgccagtcctcccgtcctgcaaagcagccaaaaccccaaccagtaaaggatttagcaggacggaaagtgatgataactaaaatgatcactgactgtgtggccaatcctcaaatgaagcaggtgtttgagcaacgattggcaaaggccagcaccgaggatgctctgaatgatatcaagcgagacacgactcggaccgatg

SEQ ID NO: 5920 - DNA, 203 bp, Homo sapiens
  source 1..203: mol_type = other DNA
ggcgcgccagtccttcatctctgaatcatcacaacagaaggtgactcctgtagtgacggcgtgcatgctgtccttcggtgctggaccagtcctagaagacccacaacatatgctgaaagctcttgatcagacagacatcagggttcggaagacagcgagtgataaagagcagatcttattcgagatcacgactcggaccgatg

SEQ ID NO: 5921 - DNA, 203 bp, Homo sapiens
  source 1..203: mol_type = other DNA
ggcgcgccagtcctaagcttttaccgaatatccaacccactgataacagctgtgaatttaagagtgtaactcaatacaataagaccttgagtaatttgcttcttccaattgcagaaaacataaacaatattgcatcgccctcatctgggtcaagacggcataaaaggtttgctggcattgctattggccgactcggaccgatg

SEQ ID NO: 5922 - DNA, 203 bp, Homo sapiens
  source 1..203: mol_type = other DNA
ggcgcgccagtcctattgctgcgctcggtgttgcgaccgcagcacaagtaactgccgctgtctcattagttcaagcacagacgaatgcacgtgcaatagcggcgatgaaaaattcaatacaagcaactaatcgagcagtcttcgaagtgaaggaaggcactcaacggttagctatagcggtacaagcacgactcggaccgatg

SEQ ID NO: 5923 - DNA, 203 bp, Homo sapiens
  source 1..203: mol_type = other DNA
ggcgcgccagtcctcatgcagtcacgaccattgatctaaccgcatgtcaaacattgtccctagacggattggatttcagcattgtctctctaagcaacatcacttatgctgagaaccttaccatttcattgtctcagacaatcaatactcaacccattgacatatcaactgaactgagtaaggttaatcgactcggaccgatg

SEQ ID NO: 5924 - DNA, 203 bp, Homo sapiens
  source 1..203: mol_type = other DNA
ggcgcgccagtcctgatggagccctccaaactcttcacaatgtcagacaatgccacctttgcacctgggcctgttatcaatgcggctgacaagaagacattccgaacctgcttccgaatattggtactgtctgtacaagctgttacccttatattagttattgtcactttaggtgagcttgtgaggatcgactcggaccgatg

SEQ ID NO: 5925 - DNA, 203 bp, Homo sapiens
  source 1..203: mol_type = other DNA
ggcgcgccagtcctgatcaatgatcaaggcttgagcaatcagttgtcttcaattgcagacaagataagagagtcagctactatgattgcatctgctgtgggagtaatgaatcaagttattcacggagtaacggtatccttacccctacaaattgagggaaaccaaaatcaattgttatccacgcttgccgactcggaccgatg

SEQ ID NO: 5926 - DNA, 203 bp, Homo sapiens
  source 1..203: mol_type = other DNA
ggcgcgccagtcctagtaaccattgtggatactaggtccactctatgcattattgccccagaattagttgctttatactccaatgagcacaaagcattaacgtacctcacctttgaaatggtattaatggtcactgatatgttagagggacgactcaatgtttcttctttgtgcacagctagtcattacgactcggaccgatg

SEQ ID NO: 5927 - DNA, 203 bp, Homo sapiens
  source 1..203: mol_type = other DNA
ggcgcgccagtccttctgtcccctctaaagaagagaatcgaaattctcctaacattagttgatgaccttgctctacttatgggggacaaagtatacggtgttgtctcttcacttgagagttttgtttacgcccaattacagtatggtgatcctgttgtagacattaagggtacattctatggatttatcgactcggaccgatg

SEQ ID NO: 5928 - DNA, 203 bp, Homo sapiens
  source 1..203: mol_type = other DNA
ggcgcgccagtcctagcatccaaggtccgagagtccatgtgtgctcctaaggtgttagatttccaaacaataatgaagaccctggctttctttcatgcaatcctgattaacggttataggaggagccataatggaatctggcctcctactactcttcatggcaatgcccccaaaagcctcattgagatcgactcggaccgatg

SEQ ID NO: 5929 - DNA, 203 bp, Homo sapiens
  source 1..203: mol_type = other DNA
ggcgcgccagtcctgagcctgataaaacagcgatatcgtgatgcgaatcggcctctaccacaaccattcaaccgacggctactgttgaattttctagaggatgacagattcgatcccattaaggagcttgagtatgtcaccagtggagaatatcttagggaccctgaattttgtgcatcttactctctcgactcggaccgatg

SEQ ID NO: 5930 - DNA, 203 bp, Homo sapiens
  source 1..203: mol_type = other DNA
ggcgcgccagtccttgacctcacaaaatactgcttaaattggaggtaccaagtcatcatcccctttgcgcgtacattgaattcaatgtatggtataccccacctgttcgaatggatacatttaaggctaatgcgaagcactctctatgttggtgatcccttcaatcctccatcagatcctacccaactcgactcggaccgatg

SEQ ID NO: 5931 - DNA, 203 bp, Homo sapiens
  source 1..203: mol_type = other DNA
ggcgcgccagtccttgaccttgatacagctctcaatgatgatatatttatagtttctcctcgtggaggaatcgagggtttatgtcaaaaattatggactatgatttccatctcaacaatcatattatccgcgactgaggcaaacactagagttatgagtatggttcagggtgacaaccaagcaattgccgactcggaccgatg

SEQ ID NO: 5932 - DNA, 203 bp, Homo sapiens
  source 1..203: mol_type = other DNA
ggcgcgccagtcctgttttacaaaggtcgaattttgactcaagcgttaaagaacgtgagcaagatgtgcttaacagctgacatactaggggactgttcacaagcatcatgctccaatttagctactactgtaatgcgcctgactgagaatggggtcgagaaagatttgtgttattttctaaatgcattcgactcggaccgatg

SEQ ID NO: 5933 - DNA, 203 bp, Homo sapiens
  source 1..203: mol_type = other DNA
ggcgcgccagtcctattaaaatttacccctgcaagctcctatgcattctctagctttgttcatatatctaatgactgtcaagttcttgagatcgatgatcaggtaacagattctaacctgatttaccagcaagttatgattactggccttgctttaattgagacatggaacaatcctccaatcaacttcgactcggaccgatg

SEQ ID NO: 5934 - DNA, 203 bp, Homo sapiens
  source 1..203: mol_type = other DNA
ggcgcgccagtcctcatctcatccacaattagtcaccctcgtatactcagaagatgcatcaatctggatgtcatagcccctatcaattctccacacatagcttcactggattacacaaaattgagcatagatgcagtaatgtggggaactaagcaggttttgaccaacatttcgcaaggtatcgattacgactcggaccgatg

SEQ ID NO: 5935 - DNA, 203 bp, Homo sapiens
  source 1..203: mol_type = other DNA
ggcgcgccagtccttgagatagttgttccttctgaaagccaactcacactcagtgatagagttctaaatctagttgcacgaaaactatcactactggcaatcatctgggccaattataactaccctccaaaggttaaaggtatgtcacctgaggacaaatgtcaggctttaactacccatctactccacgactcggaccgatg

SEQ ID NO: 5936 - DNA, 203 bp, Homo sapiens
  source 1..203: mol_type = other DNA
ggcgcgccagtcctctttggatatctggaaccaatactaatggaatctaaaatattcaatctaagttcatccgaatcagcatcccttacagaatttgatttcatcctcaacttggaattgtctgaagccagccttgagaaatactctctcccaagtttgcttatgacggctgagaatatggataaccccgactcggaccgatg

SEQ ID NO: 5937 - DNA, 203 bp, Homo sapiens
  source 1..203: mol_type = other DNA
ggcgcgccagtccttaacagcgatatcactgacttaagcacgaaaactagtgtcgagtacattattcacaaggtaggggctgatacatgtgcgttggttcatgtggatctggagggtgtacccggctcaatgaacagtatgttggagagagcccaagttcatgcgctactgatcacggtaactgtactcgactcggaccgatg

SEQ ID NO: 5938 - DNA, 203 bp, Homo sapiens
  source 1..203: mol_type = other DNA
ggcgcgccagtcctgcttacccctgatgttgaagattctgagcgcattgatattgacaatgatatacctgattatgatatccacggggacataatttaaatcgactaaagactcctctggcatgataagtcaccaaaaggttccacaccagcatccaaattcttctagaccgtacacgacctcgaatacgactcggaccgatg

SEQ ID NO: 5939 - DNA, 203 bp, Homo sapiens
  source 1..203: mol_type = other DNA
ggcgcgccagtcctggacataatttaaatcgactaaagactcctctggcatgataagtcaccaaaaggttccacaccagcatccaaattcttctagaccgtacacgacctcgaataatcataaccacatcagtattaaatccataatatcattttaagaaaaaattgattttactttctccccttggtcgactcggaccgatg

SEQ ID NO: 5940 - DNA, 203 bp, Homo sapiens
  source 1..203: mol_type = other DNA
ggcgcgccagtccttcaactgacagcaaccccatagtctggtgctcatgacagtgtgagagttcaatactcacctctccactgtcgtgaggacccttatgttaaccacaaaccttatatttttaggagccgggaggatagctcaacctgttaagaactcagaaggttatgtatattcttccttgctcccgactcggaccgatg

SEQ ID NO: 5941 - DNA, 203 bp, Homo sapiens
  source 1..203: mol_type = other DNA
ggcgcgccagtcctggattatacaagctggttttataatccgagaagtctatgaagtactggggcttgatcctcttggtcgacccctgaacttcccagggggtttaacacaaagagacaccgctgttcctgttacaagaggaagaggacgaggacgaacaggcccccgacgaggaccagttctgcccgcgactcggaccgatg

SEQ ID NO: 5942 - DNA, 203 bp, Homo sapiens
  source 1..203: mol_type = other DNA
ggcgcgccagtcctatgggccaacctatatgggtatattctcccatacactctatgaccagaatacagaaaacacccttaacagaaaggaaggcattatcaattcggtggttaaaatggcaaacttattttgaagatcctagattaatatttcattatgatgatacattaccagatttacaaaatcttcgactcggaccgatg

SEQ ID NO: 5943 - DNA, 203 bp, Homo sapiens
  source 1..203: mol_type = other DNA
ggcgcgccagtcctaataagaaaaagccactgaaacatgtgagtaaatggaaatcaatagctgactgtaaaaaacataaggccgatatccacgtgatacatgagccaggccatcaaaatgatttgcaatcaccttatgccatgggcaacaatgctgctgataaattggcagtcaaggccagttacactcgactcggaccgatg

SEQ ID NO: 5944 - DNA, 203 bp, Homo sapiens
  source 1..203: mol_type = other DNA
ggcgcgccagtcctaaggctctcaatcatctcactggtactgctattcctaaggtgctgcattctgatcaaggatcagcattcacctctgcaactttggtcgcctgggccaaagacaagggtatacaaatggaatacagttctccttatcatccccaaagtagtggtaaagttgaaaggaaaaacagtcgactcggaccgatg

SEQ ID NO: 5945 - DNA, 203 bp, Homo sapiens
  source 1..203: mol_type = other DNA
ggcgcgccagtcctgagataaaacgactcttgacaaaactattggttggacggcctacaaagtggtacccacttatacctactgttcaattggcattgaataatactccaaatgcaaaaataggcaaaacgccacatcaattgatgtatggagtggattgtaatcttcccttccaggatctaagtacacgactcggaccgatg

SEQ ID NO: 5946 - DNA, 203 bp, Homo sapiens
  source 1..203: mol_type = other DNA
ggcgcgccagtcctacctgatgtgcagatagatttgcctgtttataatcctgacatgactaagccattgcctctttgtttgcggattaagtattggatgtatttgttatgtgctacctcaccgcgtgtaatggcttggttactgtttgtttgtgttttgatatctgttatgatcatagctgttatagtcgactcggaccgatg

SEQ ID NO: 5947 - DNA, 203 bp, Homo sapiens
  source 1..203: mol_type = other DNA
ggcgcgccagtcctccaaggggtctttttggaaccctttcctaaacctattattgacaaggagagggttttgggtatttcacaaattgttatgattgattctggttcaatagcccaatctatgaatttggatttgtatatgaaacatttgttggtggatatgattaatgaagagatggttgcattaagcgactcggaccgatg

SEQ ID NO: 5948 - DNA, 203 bp, Homo sapiens
  source 1..203: mol_type = other DNA
ggcgcgccagtccttaatgtggtgcttccttttgaattaccagtaggggatccctcaactcaagaccaatatatacataagagatgttatcagcagtttgcacactgctatatagtatggcaacctggtaggcgtgtctggcctacttcagagattatacaagaccaatgtccattaccagatcatcccgactcggaccgatg

SEQ ID NO: 5949 - DNA, 203 bp, Homo sapiens
  source 1..203: mol_type = other DNA
ggcgcgccagtcctatatggaaactggtggtatcttaatagaacctctgaacaaaaggaagaaacatataggaagaagatgctaaatttgacagaaaataactcttccattctaaaagatagagctttgccaccaacatggacccctaaaggacaagccaggctgtttagagaattaaacccattagacgactcggaccgatg

SEQ ID NO: 5950 - DNA, 203 bp, Homo sapiens
  source 1..203: mol_type = other DNA
ggcgcgccagtcctatataaggtacaatctttatatcaagaatgtattcaaaaggggacctcatatgatttggaagatgtaattaatcaactcttaagggtcttacagaacaatggaatagatttgggtaaagtaccagcctcacgagcatttactcctttctataaccaaatgcctgtctcttataacgactcggaccgatg

SEQ ID NO: 5951 - DNA, 203 bp, Homo sapiens
  source 1..203: mol_type = other DNA
ggcgcgccagtccttgctggtcatcttgctagggtagaattacaacatccttatgaaatagttaaccaagactgtgagcaactgacttatctagaactcaagggatgtcaagaattggattatctggtatgcgaagaaatccttcaacatgaaccatgtggaaatcagacaggatctgactgtccagtcgactcggaccgatg

SEQ ID NO: 5952 - DNA, 203 bp, Homo sapiens
  source 1..203: mol_type = other DNA
ggcgcgccagtcctgggttgcctaacatggactggacagttgaatgggatggggagatttcagattcagctcttcaggaatttgactttgatctcagtctgtttgggcagtgatcaccacaaaggtattacagattattgttgtggacctgcttcatgctatactattgtgtgggaaattagtgcagacgactcggaccgatg

SEQ ID NO: 5953 - DNA, 203 bp, Homo sapiens
  source 1..203: mol_type = other DNA
ggcgcgccagtcctagtattggcaacaggaactccttatcttttcagagctcagcctcatcataggccactacaaacccctgctccttggtccaaaaggcttattaggaccagatatatcagaaattctgtagaagatcaatttgtacattttgccactgaagcaaattacactcccctttcagcccacgactcggaccgatg

SEQ ID NO: 5954 - DNA, 203 bp, Homo sapiens
  source 1..203: mol_type = other DNA
ggcgcgccagtcctctcatgacagtgtgagagttcaatactcacctctccactgtcgtgaggacccttatgttaaccacaaaccttatatttttaggagccgggaggatagctcaacctgttaagaactcagaaggttatgtatattcttccttgctcccggtggttcgatccctgtttagcctgatacgactcggaccgatg

SEQ ID NO: 5955 - DNA, 203 bp, Homo sapiens
  source 1..203: mol_type = other DNA
ggcgcgccagtcctcgatagccgctaacctgggacgaactccccttttagtttcggttttaagatgcttccgcatacgcatatagatagaagtaggaagtagttaatcccagtctgagggatggctcgtccaacaaaccacacatcgaggaatgtaatacctgtcctctctcagatcagtggagggaccgactcggaccgatg

SEQ ID NO: 5956 - DNA, 203 bp, Homo sapiens
  source 1..203: mol_type = other DNA
ggcgcgccagtcctccatggaggcactaatggtcacaacagtggacaaattgactcaggggagacagacctttgattggacggtgtgtagaaaccaacctgctgcaacggcactgaacacaacaataacctcttttaggttgaatgatttaaatggagccgacaagggtggattagtgcccttttgcccgactcggaccgatg

SEQ ID NO: 5957 - DNA, 203 bp, Homo sapiens
  source 1..203: mol_type = other DNA
ggcgcgccagtcctgaacggcatctctttcgccaggaatgatgatgggaatgtttaatatgctatctacagtattaggagtagccgcactagggataaaaaacattggaaacaaagaatacttatgggatggactgcagtcttcggatgattttgctctgtttgttaatgcaaaagatgaagagacatcgactcggaccgatg

SEQ ID NO: 5958 - DNA, 203 bp, Homo sapiens
  source 1..203: mol_type = other DNA
ggcgcgccagtccttacgaaagcttttttctcagaaagatgagacttgacaatgccacttggggccgaataacctttggccctgttgagagagtaagaaaaagagtactactaaacccgctcaccaaggaaatgcccccagatgaagcgagcaatgtaataatggaaatattattccctaaagaagcacgactcggaccgatg

SEQ ID NO: 5959 - DNA, 203 bp, Homo sapiens
  source 1..203: mol_type = other DNA
ggcgcgccagtccttttgaaagcataatccctcagaagatggctggtcagtacagtggatttgcaagagcagtgctcaaacaaatgagagaccaagaggttatgaaaactgaccaattcataaaattgttgcctttctgtttttcgccaccaaaattaaggagcaatggagagccttatcaatttttgcgactcggaccgatg

SEQ ID NO: 5960 - DNA, 203 bp, Homo sapiens
  source 1..203: mol_type = other DNA
ggcgcgccagtcctggctttcttgttagtggcaaatatgaccctgatcttggagatttcaaaaccattgaggaacttgaaagactaaaaccgggagaaaaagccaacatcttactttaccaaggaaagcccgttaaagtagttaaaaggaaaagatatagtgctttatccaatgatatttcacaagggcgactcggaccgatg

SEQ ID NO: 5961 - DNA, 203 bp, Homo sapiens
  source 1..203: mol_type = other DNA
ggcgcgccagtcctctggccaatatgactgaaggaaagtccaagaaaccgaagaccttagctaaggaatgtctagaaaggtattcaacactacgtgatcaaactgacccaatattgataatgaaaagcgaaaaagctaacgaaaacttcttatggaggttatggagggactgtgtaaatacaataagccgactcggaccgatg

SEQ ID NO: 5962 - DNA, 203 bp, Homo sapiens
  source 1..203: mol_type = other DNA
ggcgcgccagtcctttattaaatgaaagcaatgctagtatgggaaaatataaagtaataccaatcaccaacagagtggtaaatgaaaaaggggaaagctttgacatgctttatggtctggcggttaaggggcaatctcatttgcggggggacacggatgttgtaacagttgtgactttcgagtttagtcgactcggaccgatg

SEQ ID NO: 5963 - DNA, 203 bp, Homo sapiens
  source 1..203: mol_type = other DNA
ggcgcgccagtccttcaaatcctcaaaagttcacctcatctgccaatggagtaaccacacattatgtttctcagattggtggcttcccaaatcaaacagaagacgaagggctaaaacaaagcggcagaattgttgttgattacatggtacaaaaacctggaaaaacaggaacaattgtttatcaaagacgactcggaccgatg

SEQ ID NO: 5964 - DNA, 203 bp, Homo sapiens
  source 1..203: mol_type = other DNA
ggcgcgccagtcctggactgaaaagggttggacttgacccttcattaatcagtacttttgccggaagcacactacccagaagatcaggtacaactggtgttgcaatcaaaggaggtggaactttagtggatgaagccatccgatttataggaagagcaatggcagacagagggctactgagagacatccgactcggaccgatg

SEQ ID NO: 5965 - DNA, 203 bp, Homo sapiens
  source 1..203: mol_type = other DNA
ggcgcgccagtcctcatcaacaaaaacaactgcaccaacaatgtcattagagtgcacaaacgcatcaaatgcccagactgtgaaccattctgcaacaaaagagatgacatttccacccccagagccggagtggacataccctcgtttatcttgccagggctcaacctttcagaaggcactcctaattacgactcggaccgatg

SEQ ID NO: 5966 - DNA, 203 bp, Homo sapiens
  source 1..203: mol_type = other DNA
ggcgcgccagtcctgccctcataggttcggagagatcaaaggaaactcagctcccttgataataagagaaccttttgttgcttgtggaccaaaagaatgcagacactttgctctgacccattatgcagctcagccggggggatactacaatggaacaagaaaggacagaaacaagctgaggcatctagcgactcggaccgatg

SEQ ID NO: 5967 - DNA, 203 bp, Homo sapiens
  source 1..203: mol_type = other DNA
ggcgcgccagtcctacactgaagagtgcacatgcgggttcgccagcaataaaaccatagaatgtgcctgtagagacaacagttacacagcaaaaagaccctttgtcaaattaaatgtggaaactgatacagctgaaataagattgatgtgcacaaagacttatctagacactcccagaccggatgatgcgactcggaccgatg

SEQ ID NO: 5968 - DNA, 203 bp, Homo sapiens
  source 1..203: mol_type = other DNA
ggcgcgccagtcctgaagcatagcagggccttgcgaatctaatggagacaagtggcttggaggcatcaaaggaggattcgtccatcaaagaatggcatctaagattggaagatggtactcccgaacgatgtctaaaactaacagaatggggatggaactgtatgtaaagtatgatggtgacccatggacgactcggaccgatg

SEQ ID NO: 5969 - DNA, 203 bp, Homo sapiens
  source 1..203: mol_type = other DNA
ggcgcgccagtccttgcctaactgatatacaaaaagcactaattggtgcctctatatgctttttaaaacccaaagaccaagaaagaaaaaggagattcatcacagagcccctgtcaggaatgggaacaacagcaacaaagaagaaaggcctaattctagctgagagaaaaatgagaagatgtgtaagccgactcggaccgatg

SEQ ID NO: 5970 - DNA, 203 bp, Homo sapiens
  source 1..203: mol_type = other DNA
ggcgcgccagtcctgggtaaacttgaaaatacaaataaggaatccaaataaggaggcaataaacagagaggtgtcaattctgagacacaattaccaaaaggaaatccaagccaaagaaacaatgaagaaaatactctctgacaacatggaagtattgggtgaccacatagtagttgaagggctttcaacgactcggaccgatg

SEQ ID NO: 5971 - DNA, 203 bp, Homo sapiens
  source 1..203: mol_type = other DNA
ggcgcgccagtcctcaagaccgcctacacagactaaaacgaaaattagaatcaagaataaagactcacaacaagagtgagcctgagaataaaaggatgtctcttgaagagagaaaagcaattggggtaaaaatgatgaaagtgcttctgtttatggatccctctgctggaattgaagggtttgagccacgactcggaccgatg

SEQ ID NO: 5972 - DNA, 203 bp, Homo sapiens
  source 1..203: mol_type = other DNA
ggcgcgccagtcctcccgtcaaaataacaacttataacacgatgttacccgaagaaaccattttagtgtaacatttaagattagaagtagttcatctaatagagataggcactattagaaggaggccttttctaaaggagccgttagtcagcccagacaagcgcagtactttagaagagagaagttcccgactcggaccgatg

SEQ ID NO: 5973 - DNA, 203 bp, Homo sapiens
  source 1..203: mol_type = other DNA
ggcgcgccagtccttacctacaaaaaactgggaattgaagcaatgattaaaagacttggagatttgggaagagcagccaaaggctgttcagatttgaatgtggtgctcaaccaggctataaccaaccacatgttagaacattttgggaagaatgttcttggtttaaaacaagaagatgaactcaaagtcgactcggaccgatg

SEQ ID NO: 5974 - DNA, 203 bp, Homo sapiens
  source 1..203: mol_type = other DNA
ggcgcgccagtccttaaccctaaccctgaatttatggagttaatacgtacagctaacatagctccataccccttacacatggctcacctcgaagataaaaggaaaacaaaattcacatcaaaagtaatcattatgacatctaatgtttttgaacaggatgttaattcactaacatttccagatgcattcgactcggaccgatg

SEQ ID NO: 5975 - DNA, 203 bp, Homo sapiens
  source 1..203: mol_type = other DNA
ggcgcgccagtcctgatgaccgttagtttaatactgggcactctcattggaatacttactgttgtagggttttggaaatggttatgtagtggcgataaaaagaagaatccgataaaaagacattttattaatacaggcaatgttctaatcttacccgatagagaattaaacaccttttggaaaaatcacgactcggaccgatg

SEQ ID NO: 5976 - DNA, 203 bp, Homo sapiens
  source 1..203: mol_type = other DNA
ggcgcgccagtcctaattaagacaaaacccgccatcctaagaaatgtgatagtggatggaaaaattgttaatataaaacataaaaacttgaagaaatgcgccatggacacaccctatgtgtcaaaagaaatgactgaagaagcttttcagttagttaaatcagtctggttaaagggaatgcgtaatgacgactcggaccgatg

SEQ ID NO: 5977 - DNA, 203 bp, Homo sapiens
  source 1..203: mol_type = other DNA
ggcgcgccagtcctgtactatttgggcttcatagcacaccttatggaaaatcgaataaccaatgaagtatccataggaactaatgtttattcccaagattggaataagacagttagaaaacttaaaactatgggacccaaggttattgcaggagatttctcaacctttgatggatctttgaatgtttgcgactcggaccgatg

SEQ ID NO: 5978 - DNA, 203 bp, Homo sapiens
  source 1..203: mol_type = other DNA
ggcgcgccagtccttttggatatcagtacatataatggttatgctcaggagagattcctaaattactacttgtaatttgggaatcgcaacacaacatggttacccatagattgaggaaatttccaataaactcagtattaaggcttgttgtgttggacaaggtgccctatttagggtgaggagccttacgactcggaccgatg

SEQ ID NO: 5979 - DNA, 203 bp, Homo sapiens
  source 1..203: mol_type = other DNA
ggcgcgccagtcctctggcagccccagtgaatcctccattggataggaacagctatattgggtagttgtagcagttgtattcaaatgaatgcagcgttccgaaatatcatacctgccgatcaagaaacaaatacttccaacgtacataatacgcaactcgcgtcgacctctgaagaaaactcagttgacgactcggaccgatg

SEQ ID NO: 5980 - DNA, 203 bp, Homo sapiens
  source 1..203: mol_type = other DNA
ggcgcgccagtccttgataacaaacccctcaatagatatgtgttaaatcgacagaatccacaaccatttgttaaatcttggacattgccttcagtagttttaagtgctggaggtaagggacaaaaattagctaattttaaatatttacgatgtgatgttaaagtcaaaattgttctaaacgcaaatcccgactcggaccgatg

SEQ ID NO: 5981 - DNA, 203 bp, Homo sapiens
  source 1..203: mol_type = other DNA
ggcgcgccagtcctagcatatgatttagtcacaggtactgaagattttgtcaagctatatctatttacaataacgcccatattatccccgactagcacatctgctagttcaaaggtggacctttcagtttatatgtggttggataatatttccttagtcatacccacgtatcgcgttaacacgagcatcgactcggaccgatg

SEQ ID NO: 5982 - DNA, 203 bp, Homo sapiens
  source 1..203: mol_type = other DNA
ggcgcgccagtcctcgtaccaaatgtggggactgttgttcagacagtacaaaatatgactacacgagacagtgaaacaattaggaaagcaatggttgcattaaggaaaaataataaatcaacttacgactatatagtgcaagctttatcttctgcagttccagaagttaagaatgtaactatgcagatcgactcggaccgatg

SEQ ID NO: 5983 - DNA, 203 bp, Homo sapiens
  source 1..203: mol_type = other DNA
ggcgcgccagtccttgctgccatgccggaagaggagacaactgaagctaatgccggtcagtttctctcctttgcaagtctattccttccgaaattggtagtaggagaaaaggcttgccttgagaaggttcaaaggcaaattcaagtacatgcagagcaaggactgatacaatatccaacagcttggcacgactcggaccgatg

SEQ ID NO: 5984 - DNA, 203 bp, Homo sapiens
  source 1..203: mol_type = other DNA
ggcgcgccagtcctacttgatcatatcctacaaaagacagaacgaggagttcgtctccatcctcttgcaaggaccgccaaggtaaaaaatgaggtgaactcctttaaggctgcactcagctccctggccaagcatggagagtatgctcctttcgcccgacttttgaacctttctggagtaaataatctcgactcggaccgatg

SEQ ID NO: 5985 - DNA, 203 bp, Homo sapiens
  source 1..203: mol_type = other DNA
ggcgcgccagtccttggacttgatgatcaggaaaagaaaattcttatgaacttccatcagaaaaagaacgaaatcagcttccagcaaacaaacgctatggtaactctaagaaaagagcgcctggccaagctgacagaagctatcactgctgcgtcactgcccaaaacaagtggacattacgatgatgacgactcggaccgatg

SEQ ID NO: 5986 - DNA, 203 bp, Homo sapiens
  source 1..203: mol_type = other DNA
ggcgcgccagtccttgacgacattccctttccaggacccatcaatgatgacgacaatcctggccatcaagatgatgatccgactgactcacaggatacgaccattcccgatgtggtggttgatcccgatgatggaagctacggcgaataccagagttactcggaaaacggcatgaatgcaccagatgacgactcggaccgatg

SEQ ID NO: 5987 - DNA, 203 bp, Homo sapiens
  source 1..203: mol_type = other DNA
ggcgcgccagtcctcaaccgcacacccactgtcgccccaccggctcccgtatacagagatcactctgaaaagaaagaactcccgcaagacgagcaacaagatcaggaccacactcaagaggccaggaaccaggacagtgacaacacccagtcagaacactcttttgaggagatgtatcgccacattctcgactcggaccgatg

SEQ ID NO: 5988 - DNA, 203 bp, Homo sapiens
  source 1..203: mol_type = other DNA
ggcgcgccagtcctcaactagaacaaagggcaggggccatactgcggccacgactcaaaacgacagaatgccaggccctgagctttcgggctggatctctgagcagctaatgaccggaagaattcctgtaagcgacatcttctgtgatattgagaacaatccaggattatgctacgcatcccaaatgccgactcggaccgatg

SEQ ID NO: 5989 - DNA, 203 bp, Homo sapiens
  source 1..203: mol_type = other DNA
ggcgcgccagtcctcacctgtcatccacatccgctctcgaggtgacattccccgagcttgccagaaaagcttgcgtccagtcccaccatcgcccaagattgatcgaggttgggtatgtgtttttcagcttcaagatggtaaaacacttggactcaaaatttgagccaatctcccttccctccgaaagacgactcggaccgatg

SEQ ID NO: 5990 - DNA, 203 bp, Homo sapiens
  source 1..203: mol_type = other DNA
ggcgcgccagtcctggcgaataatagcagaggcttcaactgctgaactatagggtacgttacattaatgatacacttgtgagtatcagccctggataatataagtcaattaaacgaccaagataaaattgttcatatctcgctagcagcttaaaatataaatgtaataggagctatatctctgacagtcgactcggaccgatg

SEQ ID NO: 5991 - DNA, 203 bp, Homo sapiens
  source 1..203: mol_type = other DNA
ggcgcgccagtccttccttgaagctatggtgaatgtcatatcgggccccaaagtgctaatgaagcaaattccaatttggcttcctctaggtgtcgctgatcaaaagacctacagctttgactcaactacggccgccatcatgcttgcttcatacactatcacccatttcggcaaggcaaccaatccaccgactcggaccgatg

SEQ ID NO: 5992 - DNA, 203 bp, Homo sapiens
  source 1..203: mol_type = other DNA
ggcgcgccagtcctttgtcagagtcaatcggctgggtcctggaatcccggatcatcccctcaggctcctgcgaattggaaaccaggctttcctccaggagttcgttcttccgccagtccaactaccccagtatttcacctttgatttgacagcactcaaactgatcacccaaccactgcctgctgcaacgactcggaccgatg

SEQ ID NO: 5993 - DNA, 203 bp, Homo sapiens
  source 1..203: mol_type = other DNA
ggcgcgccagtcctagatcgttccaattgatccaaccaaaaatatcatgggaatcgaagtgccagaaactctggtccacaagctgaccggtaagaaggtgacttctaaaaatggacaaccaatcatccctgttcttttgccaaagtacattgggttggacccggtggctccaggagacctcaccatggcgactcggaccgatg

SEQ ID NO: 5994 - DNA, 203 bp, Homo sapiens
  source 1..203: mol_type = other DNA
ggcgcgccagtcctaacccttgccacaatctccacgagtccccaatccctcacaaccaaaccaggtccggacaacagcacccataatacacccgtgtataaacttgacatctctgaggcaactcaagttgaacaacatcaccgcagaacagacaacgacagcacagcctccgacactccctctgccaccgactcggaccgatg

SEQ ID NO: 5995 - DNA, 203 bp, Homo sapiens
  source 1..203: mol_type = other DNA
ggcgcgccagtcctgggaatttacatagaggggctaatgcacaatcaagatggtttaatctgtgggttgagacagctggccaacgagacgactcaagctcttcaactgttcctgagagccacaactgagctacgcaccttttcaatcctcaaccgtaaggcaattgatttcttgctgcagcgatggggcgactcggaccgatg

SEQ ID NO: 5996 - DNA, 203 bp, Homo sapiens
  source 1..203: mol_type = other DNA
ggcgcgccagtcctatcactgcattcttgaatattgctctccagttaccgtgtgaaagttctgctgtcgttgtttcagggttaagaacattggttcctcaatcagataatgaggaagcttcaaccaacccggggacatgctcatggtctgatgagggtaccccttaataaggctgactaaaacactatcgactcggaccgatg

SEQ ID NO: 5997 - DNA, 203 bp, Homo sapiens
  source 1..203: mol_type = other DNA
ggcgcgccagtcctaccttattattcagattaggccccaagaggcattcttcatctccttttagcaaagtactatttcagggtagtccaattagtggcacgtcttttagctgtatatcagtcgcccctgagatacgccacaaaagtgtctctaagctaaattggtctgtacacatcccatacattgtacgactcggaccgatg

SEQ ID NO: 5998 - DNA, 203 bp, Homo sapiens
  source 1..203: mol_type = other DNA
ggcgcgccagtcctagagcttgcgggttatattcatcatactcccttaatccgcaactacgcaactgtaaactcccgaaacatatctaccgtttgaaatacgatgtaactgttaccaagttcttgagtgatgtaccagtggcgacattgcccatagatttcatagtcccagttcttctcaaggcactgcgactcggaccgatg

SEQ ID NO: 5999 - DNA, 203 bp, Homo sapiens
  source 1..203: mol_type = other DNA
ggcgcgccagtcctcatcaagcatcatggcaccacacaagtgatgattttggtgaacatgccacagttagagggagtagctttgtaactgatttagagaaatacaatcttgcatttagatatgagtttacagcaccttttatagaatattgcaaccgttgctatggtgttaagaatgtttttaattggcgactcggaccgatg

SEQ ID NO: 6000 - DNA, 203 bp, Homo sapiens
  source 1..203: mol_type = other DNA
ggcgcgccagtcctcaaatttctttagttgaaattaagactggttttaagttacgctcagctgtgatgggtgacaatcagtgcattactgttttatcagtcttccccttagagactgacgcagacgagcaggaacagagcgccgaagacaatgcagcgagggtggccgccagcctagcaaaagttacacgactcggaccgatg

SEQ ID NO: 6001 - DNA, 203 bp, Homo sapiens
  source 1..203: mol_type = other DNA
ggcgcgccagtcctagtataggcactgcttttgagcgatccatctctgagacacgacatatctttccttgcaggataaccgcagctttccatacgtttttttcggtgagaatcttgcaatatcatcatctcgggttcaataaaggttttgaccttggacagttaacactcggcaaacctctggatttccgactcggaccgatg

SEQ ID NO: 6002 - DNA, 203 bp, Homo sapiens
  source 1..203: mol_type = other DNA
ggcgcgccagtcctggagccacactcccatgtatgattgagcaattcaaagtgttttggctgaaaccctacgaacaatgtccgcagtgttcaaatgcaaagcaaccaggtgggaaaccattcgtgtcagtggcagtcaagaaacatattgttagtgcatggccgaacgcatcccgaataagctggactcgactcggaccgatg

SEQ ID NO: 6003 - DNA, 203 bp, Homo sapiens
  source 1..203: mol_type = other DNA
ggcgcgccagtcctgaagcacgagtaaatttaagtgttcaagaaatacttcaaatgaccccttcacattactcaggaaatattgttcacaggtacaacgatcaatacagtcctcattctttcatggccaatcgtatgagtaattcagcaacgcgattgattgtttctacaaacactttaggtgagtttcgactcggaccgatg

SEQ ID NO: 6004 - DNA, 203 bp, Homo sapiens
  source 1..203: mol_type = other DNA
ggcgcgccagtcctttatctggatgggagctagccaagaccatcatgcaatcaattatttcagatagcaacaattcatctacagacccaattagcagtggagaaacaagatcattcactacccatttcttaacttatcccaagataggacttctgtacagttttggggcctttgtaagttattatcttcgactcggaccgatg

SEQ ID NO: 6005 - DNA, 203 bp, Homo sapiens
  source 1..203: mol_type = other DNA
ggcgcgccagtcctaaccgaaaatacttggcaagagactcttcaactggatcaagcacaaacaacagtgatggtcatattgagagaagtcaagaacaaaccaccagagatccacatgatggcactgaacggaatctagtcctacaaatgagccatgaaataaaaagaacgacaattccacaagaaaaccgactcggaccgatg

SEQ ID NO: 6006 - DNA, 203 bp, Homo sapiens
  source 1..203: mol_type = other DNA
ggcgcgccagtcctgagagtttcaagtcggctgtgacgctagcagagggagaaggtgctggtgccttactattgattcagaaataccaagttaagaccttatttttcaacacgctagctactgagtccagtatagagtcagaaatagtatcaggaatgactactcctaggatgcttctacctgttatgcgactcggaccgatg

SEQ ID NO: 6007 - DNA, 203 bp, Homo sapiens
  source 1..203: mol_type = other DNA
ggcgcgccagtccttcaaaattccataatgaccaaattgagattattcttaacaactcagcaagccaaataacagacataacaaatcctacttggtttaaagaccaaagagcaaggctacctaagcaagtcgaggttataaccatggatgcagagacaacagagaatataaacagatcgaaattgtaccgactcggaccgatg

SEQ ID NO: 6008 - DNA, 203 bp, Homo sapiens
  source 1..203: mol_type = other DNA
ggcgcgccagtccttcaggaaggagataggccgcatgctgaacatcttgaacgggagaaaaaggtcaacgataacattgctgtgcttgattcccaccgtaatggcgttttccctcagcacaagagatggcgaacccctcatgatagtggcaaaacatgaaagggggagacctctcttgtttaagacaacgactcggaccgatg

SEQ ID NO: 6009 - DNA, 203 bp, Homo sapiens
  source 1..203: mol_type = other DNA
ggcgcgccagtcctagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggacgactcggaccgatg

SEQ ID NO: 6010 - DNA, 203 bp, Homo sapiens
  source 1..203: mol_type = other DNA
ggcgcgccagtcctgagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtagcgactcggaccgatg

SEQ ID NO: 6011 - DNA, 203 bp, Homo sapiens
  source 1..203: mol_type = other DNA
ggcgcgccagtcctcagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtcgactcggaccgatg

SEQ ID NO: 6012 - DNA, 203 bp, Homo sapiens
  source 1..203: mol_type = other DNA
ggcgcgccagtcctatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaacgactcggaccgatg

SEQ ID NO: 6013 - DNA, 203 bp, Homo sapiens
  source 1..203: mol_type = other DNA
ggcgcgccagtcctacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaacgactcggaccgatg

SEQ ID NO: 6014 - DNA, 203 bp, Homo sapiens
  source 1..203: mol_type = other DNA
ggcgcgccagtcctgtgtgtatacaaccatgtttggaggagtctcatggatgattagaatcctaattgggttcttagtgttgtggattggcacgaactcgaggaacacttcaatggctatgacgtgcatagctgttggaggaatcactctgtttctgggcttcacagttcaagcagacatgggttgtgcgactcggaccgatg

SEQ ID NO: 6015 - DNA, 203 bp, Homo sapiens
  source 1..203: mol_type = other DNA
ggcgcgccagtcctcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtcgactcggaccgatg

SEQ ID NO: 6016 - DNA, 203 bp, Homo sapiens
  source 1..203: mol_type = other DNA
ggcgcgccagtcctgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgccgactcggaccgatg

SEQ ID NO: 6017 - DNA, 203 bp, Homo sapiens
  source 1..203: mol_type = other DNA
ggcgcgccagtcctgacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcacgactcggaccgatg

SEQ ID NO: 6018 - DNA, 203 bp, Homo sapiens
  source 1..203: mol_type = other DNA
ggcgcgccagtccttgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccaccgactcggaccgatg

SEQ ID NO: 6019 - DNA, 203 bp, Homo sapiens
  source 1..203: mol_type = other DNA
ggcgcgccagtcctcaggagccctgtgggacgtcccctcacccgctgccactaaaaaagccgcactgtctgaaggagtgtacaggatcatgcaaagagggttattcgggaaaactcaggttggagtagggatacacatggaaggtgtatttcacacaatgtggcatgtaacaagaggatcagtgatctcgactcggaccgatg

SEQ ID NO: 6020 - DNA, 203 bp, Homo sapiens
  source 1..203: mol_type = other DNA
ggcgcgccagtcctaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccgactcggaccgatg

SEQ ID NO: 6021 - DNA, 203 bp, Homo sapiens
  source 1..203: mol_type = other DNA
ggcgcgccagtcctcttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgcgactcggaccgatg

SEQ ID NO: 6022 - DNA, 203 bp, Homo sapiens
  source 1..203: mol_type = other DNA
ggcgcgccagtccttgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaacgactcggaccgatg

SEQ ID NO: 6023 - DNA, 203 bp, Homo sapiens
  source 1..203: mol_type = other DNA
ggcgcgccagtcctccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatcgactcggaccgatg

SEQ ID NO: 6024 - DNA, 203 bp, Homo sapiens
  source 1..203: mol_type = other DNA
ggcgcgccagtcctacggggtggtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattcgactcggaccgatg

SEQ ID NO: 6025 - DNA, 203 bp, Homo sapiens
  source 1..203: mol_type = other DNA
ggcgcgccagtcctggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagcgactcggaccgatg

SEQ ID NO: 6026 - DNA, 203 bp, Homo sapiens
  source 1..203: mol_type = other DNA
ggcgcgccagtcctcggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagcgactcggaccgatg

SEQ ID NO: 6027 - DNA, 203 bp, Homo sapiens
  source 1..203: mol_type = other DNA
ggcgcgccagtccttaccaacaacaaacaccaaaggctattgaagtcaggccacttgtgccacggtttgagcaaaccgtgctgcctgtagctccgccaataatgggaggcgtaataatccccagggaggccatgcgccacggaagctgtacgcgtggcatattggactagcggttagaggagacccctcgactcggaccgatg

SEQ ID NO: 6028 - DNA, 203 bp, Homo sapiens
  source 1..203: mol_type = other DNA
ggcgcgccagtcctattttctgaccgtccttttatgcttcatgggtggttggttttttccaattcaaattaccttttggaggaatttgatgttgtcttcggtaagagaggtggtggtaatgtgacatacactgaccagtatctctgtggcgccgatggcaaacctgttatgagtgaagatttatggcacgactcggaccgatg

SEQ ID NO: 6029 - DNA, 203 bp, Homo sapiens
  source 1..203: mol_type = other DNA
ggcgcgccagtcctgtttgttgaccatttcggtgagaacgaagaaattatcatcaatggtcatacttacgtttgtgcttggcttactaagcgtaagcccttagattacaaacgtcagaacaaccttgccattgaagagattgaatatgtgcatggtgatgctttgcatacactacgcaatggttctgtcgactcggaccgatg

SEQ ID NO: 6030 - DNA, 203 bp, Homo sapiens
  source 1..203: mol_type = other DNA
ggcgcgccagtccttattgaaggtgtctctgtttggagagtgattgctcttcagagtgtggattgctttgttgcttcttccacttttgtagaagaggaacatgttaatagaatggatacattctgcttcaatgtacgcaatagtgttactgatgagtgtcgtctggccatgttgggtgctgaaatgaccgactcggaccgatg

SEQ ID NO: 6031 - DNA, 203 bp, Homo sapiens
  source 1..203: mol_type = other DNA
ggcgcgccagtccttagtaatgtcagaagacaagttgcttcaggtgtcatagacattagtaccggttggtttgatgtttatgatgacatctttgctgaaagcaaaccatggtttgttcgcaaggctgaagacatttttggcccttgttggtccgctcttgcttctgcacttaaacaacttaaagtcaccgactcggaccgatg

SEQ ID NO: 6032 - DNA, 203 bp, Homo sapiens
  source 1..203: mol_type = other DNA
ggcgcgccagtccttacaggtgaacttgtgagatttgttaagtctatttgcaattcagctgttgctgtcgtgggtggtactatacaaattctcgctagtgtgcctgagaagtttttgaatgcgtttgacgtgtttgtcacagctattcaaactgtctttgactgtgctgttgaaacttgtactattgccgactcggaccgatg

SEQ ID NO: 6033 - DNA, 203 bp, Homo sapiens
  source 1..203: mol_type = other DNA
ggcgcgccagtcctgagagactatgttgacaaatgggatgatttttgcagacaatatagtaacgagtcttggtttgaggatgattacagggcttttatcagtgttttggacatcactgatgctgctgtgaaagctgcagagtctaaagctttcgttgatactattgttccaccttgcccatctattttcgactcggaccgatg

SEQ ID NO: 6034 - DNA, 203 bp, Homo sapiens
  source 1..203: mol_type = other DNA
ggcgcgccagtcctagacactgtggtttctactgttaaaattggtggcttgacctttaaaacatatgcttttgataaaccttacattgtgatacgtgatatcgtgtgtaaggttgaaaataaaacagaagcagaatggattgagctttttccacataatgacaggattaagtcttttagtactttcgacgactcggaccgatg

SEQ ID NO: 6035 - DNA, 203 bp, Homo sapiens
  source 1..203: mol_type = other DNA
ggcgcgccagtcctgagtgcttacatgccaattgcagaccctacacattttgacattgaagaagttgaacttttagatgcagagtttgtagaaccaggctgtggtggtattttggcagtaatagatgagcacgtcttttataagaaggatggtgtttattatccatcaaatggtactaacattctacccgactcggaccgatg

SEQ ID NO: 6036 - DNA, 203 bp, Homo sapiens
  source 1..203: mol_type = other DNA
ggcgcgccagtccttgctgaggatgttgttgaccaagttgaagaagtcaatagcatttttgacattgagacagtggatgttaaacatgatgtgagtccttttgaaatgccatttgaagagttaaatggtttaaagatactcaaacaattggataacaactgctgggttaactcagttatgttacaaatcgactcggaccgatg

SEQ ID NO: 6037 - DNA, 203 bp, Homo sapiens
  source 1..203: mol_type = other DNA
ggcgcgccagtcctctttacagaagacttgttgtgtgtcgctgatgacaaacccattgttttgtttactgactctatgcttactttggatgaccgtggtttagctctagacaatgcacttagtggtgtgcttagtgctgctattaaggattgtgttgacataaataaagctataccttctggtaatctcgactcggaccgatg

SEQ ID NO: 6038 - DNA, 203 bp, Homo sapiens
  source 1..203: mol_type = other DNA
ggcgcgccagtccttattaagtttgatataggttctgttgttgtctacatgtgtgttgtgccatccgaaaaggacaaacatttagataataatgttcaacgatgcacacgtaagttgaatagacttatgtgtgatatagtttgtactataccagctgactacatcttgccattggtgttgtctagtttcgactcggaccgatg

SEQ ID NO: 6039 - DNA, 203 bp, Homo sapiens
  source 1..203: mol_type = other DNA
ggcgcgccagtcctttgggtgaatgctgtttgtattgcactacagtattcgaaaccccattttatttcacaaggtcttgatgctgcgtggaataaatttgttttaggcgatgttgaaatttttgttgcatttgtttactatgttgcaagactaatgaaaggtgacaagggtgatgctgaagacactttcgactcggaccgatg

SEQ ID NO: 6040 - DNA, 203 bp, Homo sapiens
  source 1..203: mol_type = other DNA
ggcgcgccagtccttaagtactattcacgtgttagaagtgttagaggtagagctattatagtcagtgtcgaacagcttgaaccgtgtgctcagtctagacttttgagtggtgttgcttatactgctttttctggacctgttgacaaaggtcattatactgtttatgatactgcaaagaaatcaatgtacgactcggaccgatg

SEQ ID NO: 6041 - DNA, 203 bp, Homo sapiens
  source 1..203: mol_type = other DNA
ggcgcgccagtcctgcttgctaagtttacgaaactactgttactcatatatacattgtactcagtagttttgctttgtgtacgttttggaccgtttaatttttgtagtgagactgttaatggttatgctaagtcaaactttgtcaaggatgattactgtgatggttcattgggctgcaagatgtgtctcgactcggaccgatg

SEQ ID NO: 6042 - DNA, 203 bp, Homo sapiens
  source 1..203: mol_type = other DNA
ggcgcgccagtcctttttggttaccaagagttaagtcaatttagccatttggatgttgtgtggaagcatataacagaccctttgtttagtaatatgcaacctttcattgtcatggttttgctgcttatatttggtgacaattatttgagatgcttcttgctgtattttgttgctcagatgataagcaccgactcggaccgatg

SEQ ID NO: 6043 - DNA, 203 bp, Homo sapiens
  source 1..203: mol_type = other DNA
ggcgcgccagtccttagacttaagagattccctgttaacacaattgtcaatggtgtgcaacgttcattttatgttaatgcaaatggtggtagtaagttttgtaagaaacatagatttttctgtgttgattgtgactcttatggttatggcagcacgtttataacacccgaagtttctagagaacttggcgactcggaccgatg

SEQ ID NO: 6044 - DNA, 203 bp, Homo sapiens
  source 1..203: mol_type = other DNA
ggcgcgccagtcctttgtactagattagaaggtttgggtggtaacaatgtttattgttataacacagcgcttatggaaggttctttgccttacagttcaatacaagctaatgcatattataaatatgacaatggcaattttattaagttgccagaagttattgcacaaggctttggttttagaacagtcgactcggaccgatg

SEQ ID NO: 6045 - DNA, 203 bp, Homo sapiens
  source 1..203: mol_type = other DNA
ggcgcgccagtcctctatagtggtaatgcaaatgaagctgattaccgttgcgcttgttatgcctatttagcaaaagcaatgttggacttttcgcgtgatcataatgacatcttgtacacacctccgactgtcagttatggttctacattacaggctggtttgcgcaaaatggcacaaccatctggcttcgactcggaccgatg

SEQ ID NO: 6046 - DNA, 203 bp, Homo sapiens
  source 1..203: mol_type = other DNA
ggcgcgccagtcctcatgagaactaattggactatccgtggttcatttattaatggtgcgtgtggttcccctggctacaatcttaaaaatggcgaggtggaatttgtttatatgcatcaaattgaactcggaagtggtagccatgtaggttctagctttgatggtgttatgtatggtggttttgaagacgactcggaccgatg

SEQ ID NO: 6047 - DNA, 203 bp, Homo sapiens
  source 1..203: mol_type = other DNA
ggcgcgccagtcctacataaggttttgtttttgcaagtgtttttgttgccttcaattattgtggctgctattcaaaactgtgcttgggactaccatgttacaaaggtgttggcagagaagtttgattataatgtttctgttatgcaaatggacatccagggttttgttaacatttttatttgtcttttcgactcggaccgatg

SEQ ID NO: 6048 - DNA, 203 bp, Homo sapiens
  source 1..203: mol_type = other DNA
ggcgcgccagtccttgttgcactgttgcatacttggcgctttgctaaagagcgttgtacacattggtgcacttatttgttctcactcattgctgttttatacactgcattgtatagttatgactacgttagtttgctggttatgctactttgtgcaatttctaatgaatggtatattggtgctattatcgactcggaccgatg

SEQ ID NO: 6049 - DNA, 203 bp, Homo sapiens
  source 1..203: mol_type = other DNA
ggcgcgccagtcctcgttctaatgggcattttgtctaacatgaacatagcttctaattcaaaggagtgggcatattgtgttgaaatgcacaataaaataaacttgtgtgacgaccctgaaactgctcaagagttattgctggcgttgttggcctttttcttgtctaagcatagtgattttggtcttggcgactcggaccgatg

SEQ ID NO: 6050 - DNA, 203 bp, Homo sapiens
  source 1..203: mol_type = other DNA
ggcgcgccagtccttagtgaaggtaatgctctatacaacaatgaaggtggacgtgcattcatgtatgcatatgtgactacgaagcctggcatgaagtatgttaaatgggaacatgactctggtgtggttacagttgaattggaaccaccttgcagatttgttatagacacacctactggaccccaaatcgactcggaccgatg

SEQ ID NO: 6051 - DNA, 203 bp, Homo sapiens
  source 1..203: mol_type = other DNA
ggcgcgccagtccttaagtatctttattttgttaagaatcttaacaatttaaggagaggtgctgttttgggttacattggtgccactgtgagattgcaagctggcaaacagactgagtttgtttcaaactcccatttattaacacattgttcttttgctgttgacccagctgcagcctatcttgatgccgactcggaccgatg

SEQ ID NO: 6052 - DNA, 203 bp, Homo sapiens
  source 1..203: mol_type = other DNA
ggcgcgccagtccttgttaaacaaggcgcaaaacctgttggcaattgtgtaaagatgttgactaatggttctggtagcggtcaggctattacttgtaccattgattccaacactacgcaggacacatatggtggcgcgtctgtttgtatttattgcagagcacatgttgcacatccaaccatggacggcgactcggaccgatg

SEQ ID NO: 6053 - DNA, 203 bp, Homo sapiens
  source 1..203: mol_type = other DNA
ggcgcgccagtccttgtttagctagtgagtgctttatgaaaagtgacatctttggtcaagacttcaaaacttttgatttgttgaaatatgatttcacagaacataaggaggttttgtttaacaagtactttaagtattggggacaggattatcatcctgattgtgttgattgccatgacgagatgtgtcgactcggaccgatg

SEQ ID NO: 6054 - DNA, 203 bp, Homo sapiens
  source 1..203: mol_type = other DNA
ggcgcgccagtcctgggtgggataatatgttaaagaacctgatggccgatgttgatgatcctaaattgatgggatgggactatcctaagtgtgatagagctatgccctcaatgattcgtatgttgtcggctatgatcttaggttctaagcatgtcacatgttgtacggctagtgataaattttatagacgactcggaccgatg

SEQ ID NO: 6055 - DNA, 203 bp, Homo sapiens
  source 1..203: mol_type = other DNA
ggcgcgccagtcctctaccatatccagatcctagccgtattatttctgctggtgtttttgtggatgacatcactaagactgatgctgtcattcttttggaacgctatgtttctctggctatagatgcctacccattgtctaagcatcctaaacctgagtacaggaaggtgttttacgcattgttagaccgactcggaccgatg

SEQ ID NO: 6056 - DNA, 203 bp, Homo sapiens
  source 1..203: mol_type = other DNA
ggcgcgccagtccttgggtcaaacatctcaacaagactcttaacgaaggtgttttggagtctttttctgttacacttttagatgaacatgagtctaagttttgggatgaaagcttttatgctagtatgtatgagaagtctacagtattacaagctgctggtctttgtgtagtatgtggttctcaaacacgactcggaccgatg

SEQ ID NO: 6057 - DNA, 203 bp, Homo sapiens
  source 1..203: mol_type = other DNA
ggcgcgccagtcctgttctaagatgcggtgattgtttacgcagaccgatgttgtgcactaagtgcgcctatgatcatgtgtttggcactgatcataagttcattttagctattacaccatatgtgtgtaacacatctggctgcaatgtaaatgacgttacaaaactgtatcttggaggtttgaattatcgactcggaccgatg

SEQ ID NO: 6058 - DNA, 203 bp, Homo sapiens
  source 1..203: mol_type = other DNA
ggcgcgccagtcctgagaaatattctaccatttacaagttgcacccatcatttaatgttagtgatgcttatgcaaatcttgtaccttattaccaacttattggcaaacagcgtataaccacaatacagggtcctcctggtagtggaaaatcgcattgttctattggtattggtgtgtattaccctggacgactcggaccgatg

SEQ ID NO: 6059 - DNA, 203 bp, Homo sapiens
  source 1..203: mol_type = other DNA
ggcgcgccagtcctgaaccaattgactataatgttgtgacacaacgtatgtgtgctataggacccgatgtctttttacacaagtgttacagatgtcctgctgaaatagttaacactgtttcagagcttgtttatgaaaacaagtttgtacctgtcaaagaagctagtaagcagtgcttcaaaatctttcgactcggaccgatg

SEQ ID NO: 6060 - DNA, 203 bp, Homo sapiens
  source 1..203: mol_type = other DNA
ggcgcgccagtcctgaacgcggtagtgttcaggtagacaatggctccagtataaataggcgtcaacttgatgttgttaagcgatttatacataaaaactccacatggagcaaggctgtgtttatctcaccttacaatagtcaaaattatgtagctgccaggcttttaggcttacaaactcagacagtgcgactcggaccgatg

SEQ ID NO: 6061 - DNA, 203 bp, Homo sapiens
  source 1..203: mol_type = other DNA
ggcgcgccagtcctgtgatttcatatatgggtttcaggtttgatgttagcatgcctggtagtcatagtttgttctgtactagagactttgccatgcgtcatgtcagaggttggttaggaatggatgtggaaggtgcacatgtcacaggtgacaatgttggcactaatgtacctctacaagttggttttcgactcggaccgatg

SEQ ID NO: 6062 - DNA, 203 bp, Homo sapiens
  source 1..203: mol_type = other DNA
ggcgcgccagtcctgttaagaatgtggattggtcaattacctaccctatgatagctaatgaaaatgccataaacaagggcggtcgcactgtgcagagtcatattatgcgtgctgctattaaattgtacaaccctaaagcaatccatgacattggtaatcctaagggtattcgttgtgctgtaactgatcgactcggaccgatg

SEQ ID NO: 6063 - DNA, 203 bp, Homo sapiens
  source 1..203: mol_type = other DNA
ggcgcgccagtcctcaaggtttagagaacattgcttttaacgttgttaataaaggttcatttgttggtgctgatggtgaattaccagtagccattagtggtgataaagtgttcgtacgtgatggtaacactgataatttagtctttgttaacaaaacatcactgcctacaaacatagcatttgaacttcgactcggaccgatg

SEQ ID NO: 6064 - DNA, 203 bp, Homo sapiens
  source 1..203: mol_type = other DNA
ggcgcgccagtccttctaagactgtttgtacttacatggatttgttgttggatgattttgtttctgtattgaagtctttggatttgactgttgtatccaaggttcatgaggtcataattgacaacaaaccatggagatggatgctatggtgtaaagataatgccgttgctacattctatcctcagttgcgactcggaccgatg

SEQ ID NO: 6065 - DNA, 203 bp, Homo sapiens
  source 1..203: mol_type = other DNA
ggcgcgccagtcctagctggaataagaaattgtatgaacttgtacaaagattttctttttggactatgttttgcacttctgttaatacgtcatcatcagaagcctttgttgtcggaattaactatcttggtgatttcgcacaaggaccttttatagatggtaacataatacacgcaaattatgtatttcgactcggaccgatg

SEQ ID NO: 6066 - DNA, 203 bp, Homo sapiens
  source 1..203: mol_type = other DNA
ggcgcgccagtcctttgagttttagtaatcatttagtctcaactaaataaaatgtttgttttgcttgttgcatatgccttgttgcatattgctggttgtcaaactacaaatgggctgaacactagttactctgtttgcaacggctgtgttggttattcagaaaatgtatttgctgttgagagtggtggcgactcggaccgatg

SEQ ID NO: 6067 - DNA, 203 bp, Homo sapiens
  source 1..203: mol_type = other DNA
ggcgcgccagtcctaagccctattcaatccgttgagctacctgtgtctattgtgtcgctacctgtttatcataaacatacgtttattgtgttgtacgttgacttcaaacctcagagtggcggtggcaagtgctttaactgttatcctgctggtgttaatattacactggccaattttaatgaaactaacgactcggaccgatg

SEQ ID NO: 6068 - DNA, 203 bp, Homo sapiens
  source 1..203: mol_type = other DNA
ggcgcgccagtcctagggcctttgtgtgttgacacatcacacttcactaccaaatacgttgctgtttatgccaatgttggtaggtggagtgctagtattaacacgggaaattgccctttttcttttggcaaagttaataactttgttaaatttggcagtgtatgtttttcgctaaaggatatacccggcgactcggaccgatg

SEQ ID NO: 6069 - DNA, 203 bp, Homo sapiens
  source 1..203: mol_type = other DNA
ggcgcgccagtccttacttctgcttgtaaaactattgaagacgccttaagaaatagcgccaggctggagtctgcagatgttagtgagatgctcacttttgacaagaaagcgtttacacttgctaatgttagtagttttggtgactacaaccttagcagcgtcatacctagcttgcccacaagtggtagcgactcggaccgatg

SEQ ID NO: 6070 - DNA, 203 bp, Homo sapiens
  source 1..203: mol_type = other DNA
ggcgcgccagtccttagagtggctggtcgcagtgccatagaagacatactttttagcaaacttgttacttctggacttggcactgtggacgcagactacaaaaagtgcactaagggtctttccattgctgacttggcttgtgctcaatattataatggcattatggttttgcctggcgtcgctgatgccgactcggaccgatg

SEQ ID NO: 6071 - DNA, 203 bp, Homo sapiens
  source 1..203: mol_type = other DNA
ggcgcgccagtcctagcaatgaccaacatagtagatgcctttactggtgttaatgatgctattacacaaacttcacaagccctacaaacagttgctactgcacttaacaagatccaggatgttgttaatcaacaaggcaactcattgaaccatttaacttctcagttgaggcagaattttcaagctatcgactcggaccgatg

SEQ ID NO: 6072 - DNA, 203 bp, Homo sapiens
  source 1..203: mol_type = other DNA
ggcgcgccagtccttgtgttgcgacaacctaatcttgctctttacaaagaaggcaattattatagaatcacatctcgcataatgtttgaaccacgtattcctaccatggcagattttgttcaaattgaaaattgcaatgtcacatttgttaacatttctcgctctgagttgcaaaccattgtgccagacgactcggaccgatg

SEQ ID NO: 6073 - DNA, 203 bp, Homo sapiens
  source 1..203: mol_type = other DNA
ggcgcgccagtccttttgtaatagaacagtttatggccccattaaaaatgtgtaccacatttaccaatcatatatgcacatagaccctttccctaaacgagttattgatttctaaactaaacgacaatgtcaaatgacaattgtacgggtgacattgtcacccatttgaagaattggaattttggttgcgactcggaccgatg

SEQ ID NO: 6074 - DNA, 203 bp, Homo sapiens
  source 1..203: mol_type = other DNA
ggcgcgccagtcctgaatgttattctaaccatattcattgttattcttcagtttggacactataaatactccagattgttttatggtttgaagatgcttgtactgtggcttctttggccactcgtacttgctttgtcaatctttgacacctgggctaattgggattctaattgggcctttgttgcattcgactcggaccgatg

SEQ ID NO: 6075 - DNA, 203 bp, Homo sapiens
  source 1..203: mol_type = other DNA
ggcgcgccagtccttagcttttttatggccgtatcaacactcgttatgtgggtgatgtacttcgcaaacagtttcagacttttccgacgtgctcgaactttttgggcatggaatcctgaggttaatgcaatcactgtcacaaccgtgttgggacagacatactatcaacccattcaacaagctccaaccgactcggaccgatg

SEQ ID NO: 6076 - DNA, 203 bp, Homo sapiens
  source 1..203: mol_type = other DNA
ggcgcgccagtcctcaggcaacactgtggtcttgactttcactactagagtgactgtgcccaaagaccatccacacttgggtaagtttcttgaggagttaaatgcattcactagagaaatgcaacaacatcctcttcttaaccctagtgcactagaattcaacccatctcaaacttcacctgcaactgcgactcggaccgatg

SEQ ID NO: 6077 - DNA, 203 bp, Homo sapiens
  source 1..203: mol_type = other DNA
ggcgcgccagtcctagcgcagttttgcgaggtgaccaaaaggataggtagggtgacaggtagtgacggaaagctttaccatatatatgtgtgcatcgatggttgcatactgctgaagctagccaagagggacgagccaagaaccctgaagtggattagaaatttcaccgactgtccattgtgggttaccgactcggaccgatg

SEQ ID NO: 6078 - DNA, 203 bp, Homo sapiens
  source 1..203: mol_type = other DNA
ggcgcgccagtcctcagttgctctgatgatggcgcaagtggaagtaaagagaagaagccagataggatcaacaaaggcaaattaaaaatagccccaaaagagcatgagaaggacagcagaactaagccacctgacgctacgattgtagtggaaggagtaaaataccaggttaaaaagaagggtaaagtcgactcggaccgatg

SEQ ID NO: 6079 - DNA, 203 bp, Homo sapiens
  source 1..203: mol_type = other DNA
ggcgcgccagtccttaaaggaaagagtacccaagacggcctgtaccacaacaagaataaaccaccagaatctaggaagaaattagaaaaagccctattggcatgggcggtaatagcaattatgttgtaccaaccagttgaagccgaaaatataactcaatggaacctgagtgacaacggcactaatggcgactcggaccgatg

SEQ ID NO: 6080 - DNA, 203 bp, Homo sapiens
  source 1..203: mol_type = other DNA
ggcgcgccagtccttatccagcatgctatgtaccttagaggggttagcaggagcttgcatgggatctggccggaaaaaatatgcaaaggagtccccacctacctggccacagacacggaactgaaagaaatacagggaatgatggatgccagcgaggggacaaactatacgtgctgtaagttacagagcgactcggaccgatg

SEQ ID NO: 6081 - DNA, 203 bp, Homo sapiens
  source 1..203: mol_type = other DNA
ggcgcgccagtccttttgttatttgaagaggcaggacaggtcgtaaaattagccttacgagcgctgagggatttaaccagggtctggaatagcgcatcaaccacggcattcctcatctgcttgataaaagtattaagaggacagatcgtgcaaggtgtgatatggctgctactagtaactggggcacacgactcggaccgatg

SEQ ID NO: 6082 - DNA, 203 bp, Homo sapiens
  source 1..203: mol_type = other DNA
ggcgcgccagtcctaaatggagatttattctactgtaagttggggggcaactggacatgtgtgaaaggtgaaccagtggtctacacgggggggctagtaaaacaatgcagatggtgtggcttcgacttcaatgagcccgacggactcccgcactaccccataggtaagtgcatcttggtaaatgagaccgactcggaccgatg

SEQ ID NO: 6083 - DNA, 203 bp, Homo sapiens
  source 1..203: mol_type = other DNA
ggcgcgccagtcctaggttacagaatagtagattcaacggactgtaacagagatggcgttgtaatcagcacagatgggagtcatgagtgcttgatcggtaacacaactgtcaaggtgcatgcatcagatgaaagactgggccctatgccatgcagacccaaagagattgtctctagtgcaggacctgtcgactcggaccgatg

SEQ ID NO: 6084 - DNA, 203 bp, Homo sapiens
  source 1..203: mol_type = other DNA
ggcgcgccagtcctggtagcactgttaggaggaagatatgtcctgtggctaatagtgacctacatagttctaacagaacaactcgccgctggtttaccattgggccagggtgaggtagtgttgatagggaacttaattacccacacagacattgaggtcgtagtatatttcttactactctatttggtcgactcggaccgatg

SEQ ID NO: 6085 - DNA, 203 bp, Homo sapiens
  source 1..203: mol_type = other DNA
ggcgcgccagtcctgaccaacttcaagagggtaaacgacatatacgaagttgaccaatctggtgaaggggtttaccttttcccgtcaaaacaaaagacaagttcaataacaggtaccatgttgccattgatcaaagccatactcatcagctgcatcagtaataagtggcagttcatatatctattgtacgactcggaccgatg

SEQ ID NO: 6086 - DNA, 203 bp, Homo sapiens
  source 1..203: mol_type = other DNA
ggcgcgccagtcctaagggtcgtttgccaatcaaataataagatgacagatgagtctgagtatggagttaaaactgactccggatgcccggaaggagctaggtgttatgtgttcaacccagaggcagttaacatatcagggactaaaggagccatggtccacttacaaaaaactggaggagaattcaccgactcggaccgatg

SEQ ID NO: 6087 - DNA, 203 bp, Homo sapiens
  source 1..203: mol_type = other DNA
ggcgcgccagtcctctttagagagatgaactatgattggagcctttatgaggaggacagtctgatgattacacaattggaaatcctcaataatttgttgatatcagaagaactaccgatggcagtaaaaaatataatggccaggactgaccacccagaaccaattcagctggcgtacaacagctacgacgactcggaccgatg

SEQ ID NO: 6088 - DNA, 203 bp, Homo sapiens
  source 1..203: mol_type = other DNA
ggcgcgccagtcctaacacaagtgccagtgctattcccaaaaataaagaatggagaggtgactgatagttacgataactataccttcctcaacgcaagaaaattgggggatgatgtacccccttacgtgtatgccacagaggatgaggacttagcggtagagctactgggcttagactggccagaccccgactcggaccgatg

SEQ ID NO: 6089 - DNA, 203 bp, Homo sapiens
  source 1..203: mol_type = other DNA
ggcgcgccagtcctagacaccacacacctacagtacgccccaaatgctatcaagacggaggggaaggagacagaattgaaggagctagcccagggggatgtgcagagatgtgtggaagctatgaccaattatgcaagagagggtatccaattcatgaagtctcaggcactgaaggtgaaagaaacccccgactcggaccgatg

SEQ ID NO: 6090 - DNA, 203 bp, Homo sapiens
  source 1..203: mol_type = other DNA
ggcgcgccagtcctatacaaaagctggaattacaataatctgtccaagatagttgaaccggctttggccactctgccctatgccgccacagctctcaaactattcgcccccactcgattggagagcgttgtcatattgagtaccgcaatctacaagacctacctatcaatcaggcgcggaaaaagcgacgactcggaccgatg

SEQ ID NO: 6091 - DNA, 203 bp, Homo sapiens
  source 1..203: mol_type = other DNA
ggcgcgccagtcctgaactacagggtgacaaaatactatgatgacaatctatcagaaataaagccagtgataagaatggaagggcatgtggaactctactacaagggagccaccatcaaactggacttcaacaacagtaaaacaatactggcaaccgataaatgggagattgatcactccactctggtcgactcggaccgatg

SEQ ID NO: 6092 - DNA, 203 bp, Homo sapiens
  source 1..203: mol_type = other DNA
ggcgcgccagtcctttgggtgatgcaagaagaaaataaacagggcaacctgacccccttgtttgaagagctcctgcaacagtgtccacccggaggccagaacaaaactgcacatatggtctctgcttaccaactagctcaagggaactggatgccaaccagctgccatgtttttatggggaccatatccgactcggaccgatg

SEQ ID NO: 6093 - DNA, 203 bp, Homo sapiens
  source 1..203: mol_type = other DNA
ggcgcgccagtcctggattcagagaaaaacaaagtcgaagagattattgacaatctgaaaaaaggcagaaacatcaaatactatgaaaccgcgatcccaaagaatgagaagagggacgtcaatgatgactggactgctggtgacttcgtggaagagaagaaacccagagtcatacaataccctgaagccgactcggaccgatg

SEQ ID NO: 6094 - DNA, 203 bp, Homo sapiens
  source 1..203: mol_type = other DNA
ggcgcgccagtcctcacccaggtaaccacaaaagatttggagttgataaaggacatacaaaagtactatttcaagaagaaatggcataaatttattgacaccctgaccatgcacatgtcagaagtacccgtaatcagtgctgatggggaagtatacataaggaaagggcaaagaggcagtggacaacccgactcggaccgatg

SEQ ID NO: 6095 - DNA, 203 bp, Homo sapiens
  source 1..203: mol_type = other DNA
ggcgcgccagtccttaaaatggccacaaggttagattccagtggtgagaggggtaccatagcatatgagaaagcagtagcattcagcttcctgctgatgtactcctggaacccactaatcagaaggatctgcttactggtgctatcaactgaactgcaagtgaaaccagggaagtcaaccacttactacgactcggaccgatg

SEQ ID NO: 6096 - DNA, 203 bp, Homo sapiens
  source 1..203: mol_type = other DNA
ggcgcgccagtccttaaatacgtccaacaaaagagagtcaatccgttctttgctctaactcagcaatggctaacagaaatgaggaatctgctctcccagagtctatcagtaaggaagttcatggttgagatcctcatagaagtcaagaaaggaggatctgctaaaggcagagcagtagaaataatctccgactcggaccgatg

SEQ ID NO: 6097 - DNA, 203 bp, Homo sapiens
  source 1..203: mol_type = other DNA
ggcgcgccagtcctccatgctggaggaattgatcagaacatggcaaatagactgggactaagttcagatcaagttgcagaactcgctgctgcagttcaggaaacatcagcaggaaggcaagagagtaatgttcaggctagagaggcaaaatttgctgcaggaggtgtgctcattggaggcagtgatcacgactcggaccgatg

SEQ ID NO: 6098 - DNA, 203 bp, Homo sapiens
  source 1..203: mol_type = other DNA
ggcgcgccagtcctagatatcgatgaaggggaagaacctatagaacagagtggcagacagtcagttaccttcaaaagggagatgagtatttcatcccttgctaacagtgtgccgagcagttctgtgagcacatccggtgggaccagattgactaattcattactaaacctcagatcaagactggctgccgactcggaccgatg

SEQ ID NO: 6099 - DNA, 203 bp, Homo sapiens
  source 1..203: mol_type = other DNA
ggcgcgccagtcctaaaagcagcaaaagaagccgcctcatccaatgcaacagatgatccagcaatcagcaacagaactcaaggggaatcagagaagaagaataatcaagacctcaaacctgctcaaaatgaccttgatttcgtcagagctgatgtgtgacgtctatttccaatattctacagtatccacgactcggaccgatg

SEQ ID NO: 6100 - DNA, 203 bp, Homo sapiens
  source 1..203: mol_type = other DNA
ggcgcgccagtccttaatttaactaagctactgtctttgcactggaatatacaatacctcttacctcatttcttactttaatatcatgttatttttttgataagtcacttaacttgaccaaggtctaccaggtaatgctcgcacaagtgaactgcaatctcaacttagattaaacataatcatgcaaacgactcggaccgatg

SEQ ID NO: 6101 - DNA, 203 bp, Homo sapiens
  source 1..203: mol_type = other DNA
ggcgcgccagtcctgactgaatcccacagcagtaccgttcactctgagaaacctgtctgatcctgcaaaagactctcctgtgattgctgaacactactacggactaggagttaaagagcaaaacgttggccctcagactagcagaaatgtcaatttggacagcatcaaattgtacacatcagatgacgcgactcggaccgatg

SEQ ID NO: 6102 - DNA, 203 bp, Homo sapiens
  source 1..203: mol_type = other DNA
ggcgcgccagtcctacaaatcaacagatgtaccaggagcaggaccgaaagattcagcagtgaaggaagaaccaccccagaagaggctacctatgttagctgaagaatttgagtgctctggatcggaagacccaatcattcgggagctgctgaaggagaactcactcataaattgtcagcaagggaaagcgactcggaccgatg

SEQ ID NO: 6103 - DNA, 203 bp, Homo sapiens
  source 1..203: mol_type = other DNA
ggcgcgccagtcctatgctcagcctccatatcattggagcatcgagaggtcaataagcccggataaaactgagatcgtcaacggtgctgtgcaaactgctgacaggcaaagaccaggaactccgatgccaaagtcccgaggtattcccattaaaaagggcacagacgcgaaatatccatctgctgggacgactcggaccgatg

SEQ ID NO: 6104 - DNA, 203 bp, Homo sapiens
  source 1..203: mol_type = other DNA
ggcgcgccagtcctcggaaaacgtgcctgggtcgaagagtggtgcaacccggcatgttcgaggatcacccccctaccaagaaggcaagagtgtcaatgcggagaatgtccaactgaatgcttccactgcggttaaggaaactgataagtcagaagtaaaccccgtagacgacaacgactcacttgatgcgactcggaccgatg

SEQ ID NO: 6105 - DNA, 203 bp, Homo sapiens
  source 1..203: mol_type = other DNA
ggcgcgccagtcctataaatacatcatgccttcagatgatttctcaaacactttcttcccgcacgacactgatcgcttgaattatcacgcagatcatttaggtgattatgaccttgaaaccctgtgtgaagagtcggttctaatgggagtgatcaactctataaaattaattaatctggatatgcgctcgactcggaccgatg

SEQ ID NO: 6106 - DNA, 203 bp, Homo sapiens
  source 1..203: mol_type = other DNA
ggcgcgccagtcctgtaatatttgatcactgaattgtcagcagaaatacaatgatctaacaacaatctcccacaagtagacaatggtttcaggtcaataataacaacctcaatactaatctttcacataagcattactcattccagccctcagacgataacacaatacttgatacatgtttattgaagcgactcggaccgatg

SEQ ID NO: 6107 - DNA, 203 bp, Homo sapiens
  source 1..203: mol_type = other DNA
ggcgcgccagtccttggtaagagtgcctctcatccccaagatcttctggaggaactctgttccctcaaagttactgtgagaagaacagctggatcaactgagaaaattgtgtttggatcatctggccctctaaatcacctcgttccgtggaagaaagtactgactagtggttcaatttttaatgcagtcgactcggaccgatg

SEQ ID NO: 6108 - DNA, 203 bp, Homo sapiens
  source 1..203: mol_type = other DNA
ggcgcgccagtcctcataggcggactaagtctccacattaagatcaatggtgtaatcagcaaacggctgtttgctcaaatgggattccaaaaaaacctttgtttctctttgatggacatcaatccttggctcaacagattgacctggaacaacagttgtgagatcagccgagtagcagctgtgttgcacgactcggaccgatg

SEQ ID NO: 6109 - DNA, 203 bp, Homo sapiens
  source 1..203: mol_type = other DNA
ggcgcgccagtcctaagacccagtttctaattcaatgactatacaggctatatctcaggcattcggtggaaattatgaaacactgctaagaacattgggttacgctacagaagactttgatgatcttctagaaagtgacagcataacaggtcaaatcatctatgttgatctaagtagctactatataacgactcggaccgatg

SEQ ID NO: 6110 - DNA, 203 bp, Homo sapiens
  source 1..203: mol_type = other DNA
ggcgcgccagtcctcacaaaaaacaataactaattgttttctcttgaagaataagatttggtgcatatcattggttgagatatatgacacaggagacaatgtcataagacccaaactattcgcggttaagataccagagcaatgtacataaaaatcaacctcataatttaatggattgatctaatatacgactcggaccgatg

SEQ ID NO: 6111 - DNA, 203 bp, Homo sapiens
  source 1..203: mol_type = other DNA
ggcgcgccagtccttacacatgcgagacaaaagtactgaaataatcctaaatccgaatcttatctgcattttcaaatcagacaaaactggaaagaagtgttattatcttacacccgaaatggttctaatgtattgtgatgtcctagagggaaggatgatgatggagacaacagtcaaatcggatatcacgactcggaccgatg

SEQ ID NO: 6112 - DNA, 203 bp, Homo sapiens
  source 1..203: mol_type = other DNA
ggcgcgccagtcctgcataaaggaaatgcatcaagaattgagtgagtgtggttttacagatcagaagattcggtctatgtttattgatgatcttttatccattctaaatatcgataatatacatctgttggcagagttcttttctttctttcgtacgtttggccatcctattcttgaggctaaagttgcgactcggaccgatg

SEQ ID NO: 6113 - DNA, 203 bp, Homo sapiens
  source 1..203: mol_type = other DNA
ggcgcgccagtcctctgcagaaaaagtgagagaacatatgttggcagataaagttcttgaatatgcccctataatgaaagcacatgctatattctgcgggactataataaatgggtatagggatagacacggaggagcctggcctcctctttacctccccgcacatgcatctaaacatataatccgttcgactcggaccgatg

SEQ ID NO: 6114 - DNA, 203 bp, Homo sapiens
  source 1..203: mol_type = other DNA
ggcgcgccagtcctgtgaagtgttgagctataccccaccgaagtcaaccgagccaagaagattggttgacgtttttgtaaatgatgaaaactttgatccatacaacatgctggaatatgtcttatccggtgcttatctcgaggatgaacaattcaatgtttcttatagcttgaaggagaaagagacgacgactcggaccgatg

SEQ ID NO: 6115 - DNA, 203 bp, Homo sapiens
  source 1..203: mol_type = other DNA
ggcgcgccagtcctagcaagctggacgattgttcgcaaagatgacctacaaaatgcgtgcatgtcaagtcatagcagaggccctgatagcctcaggtgtcggtaaatattttaaggagaacgggatggttaaggatgagcacgaacttttgaagacactcttccaattgtctatttcctcagttcctccgactcggaccgatg

SEQ ID NO: 6116 - DNA, 203 bp, Homo sapiens
  source 1..203: mol_type = other DNA
ggcgcgccagtcctctgatcttaagaaattctgtctcaattggagatacgaatcaatggctatatttgctgaacgtctggatgagatatacggtttacctggattttttaattggatgcacaaacgactagaaagatctgttatctatgttgcagaccctaattgcccccctaatattgacaaacatacgactcggaccgatg

SEQ ID NO: 6117 - DNA, 203 bp, Homo sapiens
  source 1..203: mol_type = other DNA
ggcgcgccagtcctctatcactcaaaaagttcatcctaatcttccctacaaggtaaagaaagagatctgtgcaaagcaagctcagctttattttgaaaggttaaggatgaacttaagagccctcggccacaatcttaaagctacagaaactatcatcagtacacatctttttatttattcgaagaaaacgactcggaccgatg

SEQ ID NO: 6118 - DNA, 203 bp, Homo sapiens
  source 1..203: mol_type = other DNA
ggcgcgccagtcctttcattatgatggtgctgtgctgtctcaggcactcaaatcaatgtcaagatgttgcttttggtcagagactctggtggatgaaactagatcagcttgtagtaacatcagcactacaatagctaaagctatagaaaatgggttgtcaagaaatgtcggctattgcatcaatatttcgactcggaccgatg

SEQ ID NO: 6119 - DNA, 203 bp, Homo sapiens
  source 1..203: mol_type = other DNA
ggcgcgccagtcctatataggtgatccggttacagcatctttggctgatcttaagagaatgattgatcacagtattatgactgaaagcgtattacaaaaagttatgaatcaagaacctggtgatgcgagtttcttggactgggccagtgatccatactcgggcaacttgcctgactcacaaagcatcacgactcggaccgatg

SEQ ID NO: 6120 - DNA, 203 bp, Homo sapiens
  source 1..203: mol_type = other DNA
ggcgcgccagtccttgatatcatcaaatacttgctcagttgacttggcacgagcattgagatctcacatgtggagggaattagcgttaggtagagtaatatacggtcttgaggtaccagatgcacttgaggctatggtgggaaggtatataacagggagcttagagtgccaaatttgtgagcagggaacgactcggaccgatg

SEQ ID NO: 6121 - DNA, 203 bp, Homo sapiens
  source 1..203: mol_type = other DNA
ggcgcgccagtcctacacgatgtatgggtggttctttgtacctagggattcccaattggatcaggtagatagagagcactcatcaataagagtaccttatgtaggatcaagtacggatgaaagatcggatatcaaactagggaatgtcaaaagaccaactaaggccttgcgttctgctatcagaattgcgactcggaccgatg

SEQ ID NO: 6122 - DNA, 203 bp, Homo sapiens
  source 1..203: mol_type = other DNA
ggcgcgccagtcctagtccaaatcaagagaattagactttcctttatggtcaactgaggaacttcatgatgtcctagctaagactgttgctcagaccgttcttgagattataacaaaggctgacaaggatgttttaaagcaacaccttgcaatagactctgacgataacatcaacagcttaatcacagcgactcggaccgatg

SEQ ID NO: 6123 - DNA, 203 bp, Homo sapiens
  source 1..203: mol_type = other DNA
ggcgcgccagtcctaggtgaataggaaagttgaatacccatatcacactataggagtttcaggaaatgttgttactaatacagatattgtttatacaggatatgcagacgtcttcaagtgtgaacagtgtgatttgctgatgggtgcttgggcaccaaacgacattccagcactgacgcacaatattccgactcggaccgatg

SEQ ID NO: 6124 - DNA, 203 bp, Homo sapiens
  source 1..203: mol_type = other DNA
ggcgcgccagtcctgagcatcacagtgtgtccagtttaagctccccacagaaaatttagtggcacgtaattatgtgttgttgtgtgaggaaattgagcgagaaaatattcctgtaattttccaggattatagtgaagggaatgtctttacgtgtcggattgttagtggagatctaactgctgttggtacgactcggaccgatg

SEQ ID NO: 6125 - DNA, 203 bp, Homo sapiens
  source 1..203: mol_type = other DNA
ggcgcgccagtcctcagcatccaatatgtatacagctcgagatgtagcgtctaaaaatttgttagatcagctacataacacccccaatgtgcacatgcactctctgcattccctcccgtatgagaatttcccttgtgaagctctggaatttgcagttgagcaaggtattatcccccctgtgacctttgcgactcggaccgatg

SEQ ID NO: 6126 - DNA, 203 bp, Homo sapiens
  source 1..203: mol_type = other DNA
ggcgcgccagtccttcccccggagatcaggtgaaacgctagagttggctaatgccacattgaaccatgtgaataatgtgattgaccgacacgatgaagcaataagtaatgtcaggcaaaatgttgaagtgaagttgacgggtgtgtcccgacaagttggtgctatgttgccgaaagtagaaactgctacgactcggaccgatg

SEQ ID NO: 6127 - DNA, 203 bp, Homo sapiens
  source 1..203: mol_type = other DNA
ggcgcgccagtccttatatgagtctataggaacaggcttatgcgtagcgttgtctggtatattgtcatttatagcagtcatgtgtcttggaatcactgatttatctgctgttacattcaataagctgctcacgcagtcttcattggttggacgagctttagtcggtgtgcgtagcttcaaagatgtttcgactcggaccgatg

SEQ ID NO: 6128 - DNA, 203 bp, Homo sapiens
  source 1..203: mol_type = other DNA
ggcgcgccagtccttttttggcatctgggattatgtagacaatcaagtgtgtgaaattctttacgggaagagtcgcaagaacttggatttgttgaaagaatatccgagtttggactcgttgttgtccatcttcaactactttcacgacacggtagatgctaatgtgctcattagttgtaaccgtgcagcgactcggaccgatg

SEQ ID NO: 6129 - DNA, 203 bp, Homo sapiens
  source 1..203: mol_type = other DNA
ggcgcgccagtccttagcttatgatgatgtattgcagatagtggattcggcccaaaagccaaatcctgagttattcgaatttattaggttgaacaacagtgatccatatcaagtacatatgtccagtgtcagggataaggcaaatacattcatagcaccatcttttgtttttgcaacctcaaacgtaacgactcggaccgatg

SEQ ID NO: 6130 - DNA, 203 bp, Homo sapiens
  source 1..203: mol_type = other DNA
ggcgcgccagtcctatccaggcgcgtatgtccccaagtctattcatagtgcagatgcattcagacggcgtttagatctatgcgtttatgtagatgttaaagatgagtttgcacgcatcgtagctggatctaagggtcatcgtaaggtcccttgtgaacagaagatatggctccatcagaatccaggaacgactcggaccgatg

SEQ ID NO: 6131 - DNA, 203 bp, Homo sapiens
  source 1..203: mol_type = other DNA
ggcgcgccagtcctagacgcagcaagacatgaagcaggaaattattgcaggaacatacaagatcactccggagacagctgtgtatgagttgcatgttgacactacgttagcaggcaatgctcagtctaaagtctgtgcttatgatggtttggtgtcactaattgaacaggtgaggaaattgcgtgttgcgactcggaccgatg

SEQ ID NO: 6132 - DNA, 203 bp, Homo sapiens
  source 1..203: mol_type = other DNA
ggcgcgccagtccttggaagctcattttgtctcgcggagtgcgaacgatggaagcatgttcatcccagccagtgaggttgctgatttgttgtgtcagagacataacaatacgaatttgaatgaggaactggtgtatttgacgtggatgacgcagatcacagataaggagttagcctcgagtttagtatcgactcggaccgatg

SEQ ID NO: 6133 - DNA, 203 bp, Homo sapiens
  source 1..203: mol_type = other DNA
ggcgcgccagtcctatttcacaaataacggaatggataagtcaatttggaaacagagcgccgagcgttcagcacaggccattagtcagtgtaagaatgcttggacgcgcataaacgatttcttgaagaatcattggatttccatatctgccgttataggatcagctctcctaatagggggagtgtcgacgactcggaccgatg

SEQ ID NO: 6134 - DNA, 203 bp, Homo sapiens
  source 1..203: mol_type = other DNA
ggcgcgccagtcctcacccaatccaacaaaatctgaaattactcggagtcctatccatggatgtttccccgttcttacagcccccgctaccttgtatagcccaacagagaacttattaatcaagaacgcaatgaaagtaacaaagaatgtggagttgctggaagaagacctaattgatgcctgtgttccgactcggaccgatg

SEQ ID NO: 6135 - DNA, 203 bp, Homo sapiens
  source 1..203: mol_type = other DNA
ggcgcgccagtcctaggtgattgctggtgatttctcgaattttgatggttcattgaattctcagattttatcacgagtatctgaaattgtcactgattggtatggagatgatgcagaaaatggtctgatcagacatacactacttgagtacttgtttaatgccacctggcttatgaatggtaaggtttcgactcggaccgatg

SEQ ID NO: 6136 - DNA, 203 bp, Homo sapiens
  source 1..203: mol_type = other DNA
ggcgcgccagtccttccaactcaaccattctcagccttccggcaatccattaactactctcatcaactgtgtatataacatgatcatttttagatatgtctaccttctagctcagcgagaaaacgggtttcccatgacgctctctggatttactacaaacgtagcttgcattttctatggtgacgattcgactcggaccgatg

SEQ ID NO: 6137 - DNA, 203 bp, Homo sapiens
  source 1..203: mol_type = other DNA
ggcgcgccagtccttcgaaaactctccgaacactaggtgcagtaaggctttcatggagtggtttgctatttagcgtacgtgtaccataggcagccccaaaaacacgtgtgaggagaaagtcccagtcactttgggcaaagtagacagccgcgcttgcgtggtgggacttaattaatgcctgctaaccccgactcggaccgatg

SEQ ID NO: 6138 - DNA, 203 bp, Homo sapiens
  source 1..203: mol_type = other DNA
ggcgcgccagtcctagttgaaattgataattttgatacaacaaccagtggaggactaattccaggaggtagtgttacaaacagtgaaggttctacaatcttgatgaatgatatcccaatcactaatcagaatgtagtgctgtctaagaatgtaacagataacctgtttgaagtccaggaccaagctctcgactcggaccgatg

SEQ ID NO: 6139 - DNA, 203 bp, Homo sapiens
  source 1..203: mol_type = other DNA
ggcgcgccagtccttggcaggttgaaaaacatcaagctatatgggcatgcgccatctgtgacatcttcagtatatccgtctactcagtccggatatgatgatgattgtcccattgtgcatgcgggaactgatgaggattcttctaaacaggggattgtctcaagggttgcagacaccgttggtgcggtcgactcggaccgatg

SEQ ID NO: 6140 - DNA, 203 bp, Homo sapiens
  source 1..203: mol_type = other DNA
ggcgcgccagtccttgttggcttcgattatggcgtacccctgtctcttttccctaacaatgccattgatcccacaattgcagtgcctgaaggattggatgagatgtctattgaatacttagcacagcgaccatatatgctcaacagatacactatcagaggtggtgacactcctgatgcgcatggaaccgactcggaccgatg

SEQ ID NO: 6141 - DNA, 203 bp, Homo sapiens
  source 1..203: mol_type = other DNA
ggcgcgccagtcctcagattgctggtgcaatatctcccctatggtagtggtgttcaaccaatagaaagtatcctttcacagatcatcgacatctcacaagtcgatgataagggtattgacattgcttttccttccgtctatcccaataagtggatgcgagtgtacgatccagcgaaagttgggtacaccgactcggaccgatg

SEQ ID NO: 6142 - DNA, 203 bp, Homo sapiens
  source 1..203: mol_type = other DNA
ggcgcgccagtcctgttagtaacatgtggtagtatggcagcgattggtgaagctacggtcgcattgcaattcgtggacgagacaattgaaattctgagattagagtcagattttgagtccaaagctccagtgaaatttactccaggtaactataccgtggtcactgaagctagtgatgttgaattggtcgactcggaccgatg

SEQ ID NO: 6143 - DNA, 203 bp, Homo sapiens
  source 1..203: mol_type = other DNA
ggcgcgccagtcctatatccatccacacatgctggtctggactactccagctcagacacatctacaatgttgactacaatgggtgaacagtttgtctctctcagaatgttaactagacgttccagtcccgttgacattcttagaggcgatttggttactttgcccggaatttcctttggcacagataacgactcggaccgatg

SEQ ID NO: 6144 - DNA, 203 bp, Homo sapiens
  source 1..203: mol_type = other DNA
ggcgcgccagtcctgcattatattaacacatccctgaaccctatggctcaaattagcttgccttattatagtccagcagaaaatttagttattgattccaagtctttccctcaattaagtgatttatcaattagtaatttggaaaggacggaaaatgagtactttgtgcttgcaagtgctggtgatgacgactcggaccgatg

SEQ ID NO: 6145 - DNA, 203 bp, Homo sapiens
  source 1..203: mol_type = other DNA
ggcgcgccagtcctccacactttctctcaattggcaggatgtccagctttcacttttggacctgccgaattggcttaatttaacacccttcaggtgtagacccgtcattgtgacgcgtgggttgaggtgccatgaatttgtcattcatggtgcatttatctcaacagttttccctaaccgcgcgttgccgactcggaccgatg

SEQ ID NO: 6146 - DNA, 203 bp, Homo sapiens
  source 1..203: mol_type = other DNA
ggcgcgccagtccttatccccttgatgcaactgaggttttaacatctcattgtttttgagccccaacgccttggtggatgctcaaagaagattactcttgatgcttggctctcagaaagaatggcacctcaaagttttgagacccgattcttttgagtcgagaaccttacccccaacccttgagattgcgactcggaccgatg

SEQ ID NO: 6147 - DNA, 203 bp, Homo sapiens
  source 1..203: mol_type = other DNA
ggcgcgccagtcctcttttcttccaactaaacccctattgatgtgttggtcgtttgccaatcggagggcgacaggcgcaggtcgccccaacagctagtattgtgggaacttgccactgctgatgaaacgaggtagtggcatttagtacctgagaacgctggaggagcatctccccctcttccttcattcgactcggaccgatg

SEQ ID NO: 6148 - DNA, 203 bp, Homo sapiens
  source 1..203: mol_type = other DNA
ggcgcgccagtcctgccgagctcttcctcggtcttgttctgaatgcacacatgtctaggggctaaggatgtcctacaggtacccgcacgtaaccttcagagagtgtggatctgagtaggagactgtggtgcgctgctttacagacgtagcccagtttaaaaaacgtctatgcccctacagggtcgcggcgactcggaccgatg

SEQ ID NO: 6149 - DNA, 203 bp, Homo sapiens
  source 1..203: mol_type = other DNA
ggcgcgccagtccttgggccgcaccctttccttttacaaacttggttttatggtgacaatggcaggcaacatggtcaacaacttgttcgctctcgctactgaagtgtgttctccaaaacagggtcctctcctcgacacagagatgcccttgcctcttgaattggctgaatttcccaatcagtctgacacgactcggaccgatg

SEQ ID NO: 6150 - DNA, 203 bp, Homo sapiens
  source 1..203: mol_type = other DNA
ggcgcgccagtcctttgatgatgataggatgtacttgtcagggcctcctacccgagtcaaaatggcttcttcataccacatgcctcaatgggttgagtcttttgctcgtttttgcttggaactccaccccgtccaacacaggcgtaccttggcccagtcactccgtgactcacaatgtcgtggagctgcgactcggaccgatg

SEQ ID NO: 6151 - DNA, 203 bp, Homo sapiens
  source 1..203: mol_type = other DNA
ggcgcgccagtcctgtcactcgcgcccggaggcaggtcacaacaatgaatcaggcaattctggtacaatcgtgaacaactattatatgcaacactaccaaaattccattgaccttgatggcatttcctctcaaaacattggcgaggctggagctggaaccaaccctttttcatccatactcgacgtgccgactcggaccgatg

SEQ ID NO: 6152 - DNA, 203 bp, Homo sapiens
  source 1..203: mol_type = other DNA
ggcgcgccagtcctacgatgcactcccgcgccacctgccacctcagcagcttactctctacccacaccagtttctcaacttgcggactaacactactgttgacattgaggtcccctacatgaattttgtgcctgcttctgctccagtaatgcattgtccttggacccttttgatcatggtcatttcaccgactcggaccgatg

SEQ ID NO: 6153 - DNA, 203 bp, Homo sapiens
  source 1..203: mol_type = other DNA
ggcgcgccagtcctcactccgctacggggctgggtcagcccctgatgtacagttaaccatgaccataacccccaccgattttgttgccaacggcctgagacagaccgtatctgagggtataccgggcacccagccctacgacaggcagttcctgtccacagagccctcagctccccctcccctctatacgactcggaccgatg

SEQ ID NO: 6154 - DNA, 203 bp, Homo sapiens
  source 1..203: mol_type = other DNA
ggcgcgccagtcctcaccatcttggctgccagaccgaagcttcattcccggcaagtttactgactttttgcaggttgccgtcatcccaaccatggccgaggtttctgtgggcaccaaccacaaacccatccccagtttttctgttggcaatacattggaggaccggccgttgttgaacactgatttaacgactcggaccgatg

SEQ ID NO: 6155 - DNA, 203 bp, Homo sapiens
  source 1..203: mol_type = other DNA
ggcgcgccagtcctctttcacctccatgacatttcggaacacttacctgtctgctttggctctcaattacacccagtacagaggtagtatttgtgtggactttttgtttacaggcactgccatggcccaagggaaatttgttgttgcttacacgcctcctgggcgtgaacccaaaacattggatgaagcgactcggaccgatg

SEQ ID NO: 6156 - DNA, 203 bp, Homo sapiens
  source 1..203: mol_type = other DNA
ggcgcgccagtcctccatgcagggcacatatgccatatgggatcttggcttgaattctagctttaaatttgttataccttacatttcagcttcggcttaccgattcaccaacgaggacgaccgtccatctgtggtgaatgcagtcggttggttgcaagtttaccagctcactaccctgacgtaccctgcgactcggaccgatg

SEQ ID NO: 6157 - DNA, 203 bp, Homo sapiens
  source 1..203: mol_type = other DNA
ggcgcgccagtccttggctcctgccgcgcattttggtactttgtcaattcgcgtgaacgcccgccccttgacgcaactcaaaggggcggacgacgaacctctccaagacctggcttttgccctcttcacccgccttcgtaatttgaaagcctatgcgccacgccatttccagcgtgtgcccaattcaccgactcggaccgatg

SEQ ID NO: 6158 - DNA, 203 bp, Homo sapiens
  source 1..203: mol_type = other DNA
ggcgcgccagtcctgtgcaacaaactttgaccttctcaagttggctggagacgtcgaatccaacccagggcctaccatctggtccatgatgcctggtggcgagcttatagagtttgccacgaaagtgtcccaggtctacaaaactctgaaggaaaaatgcacagaccccactacgtggattaaggcagcgactcggaccgatg

SEQ ID NO: 6159 - DNA, 203 bp, Homo sapiens
  source 1..203: mol_type = other DNA
ggcgcgccagtcctttcgccgcaccttcttcgatgactcgtcgtcggagtctgaggacggtgaaccagaagttccacagtttaggccacaggtttaccctagacctcgcagtgagcgagtggttagacaccccatgacagcccgtcgcgcgcagcgcgtcattgacatgggttactctgactacgagacgactcggaccgatg

SEQ ID NO: 6160 - DNA, 203 bp, Homo sapiens
  source 1..203: mol_type = other DNA
ggcgcgccagtcctcggtgacgcgccgctactggaaggtgattgatgtcagcgcagacgaacagtataagacagtggacggcagattggactacgctaaggccacacaaccaacccagatcccccctgaattggctgtgttcaagacacacgtccctcttttgaagggcgctctacgcgactgccagccgactcggaccgatg

SEQ ID NO: 6161 - DNA, 203 bp, Homo sapiens
  source 1..203: mol_type = other DNA
ggcgcgccagtcctatgcagcacttgctctttctcttttgacctctatactttctttttctcttgtgatttattcaggggtgaagacctatcaggagttttcccgcaagcacaagcatgtgcgccagccggtgtacaatgcctgggaggactttgatgaggactctatctttgaacagtcacgtgcttcgactcggaccgatg

SEQ ID NO: 6162 - DNA, 203 bp, Homo sapiens
  source 1..203: mol_type = other DNA
ggcgcgccagtcctcagctggccgcaattcggcaacacgcgaccagcttgaggcagtggatgtgattgatcaatttgaaatgccgagtgatgctgtcgctattaagtttccagacaagcgcggctcctcttacaaaaatattcttcaccaccttgcctacaccctcccaacccgtggaaagccagtttcgactcggaccgatg

SEQ ID NO: 6163 - DNA, 203 bp, Homo sapiens
  source 1..203: mol_type = other DNA
ggcgcgccagtccttcatccttgtcaacaacaacgtggcaggtagagccgttgttcacggtacttacattggatgcacccaaaagatcaccactttagacggattcacttttcccaacgtgagttcatacaaagccactacccatcttgggatgtgtcgcgcgccagtggttgccaacgaaaatggcacgactcggaccgatg

SEQ ID NO: 6164 - DNA, 203 bp, Homo sapiens
  source 1..203: mol_type = other DNA
ggcgcgccagtcctaggcttatgcttcctcattgtttgcacagattggtactgacaatggacccatttcagagtatgaagctgttactggcattgagaatttggactcagtggagacgacaacgtcgcccggacttccctacacgacagcggggatcccgagagaggcgctgtttgacccagacaaaacgactcggaccgatg

SEQ ID NO: 6165 - DNA, 203 bp, Homo sapiens
  source 1..203: mol_type = other DNA
ggcgcgccagtcctacaacattgtgctgcgtgccgcagcgtatgatgtcttcaccaactacgaggaaggtgacctcgccttcttgacgtacggtgatgacgtactactctgtgctaatcagccactgcctctggagcgctttcgcaagtcgcttgcaaagcttggatacaccattactccagctgacacgactcggaccgatg

SEQ ID NO: 6166 - DNA, 203 bp, Homo sapiens
  source 1..203: mol_type = other DNA
ggcgcgccagtcctccacggacttggcggttcatcttggaccgctggagtacgcaaggctcttccgcccgtttgtggaagttgggtactgcgttcgccccttcggggatgcgcgcagggcctggctccgcaattttgacctgtgaggtgctccctaccagataccccagatttacccgttaccctaaacgactcggaccgatg

SEQ ID NO: 6167 - DNA, 203 bp, Homo sapiens
  source 1..203: mol_type = other DNA
ggcgcgccagtccttgacctgtgaggtgctccctaccagataccccagatttacccgttaccctaaaattccctcccctttctcttcactcgccgaggccacgccgagtaggaccgagggtacagcgagtcttttagtttaaggtgttagatgtaaggtacgtgggctttcttttggtttacttcttccgactcggaccgatg

SEQ ID NO: 6168 - DNA, 203 bp, Homo sapiens
  source 1..203: mol_type = other DNA
ggcgcgccagtccttccagaggagaggtgctggcttttgaagcattagctgaggacattcctgatacccttaatcaccaaactccatttgtaaataatgatgtagaagatgacatatttgatgaaacagagaaattcttagatgtttgctacagtgtgcttatgcaggcatggatagtaacatgcaagcgactcggaccgatg

SEQ ID NO: 6169 - DNA, 203 bp, Homo sapiens
  source 1..203: mol_type = other DNA
ggcgcgccagtccttcacaatcaagatctttgctagcaaaccgctactatgctatggtgggagacattggcaagtacattgaacacagcggaatgggaggatttttcttaacacttaaatatggacttggaacaagatggcctacattggctcttgcagcattttctggggaactccagaaattaaaacgactcggaccgatg

SEQ ID NO: 6170 - DNA, 203 bp, Homo sapiens
  source 1..203: mol_type = other DNA
ggcgcgccagtccttatttaaatcagcaatattttcagctaggagtagaaacagcaaggaaacagcagggagctgttgacaacaggacagcagaggacctcggcatgactgctgcagacaaagcagacctcactgcaaccatatcaaagctatccttgtcccaattacctaggggtagacaaccaatacgactcggaccgatg

SEQ ID NO: 6171 - DNA, 203 bp, Homo sapiens
  source 1..203: mol_type = other DNA
ggcgcgccagtcctggacaaccaaacaaccagacaagtgacaaccagcagagattcaacccccccataccgcaaagaacatcaggtatgagcagtgaagagttccaacattcaatgaatcagtacatccgtgctatgcatgagcaatacagaggctcccaggatgatgatgccaatgatgccacagatcgactcggaccgatg

SEQ ID NO: 6172 - DNA, 203 bp, Homo sapiens
  source 1..203: mol_type = other DNA
ggcgcgccagtcctctgattgagaacctgagtaaaatttccactgttacagataccaaaacccgccaaaaacgatttgcaggagtagttgttggacttgctgcattaggagtagccacagccgcacaaataactgcagctgtagcaatagtgaaagctaatgcaaatgctgctgcgataaacaatcttcgactcggaccgatg

SEQ ID NO: 6173 - DNA, 203 bp, Homo sapiens
  source 1..203: mol_type = other DNA
ggcgcgccagtcctcatactgggagcatgtccaacaccaactgtacacccggaaatctgcttctgcatgatgcagcgtacatcaatggaataaacaaattccttgtacttaaatcatacaatgggacgcctaaatatggacctctcctaaatattcccagctttatcccctcagcaacatctcccaaccgactcggaccgatg

SEQ ID NO: 6174 - DNA, 203 bp, Homo sapiens
  source 1..203: mol_type = other DNA
ggcgcgccagtcctgccggtaactccagcgaacaggctgcagcagcacggagttcctatgtaatccgttatcactcaaacaggttgattcagagtgctgttcttatttgcccattgtctgacatgcacacagcaaggtgtaatctagttatgtttaacaattctcaagtcatgatgggtgcagaaggtcgactcggaccgatg

SEQ ID NO: 6175 - DNA, 203 bp, Homo sapiens
  source 1..203: mol_type = other DNA
ggcgcgccagtcctccttaatactattgaatgaagactccagattcaataataattgaaaggctctctatcttatgcaatagttatacgttttggctgtattagaatgttatagattctgctgtttttcccatatgaagcaatccttcaacaccgacttaggttcaattttctcatcatttactgttgcgactcggaccgatg

SEQ ID NO: 6176 - DNA, 203 bp, Homo sapiens
  source 1..203: mol_type = other DNA
ggcgcgccagtccttactagggcacttcccgcatgatcttgacatttctgaaataagcccccttcacaataatgattgggatcaaattgccagagaagaatccaatcttgctgaacgacttggagtagctaaatctgaattaattaaacgtgtgcccgcatttagagcaactagatggcgtagtcatgcgactcggaccgatg

SEQ ID NO: 6177 - DNA, 203 bp, Homo sapiens
  source 1..203: mol_type = other DNA
ggcgcgccagtcctctgatttagttcacattgttgacacacgatctggtctaatagttatcacccctgaacttgttatttgttttgatcggttaaatagtgttttaatgtattttacatttgagatgactttaatggtaagtgacatgtttgagggaaggatgaatgtcaccgctctctgcactattacgactcggaccgatg

SEQ ID NO: 6178 - DNA, 203 bp, Homo sapiens
  source 1..203: mol_type = other DNA
ggcgcgccagtcctcctttattacacaagagattatagatatcctaattggttcaaaagcccttgataaggatgaatcaataactgttactacacaattgttagatatattttccaacctttctccagatttaattgctgagatgttgtgtctcatgagactttggggtcatcccactcttactgctgcgactcggaccgatg

SEQ ID NO: 6179 - DNA, 203 bp, Homo sapiens
  source 1..203: mol_type = other DNA
ggcgcgccagtcctgtagaagtctaataaaacaacgacatcagagacatcatattcctatgcccaatccatttaatagacgtctattactcaatttcttagaagatgacagttttgatccagttgccgagcttcgatatgttaccggtggtgaatatctccaagatgacacattttgtgcatcttactcgactcggaccgatg

SEQ ID NO: 6180 - DNA, 203 bp, Homo sapiens
  source 1..203: mol_type = other DNA
ggcgcgccagtcctatatcggagatcctcttggtacagctgtggcagatctcaagaggttaattaaatgtggtgctcttgaatcatggatactgtataatttactagcaagaaaaccagggaaaggttcatgggcaactttagcagccgatccatactcattgaatcaagaatatctttatcctcctacgactcggaccgatg

SEQ ID NO: 6181 - DNA, 203 bp, Homo sapiens
  source 1..203: mol_type = other DNA
ggcgcgccagtcctcttctacacaagaaatcactctccatttgcacactagctcatcttgttgtgttagaagtgtagatggttgccttatatgtgagagcaatggagaggttcctcagatcactgttccctatactaatacatttgtatatgatcctgatccactagcagattatgagattgcacacccgactcggaccgatg

SEQ ID NO: 6182 - DNA, 203 bp, Homo sapiens
  source 1..203: mol_type = other DNA
ggcgcgccagtcctcactaattccaggccctccttctcatcatgtattacgaccactaggagtgtcatccacagcttggtataaagggataagttattgtagatacctagaaacacaaaagatacagactggtgatcatctttatttagccgaaggaagcggtgcttcaatgtcacttctagaactctcgactcggaccgatg

SEQ ID NO: 6183 - DNA, 203 bp, Homo sapiens
  source 1..203: mol_type = other DNA
ggcgcgccagtccttatttccaggagatactgtctattataatagtctttttagtagtggagagaatcctccacagagaaactatgcccctcttccaactcaatttgtacagagtgttccatataaattgtggcaagctgatcttgctgatgatagcaatttgataaaagattttgtcccattatggacgactcggaccgatg

SEQ ID NO: 6184 - DNA, 203 bp, Homo sapiens
  source 1..203: mol_type = other DNA
ggcgcgccagtcctatggaaacggtgcagttacagacttatcaacaaaggatgcagttgcattcataatacataaagtaggagcagagaaagcatcccttgtccatatagatctcgaatcaactgctaatataaatcagcaaactctgtccagatcccagattcattcattaattatagcaactactgcgactcggaccgatg

SEQ ID NO: 6185 - DNA, 203 bp, Homo sapiens
  source 1..203: mol_type = other DNA
ggcgcgccagtcctttagaactatcggtttcagtgcagctctagtaactgctactactcttcacaatgacggattcacaacaatacatcctgatgttgtttgtagttattggcaacaccatcttgaaaatgttgggagagtcggaaaagtaattgatgagatacttgatggtttagccaccaacttctcgactcggaccgatg

SEQ ID NO: 6186 - DNA, 203 bp, Homo sapiens
  source 1..203: mol_type = other DNA
ggcgcgccagtcctctgtagctaaagatgctgattccaaaatcagcagtgctctggaggaagaactaggtgtgacagatacagcaaaagagagactaagacaccatctgacaaacctttcaggaggggatggtgcgtaccacaagcctacaggtggtggagctatagaagtggcaattgatcatacagcgactcggaccgatg

SEQ ID NO: 6187 - DNA, 203 bp, Homo sapiens
  source 1..203: mol_type = other DNA
ggcgcgccagtcctacataacatttggagtcgaggacactgctgatcgggacaacaagaactggacaaatgacagcaatgaaagatggatgaatcactcgatcagcaaccacacaatcacgattcgtggtgcagaagaacttgaagaagagacaaatgatgaagacatcactgatatagaaaacaagacgactcggaccgatg

SEQ ID NO: 6188 - DNA, 203 bp, Homo sapiens
  source 1..203: mol_type = other DNA
ggcgcgccagtcctttgcacgaaggctggccgacagaaaacagagactaagccaggcaaacaataaacgagacaccagcagtgatgctgactatgagaatgatgatgatgctacagcggctgcagggataggaggaatttaacaggatacttggacaatagaagccagatcaaaagtaagaaaaacttcgactcggaccgatg

SEQ ID NO: 6189 - DNA, 203 bp, Homo sapiens
  source 1..203: mol_type = other DNA
ggcgcgccagtcctactctcagatgtcatcggactccttgacgtcgtcttatcctacaagcccacagaaattggagaagacagaagctggctccatggtatcatcgacaacccaaaagaaaacaagccatcatgcaaagccgacgataacaacaaagacagagcaatctcaacgtcgacccaagatcacgactcggaccgatg

SEQ ID NO: 6190 - DNA, 203 bp, Homo sapiens
  source 1..203: mol_type = other DNA
ggcgcgccagtcctggaaactagcagcacacatagtacaagaataactgatgtcattaccaacccaagtccagagcttgaagatgccgttctacaaaggaacaaaagacggccgacgaccatcaagcgtaaccaaacaagatcagagagaacacagagttcagaactccacaaatcaacaagtgaaaacgactcggaccgatg

SEQ ID NO: 6191 - DNA, 203 bp, Homo sapiens
  source 1..203: mol_type = other DNA
ggcgcgccagtcctctgtacgaagaacagttagatctggagaaatgatagtatacatggtagattcgatccatgctcctctactaccatggtccagccgactgagacaagggatgatatataatgccaataaagtagctctagcacctcaatgtctcccagtcgacaaagacatcagattcagggttgcgactcggaccgatg

SEQ ID NO: 6192 - DNA, 203 bp, Homo sapiens
  source 1..203: mol_type = other DNA
ggcgcgccagtcctgccaacttgcatggaaaaaagcagtttgctatcctttaatggatgtaaatccacatatgaatctagtcatctgggcagcttcagtagaaatcacaagtgtcgatgctgtgttccaacctgcaattccgaaagaatttcgctattacccaaatgttgttgcaaaaagcatcgggacgactcggaccgatg

SEQ ID NO: 6193 - DNA, 203 bp, Homo sapiens
  source 1..203: mol_type = other DNA
ggcgcgccagtcctaaatcaggaggatataagtctacactcctcaataatgacacccattagctctaaatcgtaccattaatcaaatacagatcaattcgatacaatcagttcaaataagaaaaacgtagggacaaagtcctctaccaacatcaaggaagacaagagtctcaaaaagctcagcctaagcgactcggaccgatg

SEQ ID NO: 6194 - DNA, 203 bp, Homo sapiens
  source 1..203: mol_type = other DNA
ggcgcgccagtcctcagtctccattagacctgtagacatttctttaaatcttgcatctgccacaaatttcctagaggaatccaagacagagctcatgaaggcaagggcaatcatatcagcagttggaggatggcacaacacagagagtactcagataatcatgataataattgtgtgcatacttataacgactcggaccgatg

SEQ ID NO: 6195 - DNA, 203 bp, Homo sapiens
  source 1..203: mol_type = other DNA
ggcgcgccagtcctaaagtgccaaaataatcaaagagacaatcacagaattaatcagacaagaagtaatatcaaggaccataaacatacaaagttcagtacaaagcgggatcccaatattgttaaacaagcaaagcagagatctcacacaattaatagagaagtcatgcaacagacaggaattggctccgactcggaccgatg

SEQ ID NO: 6196 - DNA, 203 bp, Homo sapiens
  source 1..203: mol_type = other DNA
ggcgcgccagtcctgactaccttcattatcaattggtgatgcaatatatgcgtattcatcaaacttaatcactcaaggatgtgcagatatagggaagtcatatcaggttttacaattaggttacatatccttaaattcagatatgtatcctgatttaaacccggtaatttctcatacctatgacatcacgactcggaccgatg

SEQ ID NO: 6197 - DNA, 203 bp, Homo sapiens
  source 1..203: mol_type = other DNA
ggcgcgccagtcctacgacaacaggaaatcatgttctgtaatagctgcaggaacaaggggttatcagttatgctccttgcccactgtgaatgagactacagactactcgagtgaaggtatagaagatttagtatttgacatattagatctcaagggaaagaccaaatctcatcgatacaaaaatgaagcgactcggaccgatg

SEQ ID NO: 6198 - DNA, 203 bp, Homo sapiens
  source 1..203: mol_type = other DNA
ggcgcgccagtcctatataacttttgaccatcctttttctgcaatgtatccgagtgtaggaagtgggataaaaattgaaaatacactcattttcctagggtacggtggcttaacaactccgctccaaggcgacactaagtgtgtgataaacagatgtaccaatgttaatcagagtgtttgcaatgatgcgactcggaccgatg

SEQ ID NO: 6199 - DNA, 203 bp, Homo sapiens
  source 1..203: mol_type = other DNA
ggcgcgccagtcctaagaattatgggagcttatcgactctttatttcccaatcttggtgaggatgtatataatattatatcactactagaacctttatcacttgctttaatacagttggatgaccctgtaactaatttaaaaggagctttcatgagacatgttttgactgagctacatacaattttaacgactcggaccgatg

SEQ ID NO: 6200 - DNA, 203 bp, Homo sapiens
  source 1..203: mol_type = other DNA
ggcgcgccagtccttattacatgagaaattgatcaaaaatatgaataagtgcaattcaaatgggtattgggatgaaagaaagaaatctaaaaatgaattcaaagctgcagactcatcaaccgaggggtatgagactctgagctgttttttaaccaccgatttgaaaaaatactgtctcaactggagatcgactcggaccgatg

SEQ ID NO: 6201 - DNA, 203 bp, Homo sapiens
  source 1..203: mol_type = other DNA
ggcgcgccagtcctctgacaacatcgacttagatacacttagcaatggaagtcctgccatacgtatcccttattttggttctgctactgatgaaagatcagaggctcaactaggttatgttaagaacttaagcaagccggcaaaagcagcaataagaatcgcaatggtttacacttgggcttatggaacgactcggaccgatg

SEQ ID NO: 6202 - DNA, 203 bp, Homo sapiens
  source 1..203: mol_type = other DNA
ggcgcgccagtcctaaatgagaaaactttcatttttagctagacatctagcatacttgtgtagtttggcagagatagctaaagagggaccaaaattggaatctatgacatctctcgaacgactcgaatcattgaaagagtatctagaacttacttttttagacgatcctatattaagatatagtcaatcgactcggaccgatg

SEQ ID NO: 6203 - DNA, 203 bp, Homo sapiens
  source 1..203: mol_type = other DNA
ggcgcgccagtcctatatagtagacacaaaaaattgtattatcacatttgatagagtattaagagatacaatctttgagtggactcggataaaagacgcagataagaagctaagacttacaggtaaatatgatctatatcctcttagagattcaggtaagttaaaagttatttctagaaggcttgtaacgactcggaccgatg

SEQ ID NO: 6204 - DNA, 203 bp, Homo sapiens
  source 1..203: mol_type = other DNA
ggcgcgccagtcctgtccttcactttgaaaagaaagactaagcaaagatcagctggatggaccatgggtgtgattttcatatggatgatgggaaccatattgtcaattgaagttgttaaaaacaacgggggttggctcatgaaaccccgtcttcaagacactggatccacggtgcctgttggaaaaggcgactcggaccgatg

SEQ ID NO: 6205 - DNA, 203 bp, Homo sapiens
  source 1..203: mol_type = other DNA
ggcgcgccagtcctttggaagaccgttgtggtgctttgtctggcagctttggcactaccatcatttgcaaccaattgtgtgaccatatcacagagagaaattcttaaaggagtggaaggagtcacatggttcgaggtgcttttggaaaagactagctgcattaccattgcagcacaaaacagaccatccgactcggaccgatg

SEQ ID NO: 6206 - DNA, 203 bp, Homo sapiens
  source 1..203: mol_type = other DNA
ggcgcgccagtcctcattgacctctggctagacgatgtgaaacaaagctcggtgatggccagcaaagaattctgcatgaaggtcgaagtgtcagaaactcaaatagctgctaggtgccctactcaaggagatgcaactttgcctatggaagggaaggatgattatgtttgcaagaaaaccttcagtgacgactcggaccgatg

SEQ ID NO: 6207 - DNA, 203 bp, Homo sapiens
  source 1..203: mol_type = other DNA
ggcgcgccagtcctcagaggatggggcaatggatgtgctctttttgggaaaggaagtattgtgggctgcgctaaagtagcctgcaatactgctaatgttatgaaaactcatatctatgagcaacaagctgtccagtatgtggttggcatagaggtacatagaggggaagtcatcaaagcaaatgtttccgactcggaccgatg

SEQ ID NO: 6208 - DNA, 203 bp, Homo sapiens
  source 1..203: mol_type = other DNA
ggcgcgccagtcctccgtgtgacagttaaaaatgtgaaggaaaattcagatgatcaaggaactctgatcactacaaatccatttgttgaaagcaatggagccactatcttcctggaacttgaaccagtctatggattgtcaacaataaaagttggggacatcacataccaatggaatcagcaagggagcgactcggaccgatg

SEQ ID NO: 6209 - DNA, 203 bp, Homo sapiens
  source 1..203: mol_type = other DNA
ggcgcgccagtccttgtcattgggaaggctgtgagaaaaatcaccaacgacatccataaaacaattgtcgttgggagtgctttttggaattcagatcaaagattctcagccattaatttgatggatctaattaggttgccctttgcttttttatttgggggacttggattcatgatgaagatgatcatcgactcggaccgatg

SEQ ID NO: 6210 - DNA, 203 bp, Homo sapiens
  source 1..203: mol_type = other DNA
ggcgcgccagtcctgaatgaagttaatgactggtatggggggtacatgtactacccagatgatccagagacattcatcgccagcttggtcaatgataagaaagagcattgtggtacttatccagcaaacgccttggaactagcaatgtggcagaagcttgaatctcagatcaatttgttgttgaaagacgactcggaccgatg

SEQ ID NO: 6211 - DNA, 203 bp, Homo sapiens
  source 1..203: mol_type = other DNA
ggcgcgccagtccttgtcattaaggaatggtgttgccgtcactgcaaactgcctccccttaaattcaccatggaggaagagtgctggtacgccatggaaatacgaccaacttccaaagttaatggtttggtgatggcatcagatggtgagaaaccactgtttgaatggtgttcatttgctctcctgaccgactcggaccgatg

SEQ ID NO: 6212 - DNA, 203 bp, Homo sapiens
  source 1..203: mol_type = other DNA
ggcgcgccagtcctggcatatatgatggaagtggtgtttgacttgagaccaggcatgctgcttggccttatgttgaacaagacatggaagtttgaaagacttgttgccatgattggttgtctgtcattcttacaacaagccactattgaatggcggacagcctgggttctgctagattgcattgcagtcgactcggaccgatg

SEQ ID NO: 6213 - DNA, 203 bp, Homo sapiens
  source 1..203: mol_type = other DNA
ggcgcgccagtccttgagaaagaagaaagtaggatggagactcttattcttggggtgggaatgatagcaacagaattccattgggtgggtttacccctgacagttcttgtccttggcttgaggagatggattgtgaatggaaaagaacaaaggagtctgatagtctatggtggaagatcagagagtgccgactcggaccgatg

SEQ ID NO: 6214 - DNA, 203 bp, Homo sapiens
  source 1..203: mol_type = other DNA
ggcgcgccagtcctcaatgatgaaactgagggagaccttcttgagggagtttatagaattacagcagcctccatttttgggagaaagcaagttggaataggtgtcctcaaggaaggagtgttccataccatgtggcacgtcactagaggaagtgctctgcgagtgagagggagagtgctcgccccagacgactcggaccgatg

SEQ ID NO: 6215 - DNA, 203 bp, Homo sapiens
  source 1..203: mol_type = other DNA
ggcgcgccagtcctaacagcctggtttgtgccttctttaaacacagccaactcaatggcaaaagtccttagaggtctaggaaagaaagttgtggtgcttacaagcaagaccttccatgataactatccgaagctcaatgatgagaagcctgattttattttgactactgatatctcagaaatgggtgccgactcggaccgatg

SEQ ID NO: 6216 - DNA, 203 bp, Homo sapiens
  source 1..203: mol_type = other DNA
ggcgcgccagtccttaacttggatgtggaaagagtcattgaccctagaacaacattgaagcctgttgagaaaggaaatgcagttgaaatcagtggtgaaaggaagataactccagcctctgcagcgcaacgacgcggcagggtcggaaggactaaaggaaagaaggctgattacatttaccaaggtgacgactcggaccgatg

SEQ ID NO: 6217 - DNA, 203 bp, Homo sapiens
  source 1..203: mol_type = other DNA
ggcgcgccagtcctcctgcttgctcaatgtgactttacaccatggttggcttggaaagtggcttcagatggcaagagcattgagaaccgagagtggctcaagagtgggccaaaggaacacttggtgacagatgaaaactgtgaagcggttacatacaagactcctggtggaaaggttgaaagactccacgactcggaccgatg

SEQ ID NO: 6218 - DNA, 203 bp, Homo sapiens
  source 1..203: mol_type = other DNA
ggcgcgccagtcctcaagggattcaggatggcccaagaatcaatgccaacagcccttcttactgtgatgcaagctctaataataggcactggattgatcatgttcttggggtggatgtgttcgagtaggaaggtggacagaatgatgctgggcactctgttgatagtgggatgtagtgtcacagcatgcgactcggaccgatg

SEQ ID NO: 6219 - DNA, 203 bp, Homo sapiens
  source 1..203: mol_type = other DNA
ggcgcgccagtcctaatgttcacccagagaattgttgctggtagtgtcagtggaaaactggacacattgaatggattgagaaatggatttgtgagcacctcgatgtcattgggtgacttgtcgcttttcatctcattctgcagaaacatgagtcctctaactactgtgacagggctggttctagccgccgactcggaccgatg

SEQ ID NO: 6220 - DNA, 203 bp, Homo sapiens
  source 1..203: mol_type = other DNA
ggcgcgccagtcctggctatcctcctagctgtcatcaatgtggttgttgtccgtgaaccatgggcaatgcttgaagctggactagtgctcctcgctgcaattaagtttgcggctgatggggctaaagaaactttgataacgcttcctgtcctgagtgggattggtgctttgattagaggggattacttcgactcggaccgatg

SEQ ID NO: 6221 - DNA, 203 bp, Homo sapiens
  source 1..203: mol_type = other DNA
ggcgcgccagtcctagctagggaagcactggctaagggaaaaaccaacaccggccatgcggtctccagaggaacagcaaaactagcctggattgatgagaggggtggagtggagttgaaaggaagtgtcgtggacctgggctgtggaagagggggctggagttactatgcggcttcgcaaccaaatgtcgactcggaccgatg

SEQ ID NO: 6222 - DNA, 203 bp, Homo sapiens
  source 1..203: mol_type = other DNA
ggcgcgccagtccttgaggtgccagaagaagaagtccagatgagagtagacaaaatcaaggctgagaaatcaggcacctggtgttttgattctaatcacccttatcgcacgtggaactatcatggatcataccgtgtgagggatgtgggaacaagagcttcagcagtcaatcatgttgtgaagttactcgactcggaccgatg

SEQ ID NO: 6223 - DNA, 203 bp, Homo sapiens
  source 1..203: mol_type = other DNA
ggcgcgccagtcctaaccaaaggtgggaaagtgagaacatgcacaaaagaagagttcatccaaaaagtaagatctcatgctgctatcggggcctggtcgtcagatatggaagggtggagctcagctgtggaggcagttgacgatcctaggttctggaacatggtgcagaaagaaagagatttacacctcgactcggaccgatg

SEQ ID NO: 6224 - DNA, 203 bp, Homo sapiens
  source 1..203: mol_type = other DNA
ggcgcgccagtcctgcagcttatcagaatggcagaagccgaaggagttcttggagcaacttttgaggacttcgggattgacagatggttgcaggaacatggtgaagaccgagttgaaagaatgctggtcagtggtgatgactgtgtagtcaatgctatagatgaaaggtttgggtcaagtctgaattgcgactcggaccgatg

SEQ ID NO: 6225 - DNA, 203 bp, Homo sapiens
  source 1..203: mol_type = other DNA
ggcgcgccagtcctgacagtcaaccaggggggatgtgttggagtggaatcaacaggctgtctagccaaggcgtatgcgcaaatgtggcttttgctttatttccacagaagagacctcagaacgctggctctagctgttatgtcagctgtgccaagcaattggattccaacaggacgcaccacttggtccgactcggaccgatg

SEQ ID NO: 6226 - DNA, 203 bp, Homo sapiens
  source 1..203: mol_type = other DNA
ggcgcgccagtcctggcaaccagtgggctagccacatgggtatgacgcacccaccctctgcattcttgtaaatactttggccagtcattgtaaataggttagggagccgggcccaacccagctagggatagcctttctggggtaaggactagaggttagtggagacccccggcttttgaagttagggccgactcggaccgatg

SEQ ID NO: 6227 - DNA, 203 bp, Homo sapiens
  source 1..203: mol_type = other DNA
ggcgcgccagtcctcctgggaaattagctaaggggataaccactctgatgaacatcctccggactctgctaaacggaatcttgggacgcaaaaaacaaaggagaggaggaactgaaagcctgttccccataatgtttctaactggattgatggctatgcaggtatcccaaaatggtgatggttggctgcgactcggaccgatg

SEQ ID NO: 6228 - DNA, 203 bp, Homo sapiens
  source 1..203: mol_type = other DNA
ggcgcgccagtcctaatgtgtgggttaaatatccgctttgtaaacctggaggccacaggctaaaacgatcgctgtcaataactgaacatccatcgtctgtctcactagacaaaccaactttgtggcatcactggaacagtgtcaatgatcgaattggcaagagtgaagagtggatagttaccaatgctcgactcggaccgatg

SEQ ID NO: 6229 - DNA, 203 bp, Homo sapiens
  source 1..203: mol_type = other DNA
ggcgcgccagtcctatgcgtgaggaacatctcgacggatatgtctgcaagagaagcttcagtgatagaggctggggaaatggttgtggtttgtttggaaaaggcagcatcgttggatgtgctaaggccacttgtggggcaaatgacatcatcaaaagctactcgtatgattcaccaaaagtcaaatatcgactcggaccgatg

SEQ ID NO: 6230 - DNA, 203 bp, Homo sapiens
  source 1..203: mol_type = other DNA
ggcgcgccagtcctgtttttaaatcattggtcaaagctgaagaagtgaccaaaactagtaactcttaccatctcaccggaggacatgttgattgtagagtgagtactctcaatcttcgaatgaagggtttgacgtatcaaatgtgttcttctagctttgtgtggcacaaaagaccagtggccacgcaacgactcggaccgatg

SEQ ID NO: 6231 - DNA, 203 bp, Homo sapiens
  source 1..203: mol_type = other DNA
ggcgcgccagtcctattgacttggccatgtggaaagcacttgaggaggagataaactggtttctggaagatcagtcagttgattggaggataatggttggaaatgaagaaaaggttttccacaaaacaaactcaagtggctgggaaagaagagctgggaggaattctctatcatggaagaactgggcgcgactcggaccgatg

SEQ ID NO: 6232 - DNA, 203 bp, Homo sapiens
  source 1..203: mol_type = other DNA
ggcgcgccagtcctctagaggattgtgataaaagaggacattctgttagaagtaccacccaaggaggggtaacaatacctgactggtgttgtaaacactgtgttttgccacctttgaaattcaccaatgccgatggatgttggtatgccatggaaatcagaccactgaaaacgacacctggactagttcgactcggaccgatg

SEQ ID NO: 6233 - DNA, 203 bp, Homo sapiens
  source 1..203: mol_type = other DNA
ggcgcgccagtccttatgcaggaagtatgacagctttggaagctcagtcatggggagttctctctgtgatgttgctgttttacatgggctttctaccgaagattgcaaaagaaagatggagtgtgccaactgccttcatgtttttcgtctttgccatcacagggttgattgattgcagggattttctccgactcggaccgatg

SEQ ID NO: 6234 - DNA, 203 bp, Homo sapiens
  source 1..203: mol_type = other DNA
ggcgcgccagtccttttcaacatgtgactatggagtgggaatcagtttggaaagttttggattccttgggctttgttgtctatgggttcttactttctaagtctggaatgcaaagccacgtgttcatgctgtttgtagtgtcactgacttggatggatagcatagtaatgcaacatgctctagcacttcgactcggaccgatg

SEQ ID NO: 6235 - DNA, 203 bp, Homo sapiens
  source 1..203: mol_type = other DNA
ggcgcgccagtcctactgattacacagccatactcggcattgttatggcaataggagcagccatttgcaaaaatggtctggaatcaagtggatggatgatcggaatcatgggaattttcctagtcttttttctcctccaattaagcaaaggagagatgacagctgaatgggctggatactgtgaatggcgactcggaccgatg

SEQ ID NO: 6236 - DNA, 203 bp, Homo sapiens
  source 1..203: mol_type = other DNA
ggcgcgccagtcctttccataccatgtggcacgtcacacgtggtgctgtattgaacatctgtgggaggaaaatcgtaccagaatgggccagcatcacagaagatctaatatcatataatggtgggtggagattgttcactagatgggatggaacagaagttcaagttcacgcttacacccctgatggacgactcggaccgatg

SEQ ID NO: 6237 - DNA, 203 bp, Homo sapiens
  source 1..203: mol_type = other DNA
ggcgcgccagtcctagttctatagctcaaactgagaagaaggaagaagatgttccacaaccaaagacacttgaaggagatggctggttgtcaaaagggaaaataaccgtaattgatgcccatcctggaagtggtaaaacacatagaatactaccaaatttagttaaaagggctgctgagagaaagatgcgactcggaccgatg

SEQ ID NO: 6238 - DNA, 203 bp, Homo sapiens
  source 1..203: mol_type = other DNA
ggcgcgccagtcctaggacacttgttttagctccaacacgggttgtgataaaagagatggaaagtgctctcaaaggaatggatatcagttttcactcatcggccgtgtcaacgaagaccccaggatcacttgttgatgtcatgtgccatgctacttttgtaaataggaaattaattcatactccacagcgactcggaccgatg

SEQ ID NO: 6239 - DNA, 203 bp, Homo sapiens
  source 1..203: mol_type = other DNA
ggcgcgccagtcctgatgttgaaaagatgattcctgatgagccatggaaacaaggttatgaatggataacagactttgaaggaagaacagcgtggtttgtgccatcatacaatgcagctcagggaatctcaaaagccttgagagagagaggaaagaaagtcctcattctgacaagcaagacctttcatcgactcggaccgatg

SEQ ID NO: 6240 - DNA, 203 bp, Homo sapiens
  source 1..203: mol_type = other DNA
ggcgcgccagtcctgacaactatcctaagatacagtcagaaaaacctgatttcatactcaccactgacatttcggagatgggtgccaatttagatgttgatagggtaattgatccaaggacaactcttaaaccaatggaaaaaggcaatattgtggaggttagcggtgaaatatcaataacgcctgcccgactcggaccgatg

SEQ ID NO: 6241 - DNA, 203 bp, Homo sapiens
  source 1..203: mol_type = other DNA
ggcgcgccagtccttatctgattgaaccaaagggaactacattttggacccttccagtggttagtggattaacatcactggtccgaggagatttctttggtttgattcccatttctttcagggtctggctatatgccagaagtgatagacgaggtatagtaaccagtcatcacacattgggtgaaaagcgactcggaccgatg

SEQ ID NO: 6242 - DNA, 203 bp, Homo sapiens
  source 1..203: mol_type = other DNA
ggcgcgccagtccttttattcccttgtcaggtcatgtggttgacctgggctgcggccgcggcggctggagctactattgcgcagcacaaacaccagtaaggaaagtcaatgcttataccttaggtactggagctcatgagaaacctcgtctggtcgaaagcttaggttggaacctcatcacctttaagcgactcggaccgatg

SEQ ID NO: 6243 - DNA, 203 bp, Homo sapiens
  source 1..203: mol_type = other DNA
ggcgcgccagtcctatgcagggatggagtgatgccaaggaagcagttcatgaccccaggttttggaatatggtggacaaagagaggaaactacacctggaaggaaaatgtgaaatgtgcatctataacatgatgggtaaaagagaaaagaaaccaggtgagtttggatgtgccaagggtagccggacccgactcggaccgatg

SEQ ID NO: 6244 - DNA, 203 bp, Homo sapiens
  source 1..203: mol_type = other DNA
ggcgcgccagtcctgaaagattgtctcgtctcttgattagtggtgatgactgcgtggtaaacgcatgtgatgaaaggtttgggagaagcttgacatggttgaacaccatggagaaaatccgcaaggacattgacttgtgggctccatcaaatggatatgagaactttgaaaaagttgagttctgctcacgactcggaccgatg

SEQ ID NO: 6245 - DNA, 203 bp, Homo sapiens
  source 1..203: mol_type = other DNA
ggcgcgccagtcctaaccactttcatgagctgatgttgaaagatggacgtcagctggtcgtcccctgcaggagtcaaaatgaattagttggtagagcttctgtaaatcagggtggaagtgcaaccgttgcagggactgcgtgtctagccaaagcctatgcccaaatgtggaatttgttgtattttcaccgactcggaccgatg

SEQ ID NO: 6246 - DNA, 203 bp, Homo sapiens
  source 1..203: mol_type = other DNA
ggcgcgccagtcctaagacaaacatcacaacatggaagaatgtggcctacctgcccagaggacaagacatgtgttgtggcagtcttattggcagctcaaaaagagcaacttgggccaaactcattcctggagcagttgaaaaagtgagagggatgattgggaatgaaaattacgtcaactaccttggacgactcggaccgatg

SEQ ID NO: 6247 - DNA, 203 bp, Homo sapiens
  source 1..203: mol_type = other DNA
ggcgcgccagtcctcaagacatgtgttgtggcagtcttattggcagctcaaaaagagcaacttgggccaaactcattcctggagcagttgaaaaagtgagagggatgattgggaatgaaaattacgtcaactaccttggagcaatgggacgctatgaatgtgatgatgtctcattccaactgtattaacgactcggaccgatg

SEQ ID NO: 6248 - DNA, 203 bp, Homo sapiens
  source 1..203: mol_type = other DNA
ggcgcgccagtccttgcagagatgtcaaaaatgtgatggtgacttatcccacgtgtaagaggaacaccaggaccagacgggatgtcacaatccaagaccatccaccgtctgtcacactcaccaaaccatctcttctcaagcatgtgggaggggctgaggagcatcttcaaaaggttgaaaattggatccgactcggaccgatg

SEQ ID NO: 6249 - DNA, 203 bp, Homo sapiens
  source 1..203: mol_type = other DNA
ggcgcgccagtcctttaatgaacagctggaaagttgtattggtgaccgtggccttgctctatggatttgggaacaagctacaaacgtggattctcataattgtgaccttgattgtggctccagcttatgctagcacctgtgttagtgtggccaaaagggatatgatccgtggtgacctcggaacaacccgactcggaccgatg

SEQ ID NO: 6250 - DNA, 203 bp, Homo sapiens
  source 1..203: mol_type = other DNA
ggcgcgccagtcctggagaggcgcatctggcagaagaggcaaactctgactacgtgtgtaagcgaggtttcagtgacagaggttggggcaatggatgcggcttatttgggaaagggagcatagtggcatgcatcaagactacatgcaagaatgatgctaacatcataaagagctatgtctatgatgctcgactcggaccgatg

SEQ ID NO: 6251 - DNA, 203 bp, Homo sapiens
  source 1..203: mol_type = other DNA
ggcgcgccagtcctaaccaaagaactgctatcttcaaagctttggtgaaagccaatgaaatctccaagtccaacaataagtacattctggatggaggacacttgagttgcaggatcggagtcaatggactgaagatggttggggctacctattctcaatgcacaaaacctttcgaatggatcaagaaacgactcggaccgatg

SEQ ID NO: 6252 - DNA, 203 bp, Homo sapiens
  source 1..203: mol_type = other DNA
ggcgcgccagtcctccagtcctaactcaacatggcacagtggtcatggaagtgaagtacacaggtgaaggagccccatgccgtataccattcagagttgaacgagtggacaagcctatggaaaatgttggcaatctggtcacaggaaacccatatgcctcacaaaaggacgctgtggtgttccttgagcgactcggaccgatg

SEQ ID NO: 6253 - DNA, 203 bp, Homo sapiens
  source 1..203: mol_type = other DNA
ggcgcgccagtcctgttggagagataggatgtatgattgatgtgggaaggagagagctgacttgtggggatggagttgtggtctggaaccaactggatgattggtgggaaaagtaccaatattatccagatgaacctgctgttttcttgggttccctcatggaagacaaagagaagcattgcggctaccgactcggaccgatg

SEQ ID NO: 6254 - DNA, 203 bp, Homo sapiens
  source 1..203: mol_type = other DNA
ggcgcgccagtcctgtgggaggacttgtcatggcttttgatgaagaaccagtgtggaagccatggggtattatgggattgatagtcctgttgtacatgggcttctttccttctctgggcaatggaaaattttcaatgggttttggcatggctgtgttcctgttgtgcgtgactggaatgctctcattacgactcggaccgatg

SEQ ID NO: 6255 - DNA, 203 bp, Homo sapiens
  source 1..203: mol_type = other DNA
ggcgcgccagtccttcggtagacccaatagccattgtcgtgacgttgatggctttgggggctgctgtggccaaggatggcactgccgttcagcctctaacactgggactcttttctgcagtcatcttgttcctattgcttcagctgacgggtgggcccctcatagctgaatgggcagggtacgcggatcgactcggaccgatg

SEQ ID NO: 6256 - DNA, 203 bp, Homo sapiens
  source 1..203: mol_type = other DNA
ggcgcgccagtccttggaaatccaatgccttgcgctactctggtcatctggacttagaagtcaagaagttgagcgatgggagactggtcaacacagctaaggaaaataccaccaccactgatggactcatactaggggctggaatgctagcttctggctttagctgggtagctgtgcctgtgacttttcgactcggaccgatg

SEQ ID NO: 6257 - DNA, 203 bp, Homo sapiens
  source 1..203: mol_type = other DNA
ggcgcgccagtcctacttactgtagctcaatagctcaggccaatgtgccagcagaaaccgaacctgaagtgctgaaaaccaactggacatcaaagggaaaactcaccgtcattgacgctcatccagggagtgggaaaacaaagaaaatattgccacgccttgttgatgaagctgttggaagaaagcttcgactcggaccgatg

SEQ ID NO: 6258 - DNA, 203 bp, Homo sapiens
  source 1..203: mol_type = other DNA
ggcgcgccagtcctcgcacactagtccttgctccaacaagggttgttgtgaaggagatggagcaggcactcagaggcaagcctgttagttttcattcttcagcagcgagtaagaaggtgccaggagcactggtggatgttatgtgtcatgcaacttatgtccagcgacggatgatgcctattcctcagcgactcggaccgatg

SEQ ID NO: 6259 - DNA, 203 bp, Homo sapiens
  source 1..203: mol_type = other DNA
ggcgcgccagtcctaagaactatgagcttgtcatcatggatgaagcacattggacagacccctctagcattgcggcccgaggattccttgattctcagcggaaggaaaatcacctttcactggtgctcatgactgccacaccacctggaactgatgatccctggcctcaaagcaacgctccaataaaccgactcggaccgatg

SEQ ID NO: 6260 - DNA, 203 bp, Homo sapiens
  source 1..203: mol_type = other DNA
ggcgcgccagtccttcagctgctcaaaggagaggaagagtggggcgtgaggagggacgtcaagctgagtacgtctatcagggcgaagttgaccccgatgacggagacttggtgtgctggaaagaggcccagatactcctggataacatggaaggacgattcaaaacggccagtgtcttctatgagcctcgactcggaccgatg

SEQ ID NO: 6261 - DNA, 203 bp, Homo sapiens
  source 1..203: mol_type = other DNA
ggcgcgccagtcctcagagcaaagttgacagggtcaccctgggggctctgttgctaactgctggctcagcggttctttggatgggtggagcagccccttgtgtcgtgggtgggagcctgatatgtgggtttgttttactagtagcattgtcaccagaggagggaatgcaacgcactcaagttgactcacgactcggaccgatg

SEQ ID NO: 6262 - DNA, 203 bp, Homo sapiens
  source 1..203: mol_type = other DNA
ggcgcgccagtcctactctggctatgtttgtgttgacactctacaccttgatagccgctgttgtcgctaatgaaatggggttcttggaacgaacaaagaaggacttccgagagttttttaggaaagaagtgaacatggacggtgagccaacccagtggagaatttttgacctcgacatctgcccaatgcgactcggaccgatg

SEQ ID NO: 6263 - DNA, 203 bp, Homo sapiens
  source 1..203: mol_type = other DNA
ggcgcgccagtcctaatgcccaggcattcttcctctacaagagtagactcgtccacgaaattgacagagccgaagcagtttctaacctcagtaaaggacggaccaacacaggacacgcagtgtcgagggggacaagcaagcttgcttggatgcatgagcgcggttacgttccactcaagggagttgtgcgactcggaccgatg

SEQ ID NO: 6264 - DNA, 203 bp, Homo sapiens
  source 1..203: mol_type = other DNA
ggcgcgccagtccttacagcataagggatgttggcacctcagctagtgccccaaatcatgttgtcaagcttctggcatggccttggttgaaaatagagaaagtcgtgttaatggccatgacggatacaactgcctttggacagcagagagtgtttaaagagaaagttgacaccaaagcacccgaacctcgactcggaccgatg

SEQ ID NO: 6265 - DNA, 203 bp, Homo sapiens
  source 1..203: mol_type = other DNA
ggcgcgccagtcctagtggagatgactgcgttgtcaacgctttggatgagaggtttggcaaagctctgacatggcttaacaccatggaaaaaacccgtaaagacatagaagcatggaaaccatcacgggcttatagaacctggcaggaagtcgagttttgctcacaccacttccatgagctttttctccgactcggaccgatg

SEQ ID NO: 6266 - DNA, 203 bp, Homo sapiens
  source 1..203: mol_type = other DNA
ggcgcgccagtcctcgagacggaaggaagctgatcgtcccgtgccgggaccagcatgaattggttggacggtcaatggtctcgcagggtgggagctctggagtggcagggacagcttgtctggccaaagcatacgcccagatgtggctgatgagctatttccataggagagacctcagaactcttggacgactcggaccgatg

SEQ ID NO: 6267 - DNA, 203 bp, Homo sapiens
  source 1..203: mol_type = other DNA
ggcgcgccagtcctcaggatttgtcatgctccagcctgatagacaacccaaccagagcgcagtgggcaaaactactcaaaggggctgtcatgaaagtgagagagatgataggccgagagcattactctgactacttgagcaatatgggtaggtaccaagaagggacggaagagttccacatgtggtaacgactcggaccgatg

SEQ ID NO: 6268 - DNA, 203 bp, Homo sapiens
  source 1..203: mol_type = other DNA
ggcgcgccagtcctgtatacgagtttagctcaatcctcgtatacaatattgggcgtcaccaaatatagatttggcataggcaacaccccgatgcgaaggccgaaaagggctaaccatgcccttagtaggactagcaaaaaatcggggactagcccaggtggtgagcttcctggatgaccgaagccctgcgactcggaccgatg

SEQ ID NO: 6269 - DNA, 203 bp, Homo sapiens
  source 1..203: mol_type = other DNA
ggcgcgccagtcctagtacagggcagtcgtcaacagttcaacacgcagaataggtttgcgtcttgatatgctgtgtggacgagggcatgcccacggtacatcttaacctatccgggggtcggataggcgaaagtccagtattggactgggagtacagcctgatagggtgttgcagagacccatctgatcgactcggaccgatg

SEQ ID NO: 6270 - DNA, 203 bp, Homo sapiens
  source 1..203: mol_type = other DNA
ggcgcgccagtcctccctcaccagcgaggaactagagacatacccactaggcttaaggacttgcccagaaaaggggattgtaggagtggcaacaacaagggcccagtgagtggggtttacataaagccagggccagtttactaccaagattactcaggccccgtctaccatagggccccattggaactcgactcggaccgatg

SEQ ID NO: 6271 - DNA, 203 bp, Homo sapiens
  source 1..203: mol_type = other DNA
ggcgcgccagtcctcttcgaggaatccaccatgtgtgaggtgacacgaaggctgggtagaaccactggcagtgatggacttctataccatgtatatgtatgtctagacgggtgtataataatcaagacagccagcagagcgcaacaaaaagtgctcaagtggaccaagaacaccctaaactgtcctttcgactcggaccgatg

SEQ ID NO: 6272 - DNA, 203 bp, Homo sapiens
  source 1..203: mol_type = other DNA
ggcgcgccagtcctgtcaggcatacaacacgccatgtatctcagaggggtgaacaggagcttacacggaatatggccagaaaagatatgcactgggatcccgacacacttggcaacagacactgagttaaaaagaatatcaggaatgatggatgcaagtgaggaaaccaattacacttgttgtaggttcgactcggaccgatg

SEQ ID NO: 6273 - DNA, 203 bp, Homo sapiens
  source 1..203: mol_type = other DNA
ggcgcgccagtcctgcagagacatgagtggaacaagcacggatggtgtaactggttcaacatagaaccctggatagcattgatgaacagaacccaagccaacttgacggaaggcccccccccgaaggagtgtgccgtcacatgcagatatgacaagaacacggaaactaacatcgtcacacaagctagcgactcggaccgatg

SEQ ID NO: 6274 - DNA, 203 bp, Homo sapiens
  source 1..203: mol_type = other DNA
ggcgcgccagtcctggacaggccaacgatgttaactggctgcaaaaaagggaagaacttctccttcgcaggtacggtgataaaggggccctgcaattttgacgtgtccctggaagacatcctgttcaaagatgaagggtgcggtaatatgatgcaggatgcagccatccaagaggtcgacggaatcaccgactcggaccgatg

SEQ ID NO: 6275 - DNA, 203 bp, Homo sapiens
  source 1..203: mol_type = other DNA
ggcgcgccagtccttaccgtttttatttttgaagaggtaagtcaggtcgtaaagctggtacttagggcattgagggacttaactaggatctggaatgctgcttcaaccactgcttttttgatatgtttagtcaaagtgttgaggggacaggtaatccagggcatagtgtggctcttactggttacgggcgactcggaccgatg

SEQ ID NO: 6276 - DNA, 203 bp, Homo sapiens
  source 1..203: mol_type = other DNA
ggcgcgccagtcctggcacaaggggcaataacttgtgaacccgaataccagtatgcactggcaaggagtaaaaggataggcccactgggagcagaggatctagtgacaacgtggcatgactacaaatttgacctgaaaatacaagaccccttagtaatggtgtattgtaaaaacgaccagttttttgtcgactcggaccgatg

SEQ ID NO: 6277 - DNA, 203 bp, Homo sapiens
  source 1..203: mol_type = other DNA
ggcgcgccagtccttggcaagaggtgcaaggcaggagaggccagatacctggccaagatacactggcgggccttgccaacttctgtggtcttcgaaaaggttctggaagaaaacccaccagaggaactaccactagaagataactttgaatttggactttgcccttgtgactctagaccagtcgtgaacgactcggaccgatg

SEQ ID NO: 6278 - DNA, 203 bp, Homo sapiens
  source 1..203: mol_type = other DNA
ggcgcgccagtcctgggcaatttcaataccaccttgatcaaccacagtgccttccaactagtctgccccataggatgggtgggaaccattgaatgcacgttggtcaacacggacacactagcaaccacagtagtcaagaggtatacaagaacaacccctttccctatgcgggctgggtgcgtggtgtacgactcggaccgatg

SEQ ID NO: 6279 - DNA, 203 bp, Homo sapiens
  source 1..203: mol_type = other DNA
ggcgcgccagtcctggggaaggctggttacaggtttgtgagtgaagaaccatgcaacagggaaggtgttgaaatctccacaaaaggcaagctcaagtgtataatagagaagacacaagtaaaggtatatgctgctgacaacaccttagggcctatgccttgcaaacccatggaaattatatcaagtgacgactcggaccgatg

SEQ ID NO: 6280 - DNA, 203 bp, Homo sapiens
  source 1..203: mol_type = other DNA
ggcgcgccagtcctattccttgtagtgagagatgaaccagtaaagaaatgggtaatctgtctataccactgcttaacaatgaagccaataaaaacagcagctgttctagtccttctgatgagtaacgtagtaaatggggaaggcgggagtaaagcaggggcaggaattgacttatacttcctcacaaccgactcggaccgatg

SEQ ID NO: 6281 - DNA, 203 bp, Homo sapiens
  source 1..203: mol_type = other DNA
ggcgcgccagtcctactagggatggtagtatttctggtgttggctaggagagaccccatgctcatccctttagtggtggctatagccacattcaagacaactaagtatactgctggcttcagtgtagatgtagctctggccgttctactcatagtgctccttatctgtagttacaccagtgattacttcgactcggaccgatg

SEQ ID NO: 6282 - DNA, 203 bp, Homo sapiens
  source 1..203: mol_type = other DNA
ggcgcgccagtccttaagtacagaaaactgctacaatgcctgcttagtataggggcagcagtgttccttataaggagcttgaaatggctaggtggagtcgggctaccatctattgagttgcccactcagaggcccctattctacatactggtgtatctgatcgctacagctttggtaacctcttggaacgactcggaccgatg

SEQ ID NO: 6283 - DNA, 203 bp, Homo sapiens
  source 1..203: mol_type = other DNA
ggcgcgccagtcctgtgtggaggaacagggccaccaatcagctgcgggatgaccctagcggactttgaagagagacattacaaaaggatattcataagagaagactcaatgaatacgatgatgtgcaaccgatgccagggaaagcataggaggtttgaaatggaccgggaacctaagagtgccagatacgactcggaccgatg

SEQ ID NO: 6284 - DNA, 203 bp, Homo sapiens
  source 1..203: mol_type = other DNA
ggcgcgccagtcctctgtgctgagtgtaataggctgcatcctgctgaggaaggtgacttttgggcagagtcaagcatgttgggcctcaaaatcacctactttgcgctgatggatggaaaggtgtatgatatcacagagtgggctggatgccagcgtgtgggaatctccccagatacccacagagtccccgactcggaccgatg

SEQ ID NO: 6285 - DNA, 203 bp, Homo sapiens
  source 1..203: mol_type = other DNA
ggcgcgccagtcctcgagcacctaggctgggtgctacgaggcccggccgtgtgcaagaagatcacaagtcatgaaaaatgccacacgggaattgccgacaagctgactgcattctttggaatcatgccgaggggtactacaccaagagctcccgtgaggttccctaacgcccttctaaagatcagacgcgactcggaccgatg

SEQ ID NO: 6286 - DNA, 203 bp, Homo sapiens
  source 1..203: mol_type = other DNA
ggcgcgccagtcctcatatttgaagcctctagtggtagagtagtcggtagggtcaaggtagggaagaatgaaggggccaaaccgactaaactgatgagtgggatacaaacagtgtccaagagcacggctgatatcacagagatggtaaaaaagatagtggcaatgaacaggggtgagttcaaacagatcgactcggaccgatg

SEQ ID NO: 6287 - DNA, 203 bp, Homo sapiens
  source 1..203: mol_type = other DNA
ggcgcgccagtcctgatgaaagaaggggacatggctacgggcataacatacgcatcctatggatacttctgccagatgccccaaccaaaactgagggcggccatggtggaatactcatatatcttccttgatgaataccactgtgctacagctgagcagttggcaatcatagggaagatacaccggttcgactcggaccgatg

SEQ ID NO: 6288 - DNA, 203 bp, Homo sapiens
  source 1..203: mol_type = other DNA
ggcgcgccagtcctaggcaacatgctagtcttcgtccccactagaaatatggcggtcgagacagcaaagaaattgaaagctaaagggtataattcaggttactactacagtggagaggacccggccaacctaaaagtagttacatcacagtcaccatatgtggtcgtggctacaaatgccatcgaatccgactcggaccgatg

SEQ ID NO: 6289 - DNA, 203 bp, Homo sapiens
  source 1..203: mol_type = other DNA
ggcgcgccagtcctatattacagaagccaagagacagccacaggctcaaaggactaccattatgatctgctacaagcccaaaggtatgggattgaagatgggatcaatgtaaccaagtcatttagggagatgaactatgactggagtttgtacgaggaggatagtttactgatcacccaattggaggtcgactcggaccgatg

SEQ ID NO: 6290 - DNA, 203 bp, Homo sapiens
  source 1..203: mol_type = other DNA
ggcgcgccagtcctcttcctgaacgctaggaaactaggtgaggatgtgcctgcatacatctatgccacggaagatgaagatttagccgtggacttactaggacttgactggcccgacccgggggtgcaaagtacaactgaaactagcagagctttaaagcaggtcatgggactatccacggctgagaacgactcggaccgatg

SEQ ID NO: 6291 - DNA, 203 bp, Homo sapiens
  source 1..203: mol_type = other DNA
ggcgcgccagtccttgctctactggtggccttgttcggatacgtgggctaccaagcactatccaaaagacacatacccattgtcacagacatatatactgtagaagaccacagattagaagacaccacacatctacaatttgcacccaacgcaataagaacagatgggaaggaaacagaattgaaagacgactcggaccgatg

SEQ ID NO: 6292 - DNA, 203 bp, Homo sapiens
  source 1..203: mol_type = other DNA
ggcgcgccagtcctcacatggttagcctacgtatttgtcgatgaagacgtgggcactataaaaccgtgtttaggtgagaaggtaatacctgaaaaaacaggtgacgtatctctccagagtgaggtcatcctcgacacaacatcggtcggaatctctgtagtgggaggcagtgacagggcaactactggcgactcggaccgatg

SEQ ID NO: 6293 - DNA, 203 bp, Homo sapiens
  source 1..203: mol_type = other DNA
ggcgcgccagtcctagatgtagatgtggttaaaacaaaagcaaaggaactgggggctacggatgacacaaagatagttaaagaggtgggggccaggacatatacaatgaagctgagctcctggtttacccagcagtcaaacaagcatcacagccttctccccctgtttgaggaggttttacttcagtgcgactcggaccgatg

SEQ ID NO: 6294 - DNA, 203 bp, Homo sapiens
  source 1..203: mol_type = other DNA
ggcgcgccagtcctcaccatgacgtctatagggatcaaacttgaaaagttgcctgttgtgagggcccaaacagatacaactagtttccatgatgctataagggacaagatcgataagaaagagaacctccagaaccccacactacatactaagctaaaggagatcttcaacaacctcagtagaccagacgactcggaccgatg

SEQ ID NO: 6295 - DNA, 203 bp, Homo sapiens
  source 1..203: mol_type = other DNA
ggcgcgccagtcctctatgaagggaagacgcctctcttcttgatatttgacaaagtgaagaaagaatgggatcaattccaggaccctgtcgcggtgagtttcgacaccaaggcatgggatacccaagtgacaagcagggacctggagttgattagagacatccaaaaatactattttaagagaaagtgcgactcggaccgatg

SEQ ID NO: 6296 - DNA, 203 bp, Homo sapiens
  source 1..203: mol_type = other DNA
ggcgcgccagtccttaggttcgaggacatagagttttgttcccataccccagtccccgtaagatgggctgaccacaccagcagctacatggcagggaggaacacagccacaatcctgtcaaagatggcaaccagattagattcaagtggagacagaggaacagcggcttacgagaaagctgtagcattcgactcggaccgatg

SEQ ID NO: 6297 - DNA, 203 bp, Homo sapiens
  source 1..203: mol_type = other DNA
ggcgcgccagtcctagggagcgggtacgtagtgcaaggcagacattatgaagagctaagtatcactaagagaccagatagacaaacaagtaacggtcttgagagatataacttgggacctatagtgaacttagtcctgaggagattgagggttatgctgatggcttctatcggcagaggcatctgagccgactcggaccgatg

SEQ ID NO: 6298 - DNA, 203 bp, Homo sapiens
  source 1..203: mol_type = other DNA
ggcgcgccagtcctagtaagcagctcccaatgtaacataatgtaaataaatgtgactttatgtaaatgcaaggcagtaagcagctcccaatgtaacataatgtaaataaatgtaactttatgtaaatgcaagtagagtagttagagttctaaggacatactacatagagacaacaactacctcattttcgactcggaccgatg

SEQ ID NO: 6299 - DNA, 203 bp, Homo sapiens
  source 1..203: mol_type = other DNA
ggcgcgccagtcctaatgtaacataatgtaaataaatgtaactttatgtaaatgcaagtagagtagttagagttctaaggacatactacatagagacaacaactacctcatttttaaaaacagcactttagctggaaggggatattccgacgtccactgttggtctaggaaaaaaccctgaaggcccccgactcggaccgatg

SEQ ID NO: 6300 - DNA, 203 bp, Homo sapiens
  source 1..203: mol_type = other DNA
ggcgcgccagtcctggatagtcgtcagtagttcaacgcaggcacggttctgccttgagatgctacgtggacgagggcatgcccaagacttgctttaatctcggcgggggtcgccgaggtgaaaacacctaacggtgttggggttacagcctgatagggtgctgcagaggcccacgaataggctagtatcgactcggaccgatg

SEQ ID NO: 6301 - DNA, 203 bp, Homo sapiens
  source 1..203: mol_type = other DNA
ggcgcgccagtcctaccgtagaaaatgctaggcaaggggctgcaaaattgacatcctggctagggaagcaattgggtataatggggaaaaaattagaacacaagagtaaaacgtggttcggagccaatgcacaatcaccttactgtaatgtaacaagaaaaatagggtacgtctggtacacaaacaatcgactcggaccgatg

SEQ ID NO: 6302 - DNA, 203 bp, Homo sapiens
  source 1..203: mol_type = other DNA
ggcgcgccagtcctgtattgttgtttgaagaggcaggacaagtagtgaagttggtactaagggccataagggacttgacaagggtctggaacagtgcatcaacaacagcctttcttatatgcctagttaaggtgttaagaggccaggtagtacagggactagtgtggctattactggtaactggtgcacgactcggaccgatg

SEQ ID NO: 6303 - DNA, 203 bp, Homo sapiens
  source 1..203: mol_type = other DNA
ggcgcgccagtccttacaaacaagacctgtaccattgccagatgggaggtaactggacgtgcatgagaggtgaagtagtcaaatatgtggggggtccagtaaagaagtgtgagtggtgcggctacgtgtttaagaagagagagggtctcccacactatccaattggtaggtgtatgctaagaaacgagcgactcggaccgatg

SEQ ID NO: 6304 - DNA, 203 bp, Homo sapiens
  source 1..203: mol_type = other DNA
ggcgcgccagtcctactggttacagaagcgtggatgacacaccatgcgatagaggtggagtcgtgatcagcaaaaccggtgagctggaatgcttaataggtaagactacagtgaaagtatttagctcggataaaaaattgggacctatgccatgcagaccaaaagaagtcatatccagtgaaggaccgcgactcggaccgatg

SEQ ID NO: 6305 - DNA, 203 bp, Homo sapiens
  source 1..203: mol_type = other DNA
ggcgcgccagtcctgtggtagccctgctaggggggaggtatgtcttatggttaatggttgtctacatgatcctggcagatcaaatgacctcagcaataaacctgggccaaggagaggtggttctgataggaaatttaataacacatgaggaccatgaggtggtagtatatttcctcctgttatacttacgactcggaccgatg

SEQ ID NO: 6306 - DNA, 203 bp, Homo sapiens
  source 1..203: mol_type = other DNA
ggcgcgccagtcctatagtgaaggatgagccagtaaagaagtggatattgttcctctttcatgctatgaccaacaaccctgtaaagacaatatcagttggactgctaatgttaagtgggctagtgaagggggaaggggcaggaatgacctactgggagggcctcgacctgcagtttaccttgctggtacgactcggaccgatg

SEQ ID NO: 6307 - DNA, 203 bp, Homo sapiens
  source 1..203: mol_type = other DNA
ggcgcgccagtcctatgataactgcatcactattagtggcaagaagggacgttaccacataccctttgataataacagtgatagcattaaagaccacctgggtgaatagtggcccggggattgatgcagcaatagcaacaatcacgactgggctattgatgtggacatttataagtgactactacaaacgactcggaccgatg

SEQ ID NO: 6308 - DNA, 203 bp, Homo sapiens
  source 1..203: mol_type = other DNA
ggcgcgccagtcctaaaagagtgtcagatgtttatgagatagatgaatcccaggaagccgtatatctgttcccctctaaacagaaggaagggacgatcacagggggtttgctaccactaataaaggccatactgatcagctgcattagtagcaagtggcagtgcttctacctcctatatctggtggtgcgactcggaccgatg

SEQ ID NO: 6309 - DNA, 203 bp, Homo sapiens
  source 1..203: mol_type = other DNA
ggcgcgccagtcctaaacataaggtgaggaatgaagtggtagcccactggttcaatgaggaagaggtctatgggatgcccaagctagtgagtgtagtgaaagcagcaacacttaaccggagcaggcattgtatactttgcacagtctgtgaaagcagagactggaaaggagagacctgtccgaagtgtcgactcggaccgatg

SEQ ID NO: 6310 - DNA, 203 bp, Homo sapiens
  source 1..203: mol_type = other DNA
ggcgcgccagtccttgccaaagtaataataggatgacagatgagactgaatatggagtgaaaacggactcaggttgcccagagggtgctaggtgctacgtgttcaaccccgaggcagtgaacatatcggggaccaaaggagccatggtacatctacagaaaacaggtggtgaatttacttgcgtgacccgactcggaccgatg

SEQ ID NO: 6311 - DNA, 203 bp, Homo sapiens
  source 1..203: mol_type = other DNA
ggcgcgccagtcctgacttaactgacatggtgaaaaagataacaacaatgaatagaggggagtttaagcagatcacactggccacgggtgcaggaaagactacagaattacctagggcggtgatagaagaaataggccggcacaaaagagtgttggtcttgataccactcagggcagcagcagagtcacgactcggaccgatg

SEQ ID NO: 6312 - DNA, 203 bp, Homo sapiens
  source 1..203: mol_type = other DNA
ggcgcgccagtcctgatgaataccactgtgcaacgcctgaacaattggccataataggaaaaattcacaggttttcagaacagttgcgagtcgtggcaatgacggcaacgcccgctgggacggtgaccactacagggcagaagcacccgatagaggaatttatagctccagaagtgatgaagggtgaacgactcggaccgatg

SEQ ID NO: 6313 - DNA, 203 bp, Homo sapiens
  source 1..203: mol_type = other DNA
ggcgcgccagtcctatgaattatgattggagtctatacgaagaagatagcctgatgatcacgcaactagaaatcctaaataacctattgatatctgaagaactaccagttgctgtgaagaacattatggccagaacagaccaccctgaaccaattcaactggcatacaacagctatgaagtccaagtacgactcggaccgatg

SEQ ID NO: 6314 - DNA, 203 bp, Homo sapiens
  source 1..203: mol_type = other DNA
ggcgcgccagtcctccagtgctgttccctaagatcaggaatggagaagtaacagacagctatgacagctattcgttcttgaatgccaggaaactgggcgacgatgtgccagcatacgtctacgccacggaagatgaagacttggcagtggagctacttggtatggactggcccgacccgggaaaccaacgactcggaccgatg

SEQ ID NO: 6315 - DNA, 203 bp, Homo sapiens
  source 1..203: mol_type = other DNA
ggcgcgccagtcctcatctgcagtttgcacccaacgcaattagaacggatggtaaagaaactgagctaaaagaactggcacaaggagacatccagaggtgtgcagaggcaatggttgggtacgcacagcaaggggtgcaattcatcaaaacccaagccctgaaggtgcaagagaatcatgtattcaaacgactcggaccgatg

SEQ ID NO: 6316 - DNA, 203 bp, Homo sapiens
  source 1..203: mol_type = other DNA
ggcgcgccagtcctgcttttgggggtgagtctataaacgaccacgtgaaacaggctgcaaccgacttagttgtatattacataatcaacagaccccaattcccgggagacactgagacacaacaggagggccggaaattcgtggctagcttactagtctcagccttggctacatacacctacaaaagccgactcggaccgatg

SEQ ID NO: 6317 - DNA, 203 bp, Homo sapiens
  source 1..203: mol_type = other DNA
ggcgcgccagtccttggaactatagcaatttatcaaaagtggtagagcctgcacttgcttgtctgccctacgcttcccaggcactcaaattgtttgctccaacgcgcctggagagtgtagtcatcctcagcacagccatttacaagacttacctggcaatcaggcgtggtaggagtgatggtctactgcgactcggaccgatg

SEQ ID NO: 6318 - DNA, 203 bp, Homo sapiens
  source 1..203: mol_type = other DNA
ggcgcgccagtcctgcggacaataggatcaggctcccccacgagaactaccttagagtcgtcaccaggtgcagatgtgggtaccggacgaaggcagtaaaaaactgtgcaggtgagttaatactggaggaggaagagggctcattcttctgcagaaacaaatttgggaggggagcacccaactacaaacgactcggaccgatg

SEQ ID NO: 6319 - DNA, 203 bp, Homo sapiens
  source 1..203: mol_type = other DNA
ggcgcgccagtcctaaaagatacacaggggctgggtacaaaggtgccttcctaggggatgaacccaaccacaaaagcctgatcgagaggacctgcgcaaccgtgtgcaaggataagatatacttttcaaagatgaagaaaggctgtgccttcacgtatgatctatctctaagcaacttggtaagattgcgactcggaccgatg

SEQ ID NO: 6320 - DNA, 203 bp, Homo sapiens
  source 1..203: mol_type = other DNA
ggcgcgccagtcctgtcgacttggttcacaggaacaagcttgaagagaaagatatcccggaacgaactgtaacaacgtggctggcgtatacattcgtcaatgaagacgtgggtaccatcaagccagtcctgggggagaaggtcataccggaagagagtgatgagataaatttgcaaccaacagtaacacgactcggaccgatg

SEQ ID NO: 6321 - DNA, 203 bp, Homo sapiens
  source 1..203: mol_type = other DNA
ggcgcgccagtcctgtgaatatgtctaagtgtcaggtaacagtggtaggcgaggccaaaaatatgaccaccggggtggttccactcacagtgaccaaagaggcatgtaatggtcaagaccggtcagttctaaacattggaatggaagaaggggaatacccgggccctgctgtaagcactgtcactgtgcgactcggaccgatg

SEQ ID NO: 6322 - DNA, 203 bp, Homo sapiens
  source 1..203: mol_type = other DNA
ggcgcgccagtcctggtgaagctgttcaaagtaaagatgtgcgcccatatgtattggtgataggttccaataaggcaacatcaaacagggcaaagacagctaagaacgttaagttgtataaaggaggagatgctgtcgaagtcagagacctaattaagaaaggggagatgctggtcgtagctttggcccgactcggaccgatg

SEQ ID NO: 6323 - DNA, 203 bp, Homo sapiens
  source 1..203: mol_type = other DNA
ggcgcgccagtcctcaagctgaaagaggggatgcaaacctcaaacccttatttgaagaacttctgctacagtgcccacccgggagaacagtcaaaggcggaaccatggtgtcggcataccagcttgcacaggggaactggacgccaactagctgtaaagtatacatggggactataacagcaaaaagacgactcggaccgatg

SEQ ID NO: 6324 - DNA, 203 bp, Homo sapiens
  source 1..203: mol_type = other DNA
ggcgcgccagtcctgtaaaaatacacccatatgaagcatatataaaattgaaggagcttatagaagagtacaacatgaaaagggtgactggagatacaggtctaaagagacataatgaatggatcttaaagagaatcaaacaccacgggaacctgaggactaagaaaatactgaacccaggtaaagtacgactcggaccgatg

SEQ ID NO: 6325 - DNA, 203 bp, Homo sapiens
  source 1..203: mol_type = other DNA
ggcgcgccagtcctaaaaacaaggtagaggacataattagagatttaaaatctggaagacctatcaagtattacgaaactgcaatcccgaaaaatgagaagagagatgtcaatgatgattgggagagcggcgattttgtagatgaaaagaaaccgagagtgatacagtacccagaggccaaagtcaggcgactcggaccgatg

SEQ ID NO: 6326 - DNA, 203 bp, Homo sapiens
  source 1..203: mol_type = other DNA
ggcgcgccagtcctaattggctggtaaacgcagataggccggagagcagaaaaacaggaaaggtctacttgcaaagtggaggccataccgtaagagggaggcattatgaagacctgatattgcctaggatggtgaaaccaacatttcaaggagtagacagatacaaattgggacccatagtcaacgtacgactcggaccgatg

SEQ ID NO: 6327 - DNA, 203 bp, Homo sapiens
  source 1..203: mol_type = other DNA
ggcgcgccagtcctaataagtcgcgaccagcaacgagcccaatgccaaagggcttcgtgctgtcgcgcatgctggggattctttggcacgccgtgacaggcacggccagacccccagtgctgaaaatgttctggaaaacggtaccactgcgccaggcggaggctgttctgaagaagataaagagagttcgactcggaccgatg

SEQ ID NO: 6328 - DNA, 203 bp, Homo sapiens
  source 1..203: mol_type = other DNA
ggcgcgccagtcctgtcagggtacaaaacggaacgtgcgtcatcctggcaacagacatgggagagtggtgtgaagattcaatcacctactcttgcgtcacgattgaccaggaggaagaacccgttgacgtggactgcttctgccgaggtgttgatagggttaagttagagtatggacgctgtggaaggcgactcggaccgatg

SEQ ID NO: 6329 - DNA, 203 bp, Homo sapiens
  source 1..203: mol_type = other DNA
ggcgcgccagtccttggctcatggttgatagttggatggccagagtgactgtcatcctcttggcgttgagtctagggccagtgtacgccacgaggtgcacgcatcttgagaacagagattttgtgacaggaactcaagggaccaccagagtgtccctagttttggaacttggaggctgcgtgaccatccgactcggaccgatg

SEQ ID NO: 6330 - DNA, 203 bp, Homo sapiens
  source 1..203: mol_type = other DNA
ggcgcgccagtcctacagctgagggcaagccatccattgatgtatggctcgaagacatttttcaggaaagcccggctgaaaccagagaatactgcctgcacgccaaattgaccaacacaaaagtggaggctcgctgtccaaccactggaccggcgacacttccggaggagcatcaggctaatatggtgcgactcggaccgatg

SEQ ID NO: 6331 - DNA, 203 bp, Homo sapiens
  source 1..203: mol_type = other DNA
ggcgcgccagtcctacggtgctggggggagctttcaacaccctttttgggggggttggattcatccctaagatgctgctgggggttgctctggtctggttgggactaaatgccaggaatccaacgatgtccatgacgtttcttgctgtgggggctttgacactgatgatgacaatgggagttggggcacgactcggaccgatg

SEQ ID NO: 6332 - DNA, 203 bp, Homo sapiens
  source 1..203: mol_type = other DNA
ggcgcgccagtcctgattatggatgtgccattgacccagaaaggatggaaatccgctgtggagaagggcttgttgtgtggaaagaggtgtcggaatggtatgacggctacgcctatcacccagaatcacctgacacgcttgcacaggctctcagagaggcctttgagagaggcgtttgtggggtcgtgcgactcggaccgatg

SEQ ID NO: 6333 - DNA, 203 bp, Homo sapiens
  source 1..203: mol_type = other DNA
ggcgcgccagtcctccccaaaacagacttgaaatggccatgtggagaagcactgctccggaactcaacttggtgctgagtgagggagaagcaaacttgaccatcgtggtagacaaaacagatccggcagactataggggaggcactcccatggttctaaagaagactggaaaagagagcaaggtgtcccgactcggaccgatg

SEQ ID NO: 6334 - DNA, 203 bp, Homo sapiens
  source 1..203: mol_type = other DNA
ggcgcgccagtcctgaagcttcaaaagagtgtgacacaggagtgatgggagcagccgtgaagaatggaaaagccatccacacggaccaaagtatgtggatgagctcctttcggaatgacacgggcacgtacatccatgagcttattctcactgatctcaggaactgcacatggccagcaagtcacactcgactcggaccgatg

SEQ ID NO: 6335 - DNA, 203 bp, Homo sapiens
  source 1..203: mol_type = other DNA
ggcgcgccagtcctgaggagatcgtgcgctatgtcatagcagttggggtcactttccacttggaattgggaccagagaccatggttcttgtgatgctgcaggcggtcttcaacatgcgcacatgttatctcatggggtttcttgtcaagagggtgatcaccacacgtgaggtggtgactgtttacttccgactcggaccgatg

SEQ ID NO: 6336 - DNA, 203 bp, Homo sapiens
  source 1..203: mol_type = other DNA
ggcgcgccagtcctggagtggtggagtggaaccctgagttggtcaatgagggaggtgaggtaagcttgaaggtcagacaggatgccatggggaacttgcacttgacagaggtggaacgggaggagcgtcgtttggccttatggcttgtgttcggcctactggcatcggcttatcattggtccggaatacgactcggaccgatg

SEQ ID NO: 6337 - DNA, 203 bp, Homo sapiens
  source 1..203: mol_type = other DNA
ggcgcgccagtcctgtacacgcattccctccggacagtggacacaaaatccatcaatgccagccaggaaagctgaaccttgagggggggagagttctgggggccatcccgatagacctcccacgtggtacttcaggtagcccaatcatcaatgcacagggagatgtgctgggtctgtacggcaatggtcgactcggaccgatg

SEQ ID NO: 6338 - DNA, 203 bp, Homo sapiens
  source 1..203: mol_type = other DNA
ggcgcgccagtcctgtcaaccgccggctcttgccacaagggagacagaactgggaggtggccataatggatgaggcacattggaccgacccacacagcatagctgcccgaggccatctttactccttggccaaggagaacagatgtgcactcgtgctgatgactgctaccccacctggcaagagcgagcgactcggaccgatg

SEQ ID NO: 6339 - DNA, 203 bp, Homo sapiens
  source 1..203: mol_type = other DNA
ggcgcgccagtcctgcgttccctgaatccaaaggagccatagtgagtgaggaaaaacccattcccgaaggagagtggagagatggctttgattggataacagaatttgagggtcgaacagcctggtttgtgccatcgatagccaagggaggcgccatagcacggacactgagacagaaagggaaaagccgactcggaccgatg

SEQ ID NO: 6340 - DNA, 203 bp, Homo sapiens
  source 1..203: mol_type = other DNA
ggcgcgccagtcctttgattggcacgagacgagtgacgacagcatcagctgcgcaacgcagagggcgagttggaaggcatgaaggacgcacggacctctatgtgtattctgggcagtgtgatgatgatgacagctccttagtgcagtggaaagaagcgcagattctgcttgacaacattactacagtgcgactcggaccgatg

SEQ ID NO: 6341 - DNA, 203 bp, Homo sapiens
  source 1..203: mol_type = other DNA
ggcgcgccagtcctcggaaatggacctgggaaggtcccgacgagaatgccattgatggtccaggcggcgaactggtcacgttcagaagccccaatggagcggaacggaagctgaagccaatctggaaggacagtagaatgttccgggaggggagagatgtggcagacttcatccagtacgcttccggtcgactcggaccgatg

SEQ ID NO: 6342 - DNA, 203 bp, Homo sapiens
  source 1..203: mol_type = other DNA
ggcgcgccagtcctctcacggtactgcaaccagaaccgggaaagcagcgtagtggagaggataaccgactggccttcctgttgattggactggggagcgtggtgggccttgtggcagccaatgagctgggctatctggaacaaacgaaaactgacatttcaggactctttagacgtgaggaccagggacgactcggaccgatg

SEQ ID NO: 6343 - DNA, 203 bp, Homo sapiens
  source 1..203: mol_type = other DNA
ggcgcgccagtcctgggatggtttgggacgcatggacgaacatcgacatacagcctgcccgatcctggggaacttatgtgctcattgtctccctctttactccatatatgctccatcagctacaaacaaaaatccagaggctggtgaacagctcagttgcagcgggaacacaggccatgagagaccttcgactcggaccgatg

SEQ ID NO: 6344 - DNA, 203 bp, Homo sapiens
  source 1..203: mol_type = other DNA
ggcgcgccagtcctgggggaggcaccccattctttggtgtagctggacatgtcgtggcactcggtgtgacctctttggtaggagcgacgcccacctcccttgcattgggtgttgccttggctgccctccatttggccgtggtcacatctgggctggaggctgaactgacccagagggcgcaccgggcacgactcggaccgatg

SEQ ID NO: 6345 - DNA, 203 bp, Homo sapiens
  source 1..203: mol_type = other DNA
ggcgcgccagtccttttttctcagccatggtaaagaatccaatggtggatggagagatcatcaaccccattccggatggagacccaaaaccagctttgtatgagaggaagatgagtttgtttctcgccatcggcctgtgcatagcggccgtagccttgaacaggactgccgcggcgatgacagaagctcgactcggaccgatg

SEQ ID NO: 6346 - DNA, 203 bp, Homo sapiens
  source 1..203: mol_type = other DNA
ggcgcgccagtcctgagggaagcacccttggtgacatttggaagcagcggctgaactcatgcaccaaagaagaattttttgcctacaggcgcacaggggtcatggagacaaaccgagaccaagctcgtgaattgcttcgccgaggtgagactaacatggggttggcagtatcgcgaggctgtgccaaacgactcggaccgatg

SEQ ID NO: 6347 - DNA, 203 bp, Homo sapiens
  source 1..203: mol_type = other DNA
ggcgcgccagtcctccctcaccccaagggggatgtgtgatggacgtgatcacaaggagagaccagaggggatcaggacaggtcgtcacatacgccctcaacaccatcacaaacatgaaagtccaactcatccgcatgatggaaggagaaggagtcataggaccagctgactcacaggaccctcgtctgcgactcggaccgatg

SEQ ID NO: 6348 - DNA, 203 bp, Homo sapiens
  source 1..203: mol_type = other DNA
ggcgcgccagtcctgcgtacgggcagatgtggcttctcaactactttcatcgcagagaccttcgcacccttggtttcgccatatgttctgctgttcccgtgagttgggttcccatgggtcgcaccacttggagcatccacgcgagtggtgaatggatgacaacagaagacatgctgcgcatctggaaccgactcggaccgatg

SEQ ID NO: 6349 - DNA, 203 bp, Homo sapiens
  source 1..203: mol_type = other DNA
ggcgcgccagtcctgcctcctggaaggctcaccaggagttaggccgtttaggagcccccgagcataactcgggaggagggaggaagaaaattggcaatcttcctcgggatttttccgcctcctatactaaatttcccccaggaaactgggggggcggttcttgttctccctgagccaccaccatccagcgactcggaccgatg

SEQ ID NO: 6350 - DNA, 203 bp, Homo sapiens
  source 1..203: mol_type = other DNA
ggcgcgccagtcctaactcgggaggagggaggaagaaaattggcaatcttcctcgggatttttccgcctcctatactaaatttcccccaggaaactgggggggcggttcttgttctccctgagccaccaccatccaggcacagatagcctgacaaggagatggtgtgtgactcggaaaaacacccgctcgactcggaccgatg

SEQ ID NO: 6351 - DNA, 203 bp, Homo sapiens
  source 1..203: mol_type = other DNA
ggcgcgccagtccttcgacgagcgtcgaaagtggccccaaagaagacgcgtcagttgcgggtccaaatgccaaatggacttgtactgatgcgcatgctgggagttctgtggcatgccctgactgggactgcacgaagcccagtactgaaagcgttttggaaagtcgttcctttgaagcaggctactctcgactcggaccgatg

SEQ ID NO: 6352 - DNA, 203 bp, Homo sapiens
  source 1..203: mol_type = other DNA
ggcgcgccagtcctggcactgcgtaagatcaagagaacggtgagcaccctcatggtaggcctgcaccgccgaggaagtagaaggacgaccattgactggatgactcccttgttgatcactgtcatgcttggaatgtgcctcacggcaactgtccgtagagagagagatgggtcaatggtgattcgtgccgactcggaccgatg

SEQ ID NO: 6353 - DNA, 203 bp, Homo sapiens
  source 1..203: mol_type = other DNA
ggcgcgccagtccttgaagggcgagatgctgcaacccaggttagagtggagaatggcacttgtgtcattcttgctacagacatgggatcatggtgtgatgactcgttggcttacgaatgcgtgaccattgaccagggagaggaacccgttgatgtagactgcttttgcagaggtgttgagaaggtgaccgactcggaccgatg

SEQ ID NO: 6354 - DNA, 203 bp, Homo sapiens
  source 1..203: mol_type = other DNA
ggcgcgccagtcctactggagtatggacgttgtggaaggcgtgaaggttcacgttccaggcgctccgtgctgattccgtcacacgcacagcgtgacctgaccgggcggggacaccaatggctcgagggagaggctgtgaaggcacacctgacccgcgttgagggttgggtgtggaagaacaaattgttcgactcggaccgatg

SEQ ID NO: 6355 - DNA, 203 bp, Homo sapiens
  source 1..203: mol_type = other DNA
ggcgcgccagtcctgatgcagctccctcctggagataacataatctatgttggtgacctgaaccatcagtggtttcagaaggggagcagcatcggcagggtcctccagaagaccaggaaggggattgagagactcaccgtccttggagaacatgcttgggactttggctcagtgggaggtgtcatgaccgactcggaccgatg

SEQ ID NO: 6356 - DNA, 203 bp, Homo sapiens
  source 1..203: mol_type = other DNA
ggcgcgccagtcctcatgactctgggggttggagccgatgtgggctgcgcagtggacacagagcgaatggagctccgatgtggagaaggactggtggtatggagagaggtgtcagaatggtacgacaactacgtgttccacccagagactccggcggttctggcatcggcagttcagagggcctatgacgactcggaccgatg

SEQ ID NO: 6357 - DNA, 203 bp, Homo sapiens
  source 1..203: mol_type = other DNA
ggcgcgccagtcctagaggaaatctgtggcattgtccctcaaaatagactggagatggccatgtggagaagctctctagtggagctcaacctggctctagcggagggtgaggcaaacctgactgttgtggtcgacaaggcagaccccagtgactacagggggggcgttcccgggctccttaacaagggcgactcggaccgatg

SEQ ID NO: 6358 - DNA, 203 bp, Homo sapiens
  source 1..203: mol_type = other DNA
ggcgcgccagtcctaacccgagtgaccattgacaaggcatgtgacaagagaggggcgtcggtgagaagcactacagagagtgggaaagtcatacccgaatggtgctgtcgcacctgtgagctgcccccggtcacatatcgcactgggactgattgttggtatgccatggagattaggccggtacacaccgactcggaccgatg

SEQ ID NO: 6359 - DNA, 203 bp, Homo sapiens
  source 1..203: mol_type = other DNA
ggcgcgccagtcctgacgggactagtctctgtggagagtctgtttcgttaccttgtagcagtcggtctggtgtttcagctggaactgggaccagaggctgtggctatggtgcttctacaggcagtttttgagatgagaacgtgtctactgagtgggtttgtgcttcgtagaagcataaccacgagagacgactcggaccgatg

SEQ ID NO: 6360 - DNA, 203 bp, Homo sapiens
  source 1..203: mol_type = other DNA
ggcgcgccagtcctaattgtgacagtgtacttcctcctcctggtgttggagatgggcattccagtgaagggtctggagcatctctggagatggactgatgcgctggcgatgggggccatcatcttcagggcatgcactgcagaggggaagacaggcattggtttgcttttggctgcattcatgacccacgactcggaccgatg

SEQ ID NO: 6361 - DNA, 203 bp, Homo sapiens
  source 1..203: mol_type = other DNA
ggcgcgccagtcctctttcactggtcggggatccttatcgtcatgggactgtggaccatttcggagatgcttggctcacccaggagaacggatcttgtgttttcaggatgctccgaagggcgaagtgacagccgtccgctcgatgtaaaaaatggagtgtaccgcatatatactccaggcctgctctgcgactcggaccgatg

SEQ ID NO: 6362 - DNA, 203 bp, Homo sapiens
  source 1..203: mol_type = other DNA
ggcgcgccagtcctgggacaaagacagattggagtgggctacggggcaaagggtgtgctacacaccatgtggcatgtcactaggggggctgccctgctggttgatggagttgcagtgggcccctactgggctgatgtgcgggaggatgtggtttgttatggaggcgcctggagtctggaaagcaggtgcgactcggaccgatg

SEQ ID NO: 6363 - DNA, 203 bp, Homo sapiens
  source 1..203: mol_type = other DNA
ggcgcgccagtccttggcctgtatggaaacggcctcaagactaatgacacgtatgtcagcagcatagcacagggtgaagtggaaaaaagtagaccaaatctcccacagtcagtagttggcacgggctggacagccaagggacagatcacggtgttggatatgcaccctggctcggggaagacccatcgcgactcggaccgatg

SEQ ID NO: 6364 - DNA, 203 bp, Homo sapiens
  source 1..203: mol_type = other DNA
ggcgcgccagtcctgtgccatgctacatatgtcaacagaagactcctcccacaggggagacaaaactgggaggtggctatcatggatgaggctcattggactgacccccacagtatagcggccagaggacacctctactcccttgccaaggaaaacagatgtgctttcgttctcatgacggcaacacccgactcggaccgatg

SEQ ID NO: 6365 - DNA, 203 bp, Homo sapiens
  source 1..203: mol_type = other DNA
ggcgcgccagtcctaccggggaagagtgaaccctttcctgagtccaacggagccatagccagtgaggagagacagatccctgatggggagtggcgggacgggtttgactggatcacagagtatgagggtaggacagcctggttcgttccgtcaattgccagaggaggagccatagcaagggctttgagcgactcggaccgatg

SEQ ID NO: 6366 - DNA, 203 bp, Homo sapiens
  source 1..203: mol_type = other DNA
ggcgcgccagtcctgcagcgagggaagagtgtcatttgcttaaacagcaagacctttgacaaggagtactcaagagtgaaggatgaaaaacccgactttgtggtgaccacggacatatcagagatgggggcgaatcttgatgtcacccgcgtcattgatggccggacaaacatcaaaccggaggaggtcgactcggaccgatg

SEQ ID NO: 6367 - DNA, 203 bp, Homo sapiens
  source 1..203: mol_type = other DNA
ggcgcgccagtcctggacggcaggatcgaactcacagggacgagacgtgtgacaaccgcgtctgctgcacagcgcaggggaagagtgggcaggcaggggggtcgcacagatgaatacatatactcaggccagtgtgatgatgatgacagtggtcttgtgcagtggaaagaggcccagatactcttggacgactcggaccgatg

SEQ ID NO: 6368 - DNA, 203 bp, Homo sapiens
  source 1..203: mol_type = other DNA
ggcgcgccagtcctcctgacggcagtggagatgcttgtcctggggcttgcaaccctgggagttgtctggtgttttgttgtgcgcacctcggtcagtaggatggtgttggggaccctagttctcgccacctcactgatcttcctgtgggccggaggtgttggctacgggaacatggctggggtggcactcgactcggaccgatg

SEQ ID NO: 6369 - DNA, 203 bp, Homo sapiens
  source 1..203: mol_type = other DNA
ggcgcgccagtccttagagaccaaggggagactgtgcgatggggggagtggaccaatttggacatccagccggcaagatcatggggcacatatgttctggtggtatctttgttcaccccctatatgctgcaccaattgcagacaagaatccagcagttggtgaacagtgcagtggcttcaggagcccacgactcggaccgatg

SEQ ID NO: 6370 - DNA, 203 bp, Homo sapiens
  source 1..203: mol_type = other DNA
ggcgcgccagtcctggcagttactgaggcaggagccgtgggagtggctgcagcaatgcagttgctgagacctgagatggacgttttgtggactatgcctgtggcctgtggcatgagtggagtggtcaggggaagcctgtggggccttctgccactcggccacagactgtggctccggaccactgggaccgactcggaccgatg

SEQ ID NO: 6371 - DNA, 203 bp, Homo sapiens
  source 1..203: mol_type = other DNA
ggcgcgccagtcctcatggtaaccagcctcgggtggaacctgataaaattcagagcaggcatggatgtgttctcaatggagcctcatcgagcagatgcaatcctatgtgacataggggaaagcaatccagacgcagtggtggaaggagagagatcacggcgtgtgattcttcttatggagcaatggaacgactcggaccgatg

SEQ ID NO: 6372 - DNA, 203 bp, Homo sapiens
  source 1..203: mol_type = other DNA
ggcgcgccagtcctaaatcgcaatccaacagcgacatgtgtgttcaaggtcttggctccttatcgtcccgaggtaatagaggcactgcacaggttccaacttcaatggggagggggtcttgtgaggacacctttttcccgaaattccacccatgaaatgtacttctcaactgccatcacggggaacatcgactcggaccgatg

SEQ ID NO: 6373 - DNA, 203 bp, Homo sapiens
  source 1..203: mol_type = other DNA
ggcgcgccagtcctggcctgtctatcgaaggcttacggacaaatgtggctgttgagctacttccacaggagggacttgaggactctggggttcgccatatgttcggcagtgcccgtggactgggtcccaacaggaagaacaacctggagcatacatgcaagtggtgcctggatgacaaccgaagacatcgactcggaccgatg

SEQ ID NO: 6374 - DNA, 203 bp, Homo sapiens
  source 1..203: mol_type = other DNA
ggcgcgccagtcctgcaagtcaacaggagatgataactcgtacgagctgatctccaacacacaagaaaaatggtgggatgcggcaacgcacgaggctcgtgacggggaaatgatcgctcccgacgcacccctccattggagacaacttcgtgagatcccccaggtgtttaggggcacacgcctgaggtcgactcggaccgatg

SEQ ID NO: 6375 - DNA, 203 bp, Homo sapiens
  source 1..203: mol_type = other DNA
ggcgcgccagtcctgcaaaatgggtacgtagttaaccactgcgtatcaggattgcaggccacgaagggtatttgcatatctttctatgcggtattacggcttaaaacccgttgtatcttgtagtttgactgcctgtatcactagtggccattttatttaggttagagacccctgatagtaggagagttcgactcggaccgatg

SEQ ID NO: 6376 - DNA, 203 bp, Homo sapiens
  source 1..203: mol_type = other DNA
ggcgcgccagtcctacaaactctttaaaaattgttgaccccggaaaagatggtgacccctgtaagtagttgatctagaagatctatgcgctggcatagtaatccagtgtttcctgttttaggatgacctctgaaagtagatgaccgtggaaagtcacgtagtgccccaataagcacgtttgggcagcgcgactcggaccgatg

SEQ ID NO: 6377 - DNA, 203 bp, Homo sapiens
  source 1..203: mol_type = other DNA
ggcgcgccagtcctgttatggcaactgtatcagaacaatggagtcaggttaaaggaaaagttttgaaacttttcttaattttagtcaaatttttaactggtttattactcgtttctctaggtcttaaaattttaaaggatttatccgcattaagtgtaattaaaacatttttatttttactctttggtcgactcggaccgatg

SEQ ID NO: 6378 - DNA, 203 bp, Homo sapiens
  source 1..203: mol_type = other DNA
ggcgcgccagtccttggttccgtagttctgttattttagcgtcttccaatcttaccgcagagaacttgcaatcgaaagttcattcgttaaactaccctgtagctttacttaggagatttgatttagttgtagaagtagaaatagcccctggttgtactaagcctcgtgctggacaacctttttccaaacgactcggaccgatg

SEQ ID NO: 6379 - DNA, 203 bp, Homo sapiens
  source 1..203: mol_type = other DNA
ggcgcgccagtcctgtgcgaaaacaagtaatgaaggcaaaggaggaatctcatttaacaatagaaccatcggaaaataatcttttggctacacaaggttggttaagttggtttgtagatagctatgaggaagaaaatgatcttgggtatgataacttcttcgatgaagttgttacacccgaccaatatcgactcggaccgatg

SEQ ID NO: 6380 - DNA, 203 bp, Homo sapiens
  source 1..203: mol_type = other DNA
ggcgcgccagtccttctcaagaaaaacttggcgctattccacacgtgaaaattgagcaaagtgtttttaacgccacagaggacagtgtgaatatgcagtgtaatggtaatgtagagaacttagcgctacagaattattattccaaagttaatgaaatgttgactgtggaaggatgttcagatcagaatcgactcggaccgatg

SEQ ID NO: 6381 - DNA, 203 bp, Homo sapiens
  source 1..203: mol_type = other DNA
ggcgcgccagtcctgaatatggatctaattataaatatgaatctcgatatccttttgaaacagcgtgtgaaggaattgacagtgaccctactttcaattcaataaaaaggaaaacttcagctggatatccattgtgttctaaagttaagaatggcaaacaagaaatatttgggagtgatggtcccttccgactcggaccgatg

SEQ ID NO: 6382 - DNA, 203 bp, Homo sapiens
  source 1..203: mol_type = other DNA
ggcgcgccagtccttctctcccctcaggacacttcctaacttccattattaatagtatttttgtaaatatagctatgtgttatgcgtttgtagaatctcaagaaaagggaaatagatctgaggagaacatacgtgttttcttcaacgatttctctatagtaacttatggggatgaccacgtaattggtcgactcggaccgatg

SEQ ID NO: 6383 - DNA, 203 bp, Homo sapiens
  source 1..203: mol_type = other DNA
ggcgcgccagtcctttagaacccataaattggtctaatttctttattaaagtgtatagtccattagtaagtaagcagacagaccagctagatctcgtattatgggctagatttaaggatataaaattaggttacccaactgtattacctgttaagacccctactacagatttaattttgcagtcaggacgactcggaccgatg

SEQ ID NO: 6384 - DNA, 203 bp, Homo sapiens
  source 1..203: mol_type = other DNA
ggcgcgccagtcctcctaattatatagatagtttttcatatagtagtacaataacctccccaactaccatttggtcgactcatttgtgtcctttcttcctttcgaagacggacatacaaggccaccctcaacccacgcttttgtattatttgtccaacttcttcttatactggagaggttctttaaaacgactcggaccgatg

SEQ ID NO: 6385 - DNA, 203 bp, Homo sapiens
  source 1..203: mol_type = other DNA
ggcgcgccagtcctgaggttagcggaggtgatgactttgaattacaagctcccatcaatgaagggtgggtaggctttgattcggcgtcatcttctcaactaaccttacaatccggagatacttttggttcaacgggcattagagacagtagagtcaatactgtggacaataaagtagattttcaaagtcgactcggaccgatg

SEQ ID NO: 6386 - DNA, 203 bp, Homo sapiens
  source 1..203: mol_type = other DNA
ggcgcgccagtcctcatctagaatgaacacagaatttctccggacaatgacatccaaccctaagtgtaatagcgaagtgattcaatactatacgacaagaactgatactcaaaaatcagacgtaagtttagccttcatgaacttgaagcctttatttacagcttagtacctgccgcgtccgtgtgggacgactcggaccgatg

SEQ ID NO: 6387 - DNA, 203 bp, Homo sapiens
  source 1..203: mol_type = other DNA
ggcgcgccagtcctttttcttagggcctttttcacctgggtaaagtgtagttattgcgtataactctggtatcaataccacccggaagaaattatttatctgccatcatgtctcaattaatccaaaccaaaatctctagttataagaattatgttaaccagaaaattaaggaaggaaggtccaacatccgactcggaccgatg

SEQ ID NO: 6388 - DNA, 203 bp, Homo sapiens
  source 1..203: mol_type = other DNA
ggcgcgccagtcctcaccccttgcttcgggcaactccgaattttgtggaagatgttgaatcggatttgaaaaatttgaatgaagcaatccggactacagatgtttttaaaaattatgttgttgagttgacactaggtcatcaagatctcgattttggctattttaagctatacaatcgtgatcttgagcgactcggaccgatg

SEQ ID NO: 6389 - DNA, 203 bp, Homo sapiens
  source 1..203: mol_type = other DNA
ggcgcgccagtccttatgaatctccaaatgtaaaacctgtaagagttgaaatgagcttcccaagtggaagagtttctggttccgagatgaatcttgcttctttacaacttgataattatatcaaggaagtgaaggagcagggtgtctccgaccagaatgctgccgaaatttgttcgaagctcgtaacacgactcggaccgatg

SEQ ID NO: 6390 - DNA, 203 bp, Homo sapiens
  source 1..203: mol_type = other DNA
ggcgcgccagtcctgcggcgagtcaagtgctcctcaacgtctccagagatatgctcggatcgactgaagaagatctgcttgttatgcaagtacttctggaatccctcctctcaagtgttcatctcaataataattatgtatatatgtggttgaaaggtctcccttcaggacactttttgacagctattcgactcggaccgatg

SEQ ID NO: 6391 - DNA, 203 bp, Homo sapiens
  source 1..203: mol_type = other DNA
ggcgcgccagtcctgccagtttgtttaagcaaattggattgtcatatactttggaggataaagatgcgactgtgaatgctccgtatcggagtttgaatgaagtgtcttatctcaagagaaaatttctctgggatgaagacaagcgtcaatacttggcccctttgagtttagagactattctcgaaactcgactcggaccgatg

SEQ ID NO: 6392 - DNA, 203 bp, Homo sapiens
  source 1..203: mol_type = other DNA
ggcgcgccagtcctgccagaagctttgtgctcaacgaaaatgtgtgatctgattagaagtaagaaaattcctagttataatatttttaatactgctacatttttaagacccttagttatttagctttaccgcccaggatggggtgcagcgttcctgcaatatccagggcacctaggtgcagccttgtacgactcggaccgatg

SEQ ID NO: 6393 - DNA, 203 bp, Homo sapiens
  source 1..203: mol_type = other DNA
ggcgcgccagtcctcgataatgctcctgtaattgattcttcaatcgcaggggaaacgaatctcaaacctagtttagtaacggatttccatgataatagacaacatagtgttatttcctttcttcaacgtcctcagttgatcaaaactgttgaatgggctcctggaactgctcagggatccttgttgaccgactcggaccgatg

SEQ ID NO: 6394 - DNA, 203 bp, Homo sapiens
  source 1..203: mol_type = other DNA
ggcgcgccagtcctaaccattgacatacctgatgatcttatgacatctatggtatatgacaagttagatggtttcgccactttcaaggcggatactatcttccgtgttcaagtcaatgctcagccatttcaatgtggccgtcttgtgatggcttacattccaatgcctgattcgttgtcgaccaggaccgactcggaccgatg

SEQ ID NO: 6395 - DNA, 203 bp, Homo sapiens
  source 1..203: mol_type = other DNA
ggcgcgccagtcctcgctgagttgaccagggcgatagatcgcattattgcactaccgcatgttcaactcgacattagtgaacaatctgaggttacactgcgagtaccatatatctccccctactctgcctacaatttaattgaaggaagatataggtggggacgtgtggttgttgccgtgtattcccccgactcggaccgatg

SEQ ID NO: 6396 - DNA, 203 bp, Homo sapiens
  source 1..203: mol_type = other DNA
ggcgcgccagtccttttcccaactaaaatagctgctagcatcaacggtgtaattcagaaaggttctgatatcttgggtaatgttttaccgcagactaagagttttaccaacccagttgctaaaatttcagatgctgcgtttgacattatttccatgataccaggatttaagaaacctgataaaactaacgactcggaccgatg

SEQ ID NO: 6397 - DNA, 203 bp, Homo sapiens
  source 1..203: mol_type = other DNA
ggcgcgccagtccttcacggtgaaactgtacttttccgaccaacacagtactttggtaatgttgatggtgtagagcattctcataaacttggatatcatgcgatgaatcgcattgatttccaacctgatttcgctggtagtaagatggatgaaatgtcatttgattatgttaaacgcataccaaattacgactcggaccgatg

SEQ ID NO: 6398 - DNA, 203 bp, Homo sapiens
  source 1..203: mol_type = other DNA
ggcgcgccagtcctcattgattcattttcctattcgaattcaaatgtttatggtgatactctgtggtcaactgcagtttcgccttgttatagatctgccgattatacaacaacaaatggtgctagaaatttttcatttcctacccctacttctcttacttatgcaataggacctttctctttgtggagcgactcggaccgatg

SEQ ID NO: 6399 - DNA, 203 bp, Homo sapiens
  source 1..203: mol_type = other DNA
ggcgcgccagtcctcaccgtgccttatgctgggactacccctttcaaacgcattagacctgaaatcaaccctctttcctcttctggaattagtgttgatgatttcaatgtgtttgcaacgggtgttcttggtgtaagagcccttactcccttagttttaggatcaactgttgtaccatccacaattcacgactcggaccgatg

SEQ ID NO: 6400 - DNA, 203 bp, Homo sapiens
  source 1..203: mol_type = other DNA
ggcgcgccagtcctaatattagtggaaatgaaaggtggacctgattttgaggttgagtgccctaacagcaccggctggatgccaatacatagtattactccagccgctactggtagggacactgtagactctgagttggtttcgactgcgcaagaacaagctaactttgcgtctactggacaacatgacgactcggaccgatg

SEQ ID NO: 6401 - DNA, 203 bp, Homo sapiens
  source 1..203: mol_type = other DNA
ggcgcgccagtcctagggaattgattgtataggcgagttgattagcaaagcttttgagttcgcaagaatctctttttataaatatgttttaaaatctgatgtacctataactcaagaatctccagtaactaagtggtctggtgaagtacaaaaatattacatgaaatatttggaatctcaacttgtatcgactcggaccgatg

SEQ ID NO: 6402 - DNA, 203 bp, Homo sapiens
  source 1..203: mol_type = other DNA
ggcgcgccagtcctctccagttactatttatatttctggagatacgggtgtgggcaaaagtacactatcttatcctttatctgccgatattataaagaaaatagcaggtgatacaactcatgatctgaaaaataattggaagaaattgatctatacccgaaattctgagcaagaattttgggatggttcgactcggaccgatg

SEQ ID NO: 6403 - DNA, 203 bp, Homo sapiens
  source 1..203: mol_type = other DNA
ggcgcgccagtccttaatttataagggacctgattctcaaaatatatacttaagatctgcatgggagtattcacttgatactcaatctggtgattgtggtgctcctttaattttaagaaaccctatgtgtagaggaaagatctgtggaatacatgtagctggtctaccaactggtggactcggctatgcgactcggaccgatg

SEQ ID NO: 6404 - DNA, 203 bp, Homo sapiens
  source 1..203: mol_type = other DNA
ggcgcgccagtcctttgttgatgcattaaaagatgaaaggaaaccgagagagaaagctcataaaacaagagctttttcaggatgtcctttggagtaccttgcggtatgtaagatgtattttcagggtatcgtctcggtattgaccaaatgcaaaaacgaaacgcatattagtgtaggaactaatgtgtcgactcggaccgatg

SEQ ID NO: 6405 - DNA, 203 bp, Homo sapiens
  source 1..203: mol_type = other DNA
ggcgcgccagtcctagcgtgagattgatgtcccaattcgttctttagatgaaattgcttatttaaaaagaagtttcgttttagacgaagaaagacaacaatggatcgctcctctgaccctggatactgtattggaaacgccaagttggattcatcgttgtgatgatccgatagaagcaactgtttctacgactcggaccgatg

SEQ ID NO: 6406 - DNA, 203 bp, Homo sapiens
  source 1..203: mol_type = other DNA
ggcgcgccagtcctcctgatgcacttatgtcacctatgattagagaaaaattatctggttttacatcttttagtgctagtaccgtctttcatatacaagtaaatgctcatccatttcaatgtggaagattggttttagctgctgtacctgttccagatattttacctctacataggttgaacatgttacgactcggaccgatg

SEQ ID NO: 6407 - DNA, 203 bp, Homo sapiens
  source 1..203: mol_type = other DNA
ggcgcgccagtccttatgatgatgttatggattcggatggtaagatagttagagatgaatacgtctatcgtgtagtcgtagaccttcgtgaccagactgaggctactttagtagtcccttttacctcccttactccttataaagtgtgtgcggatgtgtttaattcagcaaatcgtcctaaatacaaccgactcggaccgatg

SEQ ID NO: 6408 - DNA, 203 bp, Homo sapiens
  source 1..203: mol_type = other DNA
ggcgcgccagtcctatgtgcttttatatgtttgtgtctgtgtctttcaggtttcttcttgattcttcctgagggtactaatcgaatcatgtattttgttttattattatatacgtttttgttcgctttgtccgttcagtggaccaagttttggcaatagctgacacttgtttcacagcttctttctgccgactcggaccgatg

SEQ ID NO: 6409 - DNA, 203 bp, Homo sapiens
  source 1..203: mol_type = other DNA
ggcgcgccagtcctgaaccaatactttactacccattccgttacaactggaatattaagattcttgacctcacagataaggagggtcaagagagtgtcaataagaagtttttaaggaagtttactaaacttaggaagctttgtttgagacttcaaaaggacactgccttctggaaaaatactagaagtcgactcggaccgatg

SEQ ID NO: 6410 - DNA, 203 bp, Homo sapiens
  source 1..203: mol_type = other DNA
ggcgcgccagtcctaggttagatatgattcaggatgacatagacaaaatggtcgcacaaagtggccctgttatgagtcagagcttaagtgacagggttgaccgcatgtaccatgagttaatacatacgaatgtcgctcaaatgaatttctctataccgttttcacataatttgtccaaggattcaaagcgactcggaccgatg

SEQ ID NO: 6411 - DNA, 203 bp, Homo sapiens
  source 1..203: mol_type = other DNA
ggcgcgccagtccttgtagtcgtcattttaacaatgtgcaggaagcttttaattttacaatgagctttatgagatttttagctttggcttatgccatctttttcctcatttcacgagcaactaagttctttggagcgtcattttctacgatatctactgttctgataactcttattactatgacagtacgactcggaccgatg

SEQ ID NO: 6412 - DNA, 203 bp, Homo sapiens
  source 1..203: mol_type = other DNA
ggcgcgccagtcctactgacaagttagttaagaaatttttggtcgattactactcaaaacacatggaaaatgctaaaatgttagcccaagcaggagaggaagactcgtcttttctatcctacgtcattcccccattgtttttagaatcagttgtagatacaaaatctaacttgtttaagaggatttggcgactcggaccgatg

SEQ ID NO: 6413 - DNA, 203 bp, Homo sapiens
  source 1..203: mol_type = other DNA
ggcgcgccagtcctaagagtaaagacctggaccttgttgttaagaggttgtcgtattttggtgatgctaaaatatacaatgcctttgacaatataggcacgtggttgactacgatgatcaacaagacagtaaattatgtaaaggttacactcttgggccatgatcctgaagaatttttggagaatcagcgactcggaccgatg

SEQ ID NO: 6414 - DNA, 203 bp, Homo sapiens
  source 1..203: mol_type = other DNA
ggcgcgccagtcctgttaagagggctccttctgaaagtggtacattctctactgattgttatactttcgtggaatatgatccatttgaccactgcaacatcgttaaatcaatgtctttcaatgaattgatagatgaggtggttgccatgtatttccacgaaggagagtttgtatcttccgtagataaacgactcggaccgatg

SEQ ID NO: 6415 - DNA, 203 bp, Homo sapiens
  source 1..203: mol_type = other DNA
ggcgcgccagtcctcgatttccatcatcgttgacctttgatcaagcagtgttggggatacctggagaagactatgtcaattcaataaaacgtgatacctcttgcggttatcctttcgttaaggaaggatggacacgagctaaaatcttcggtaacggtgatgaatatgacatgtctacctcgggtgttcgactcggaccgatg

SEQ ID NO: 6416 - DNA, 203 bp, Homo sapiens
  source 1..203: mol_type = other DNA
ggcgcgccagtcctcaaatgttacgagagaaagtacaggaatgcatagaggcggcgagacaagggaagatattggaccattattttatagatacattaaaggacgaaaggaagcctaaacataaggctcataagtctcgaatgttttctaatggaccaatagattatcttgtttggagtaagatgtatcgactcggaccgatg

SEQ ID NO: 6417 - DNA, 203 bp, Homo sapiens
  source 1..203: mol_type = other DNA
ggcgcgccagtccttttaatccgatagtagcggtgttgtctgagcttaaaaatgtagaccatatttccgtggggtccaatgtgtattctacggactgggacgttattgcaaggtacttgaagtcgaaatctcaccatatggtggctggagacttcgagggctttgatgcttcggaacagtccgacatacgactcggaccgatg

SEQ ID NO: 6418 - DNA, 203 bp, Homo sapiens
  source 1..203: mol_type = other DNA
ggcgcgccagtcctgttgtattggaaatgcctatgtggaccaaatccagcaaggacattgtaactaatgtattctgtaatttggaacacgccctcaaggagttatcattgcatgataaagaattgtgggaaaaatggagtcctgtattgcattcaaagagtgaggaagtcctgaaaatggtttcttctcgactcggaccgatg

SEQ ID NO: 6419 - DNA, 203 bp, Homo sapiens
  source 1..203: mol_type = other DNA
ggcgcgccagtcctctgaaatttcaagatgaggtcagggagattgctcttggcctttcaggttatgagtagttttcttgacttctcttaaaaccaacaatgtgatcttgcttgcggaggcaaaatttgcacagtataaaatctgcaagtagtgctattgttggaatcaccgtacctatttaggtttaccgactcggaccgatg

SEQ ID NO: 6420 - DNA, 203 bp, Homo sapiens
  source 1..203: mol_type = other DNA
ggcgcgccagtcctgatagtgcttgaagatggaccgcagatggaagaacctcttccttatgcattccatggacagcatactgataatcgtcaacatacggtggttaatttcttgcaacgtccccaggttattttcgattcgtcttgggcgtctgatctccctcgaaacaaacaatttatggattcgatcgactcggaccgatg

SEQ ID NO: 6421 - DNA, 203 bp, Homo sapiens
  source 1..203: mol_type = other DNA
ggcgcgccagtcctaggcgcagcttttaaacaatctgtttcaaagctgggcgaacatttacctttcctcaaatctggagcgaactgggtcagtgagaacattctacaacctgcagatgaaatcataggacctattttatctctttttgggttctcgaagccccttttgcccattaccaatcccaccgtcgactcggaccgatg

SEQ ID NO: 6422 - DNA, 203 bp, Homo sapiens
  source 1..203: mol_type = other DNA
ggcgcgccagtccttcacatcagtactcctttggcaatagaacaaatacctataaagggagtcgcagagttccaaataccgtactatgctccatgtttgtcatcttcgtttagagcgaattcggaaacattttactatagttcaggtcggaataatctcgatatagccacttcacctcccaccgtcaacgactcggaccgatg

SEQ ID NO: 6423 - DNA, 203 bp, Homo sapiens
  source 1..203: mol_type = other DNA
ggcgcgccagtccttcgctattatgcggttggtgcgggagatgatatggacttttccatctttatcggtacgccgccctgtattcatgcatctcagacggcccagtttaccaagataaaacaaggtaaagtgtatgatttgaggtatgatcagtacgacccttttagggaagtccaggacggtacggccgactcggaccgatg

SEQ ID NO: 6424 - DNA, 203 bp, Homo sapiens
  source 1..203: mol_type = other DNA
ggcgcgccagtcctgttcctcaatgctcgtagtattgaggatagcgatttgttgtgagctcctttagagggagggctcactttatctattgcttaattcggtaagccacaaatttttctaagtgtcatgagtttcttctcggttcttctcatgattactaatcgaaccgtgtgtagagtcagaatgttcgactcggaccgatg

SEQ ID NO: 6425 - DNA, 203 bp, Homo sapiens
  source 1..203: mol_type = other DNA
ggcgcgccagtccttacaatgtgatcatgtcttttcaacaaacaaacaacaacgcaaccaacaacatcaactcccttgaggagcttgctgctcaagaactaatagcagcacaatttgaaggaaatcttgatggtttcttttgcactttttatgtgcagtccaaaccacaactattggacttagagagtcgactcggaccgatg

SEQ ID NO: 6426 - DNA, 203 bp, Homo sapiens
  source 1..203: mol_type = other DNA
ggcgcgccagtcctggacaattgaacggaaatttaacaagaatttgtgattttttggaaaactctctaccgacactaacagcccaaattcaaacaacagttttgacaacaacagacaaatatgtgaatttgaaagaagacttgctaaaggttgccattctacttgtcctagtccgtcttttgatggtccgactcggaccgatg

SEQ ID NO: 6427 - DNA, 203 bp, Homo sapiens
  source 1..203: mol_type = other DNA
ggcgcgccagtccttgggatgaaacatacttttcaaacttactttcacaaggctttatggcaggaaaatctctgatagaaatggaagctgaatttgctagtgatgctgaaacgttcaacgcatatattgagtacaaaaagaatattcccaaagaaaccaaatggagcaagtggatgaccattttggaccgactcggaccgatg

SEQ ID NO: 6428 - DNA, 203 bp, Homo sapiens
  source 1..203: mol_type = other DNA
ggcgcgccagtcctggagacagtaaaacgcaaaaacagcgaaacacaaaagtagaagttggcaaagaacttgaaaaagaagctgaaactcaaggttgcagcgacccagcagctcatgctttggtgcttgatgtgttgcagaagaatacgtactgtttatattatgagcgaatggtgaaaggagaaatgcgactcggaccgatg

SEQ ID NO: 6429 - DNA, 203 bp, Homo sapiens
  source 1..203: mol_type = other DNA
ggcgcgccagtcctggaacgttggcaacatttcatcagagtgctaatgaactgtgtcgtgcatatcagtggctacaagccatccgtcctttggaccaagaaattaccatttatcatgaagataccgacatgtttgattacgagagtgaaagctatacacagcgggattgctatgaatacaatgcgcctcgactcggaccgatg

SEQ ID NO: 6430 - DNA, 203 bp, Homo sapiens
  source 1..203: mol_type = other DNA
ggcgcgccagtcctaataacattacagtgcaatgctgctttgaaccaccatcagatatcaaagataccatgagtggagaaacgcctgaaggaaaattttgcgctatcggaaagagtaatatcaaggttggtcaggcggtaaaaacaactttactaaaatcttgtatctatggaatgttgagcaaaccacgactcggaccgatg

SEQ ID NO: 6431 - DNA, 203 bp, Homo sapiens
  source 1..203: mol_type = other DNA
ggcgcgccagtcctcaccaactacaacgaactgtcgcacctttgcaaaaagatgttatttacgaaatgctaaactggacacggaacactattgacccaaacgaaattctaatgatgaacataaacacagcttttagagaaatagtataccatggaaagagtgagtaccagaagttgcgtagcggaattcgactcggaccgatg

SEQ ID NO: 6432 - DNA, 203 bp, Homo sapiens
  source 1..203: mol_type = other DNA
ggcgcgccagtcctgcaactaacctttggtcatctagtgaccctgtagaaaaacaattgtatacagccaatttcccagaagttctaatttctaatgctatgtaccaagacaaattgaaaggtttcgtaggacttcgcgccacacttgttgtcaaagtacaggttaattcccaacccttccagcaaggtcgactcggaccgatg

SEQ ID NO: 6433 - DNA, 203 bp, Homo sapiens
  source 1..203: mol_type = other DNA
ggcgcgccagtccttacgccggtgatttaacactggctgataccagaaagattgaagcagagagaacgcaagagtattccaataatgaagacaatagaataacaactcagtgtagcagaatcgtcgcacaggttatgggagaagatcagcaaattccacgaaatgaagcacagcacggcgttcaccctcgactcggaccgatg

SEQ ID NO: 6434 - DNA, 203 bp, Homo sapiens
  source 1..203: mol_type = other DNA
ggcgcgccagtcctttacaagactcttttaattcccttatttcaacgagttcttctgcagtgacgaccacagttttaccatccggcactattaatatgggtccatccacacaagtaattgacccaactgtagaaggcttgatagaggtagaagttccctattacaatatttcacatattacacctgctcgactcggaccgatg

SEQ ID NO: 6435 - DNA, 203 bp, Homo sapiens
  source 1..203: mol_type = other DNA
ggcgcgccagtccttgtcctgcactgaacttgtttctgtctctggagtgctctacacttcagtaggggctgtacccgggcggtcccactcttcacaggaatctgcacaggtggctttcacctctggacagtgcattccacacccgctccacggtagaagatgatgtgtgtctttgcttgtgaaaagctcgactcggaccgatg

SEQ ID NO: 6436 - DNA, 203 bp, Homo sapiens
  source 1..203: mol_type = other DNA
ggcgcgccagtccttgtgaaaatcgtgtgtaggcgtagcggctacttgagtgccagcggattacccctagtggtaacactagcctctgggcccaaaaggcatgtcatttgaccactcaggtacacaaccccagtgatgcacacgcttagtaatggcttagtaacaaacattgattgatcatttgaaagcgactcggaccgatg

SEQ ID NO: 6437 - DNA, 203 bp, Homo sapiens
  source 1..203: mol_type = other DNA
ggcgcgccagtcctactctaccgcaggcattttggcccaatcaagattttccagcatgggggcagtctcgttattttgcagcagtgcgctgtggctttcatattcaagtacagttgaatgttaacatcggttctgctggttgcttgattgccgcgtacatgccaaagacggcccatgatcatatgaaccgactcggaccgatg

SEQ ID NO: 6438 - DNA, 203 bp, Homo sapiens
  source 1..203: mol_type = other DNA
ggcgcgccagtcctggttcacctacaacagtggatgtgaccatttttggttcattactcgacttggattttcagtgtcctcgtcctcctggtgcagacacagtaatttacacacaagggaaaagaactgttcgaaagaccaagacatcaaagttcaaatgggtcaggaataaaattgacatagctgaacgactcggaccgatg

SEQ ID NO: 6439 - DNA, 203 bp, Homo sapiens
  source 1..203: mol_type = other DNA
ggcgcgccagtcctccagatggtcgaaggggctatttcacctggtcacatacaatctcacctgttaattgggtttttgatgaccacatttatttggaaaacatgcccaatctgagattattctcctcctgttacaactattggaggggctcctttgttattaaactgacagtttatgcgtcaactttccgactcggaccgatg

SEQ ID NO: 6440 - DNA, 203 bp, Homo sapiens
  source 1..203: mol_type = other DNA
ggcgcgccagtcctaacaaaggacgcttgaggatggcatttttcccaaacagagaaggcgcctacacacaggatgaagctcagaacgcaatctttgttgtgtgtgatataggcttgaataatacctttgagatgaccatcccctacacttggggcaactggatgagaccaacaagaggaaactccttgcgactcggaccgatg

SEQ ID NO: 6441 - DNA, 203 bp, Homo sapiens
  source 1..203: mol_type = other DNA
ggcgcgccagtcctgttccattaagatgtgttaaaggttcagacaggaattcagccggacttggttctctcttcacacaggctgtgggcagaacaatctctaatcgggtacaaatctttgtgagcttccgctgtcctaattttttcttcccactacctgcgcccagggaagccacgtctcgaagcatacgactcggaccgatg

SEQ ID NO: 6442 - DNA, 203 bp, Homo sapiens
  source 1..203: mol_type = other DNA
ggcgcgccagtcctgggaaatttttgaaccaatgtggtgacgtggaaaccaacccaggccctgacattgagttggtctataaaaacagaggcttctataagcattatggagttagatttggtggtcatatctaccacttgaattcacaagacattctgtcaaccgcaattacaggcaagtctgacttccgactcggaccgatg

SEQ ID NO: 6443 - DNA, 203 bp, Homo sapiens
  source 1..203: mol_type = other DNA
ggcgcgccagtcctaaagccttggggattattggggtcatcttgttgtcagcctctcttctttcattgcttgctgtaccctgggattattcctcacttcaaactgtttataaccaatccattgaaggtgatgcttctggcctcacactcctaagtcaaagatgcatgacttttttttccaatacaatgcgactcggaccgatg

SEQ ID NO: 6444 - DNA, 203 bp, Homo sapiens
  source 1..203: mol_type = other DNA
ggcgcgccagtccttgtgaaacttttaataatgatcttgttaagtttattattaagattttggtgcggcttttgtgctacatcgttctttattgccatgcaccaaatatgctgacaaccatgtgtctgggaactcttcttgttttggacattacaacttgtgaaatcttgtctgctaacaccaaagcacgactcggaccgatg

SEQ ID NO: 6445 - DNA, 203 bp, Homo sapiens
  source 1..203: mol_type = other DNA
ggcgcgccagtcctctctttcaggcattggttgatggtgatgtgaagagtcttgtctggaaaattgctgagaatatgcaatttgcccaatccaaggatgaacaagctgaggacatggcagcaaccttcaactttgcctctgacatggttaattttgtgccaatggaacagatgagacaagaaggctggcgactcggaccgatg

SEQ ID NO: 6446 - DNA, 203 bp, Homo sapiens
  source 1..203: mol_type = other DNA
ggcgcgccagtcctggtggtagggcttggaagaccctctccatggatgaacttgtgaaacaaatcacggcagtttacacacagaggtcagatgcccttatggtttggaaaaggaagttgaataccatcaggaacgaaatgagccctggatcatccaccggcaggatttttgaacccttagaggaaacacgactcggaccgatg

SEQ ID NO: 6447 - DNA, 203 bp, Homo sapiens
  source 1..203: mol_type = other DNA
ggcgcgccagtcctaaccctcaaactgcaatttctaagaaggggggtaagcctaagctctcattagtgaaaaccacaaactttgttaatgaagcaccctatatgcaagatcttgaacattgctttgcacaaacggcctacatttcttctccagaaacccaagatataatacattgtgctgccttgagtcgactcggaccgatg

SEQ ID NO: 6448 - DNA, 203 bp, Homo sapiens
  source 1..203: mol_type = other DNA
ggcgcgccagtccttcaaaaaaaggaatgtgtgggggccttttggtcactagagtgcatggcacattcaaggttctgggaatgcacattgcaggcaatgggcaagttgcacgagctgcagcagttcactttatatccaatggtgcagctggctttatggatcaaggtgttgttgtggccaaagaaaagcgactcggaccgatg

SEQ ID NO: 6449 - DNA, 203 bp, Homo sapiens
  source 1..203: mol_type = other DNA
ggcgcgccagtcctttacaaaagcccatttatttgccatctaagacagctttgaatcccagtcccttgaatggtgtagtccccgtgaaaatggaaccagctgtgcttagtcctcatgacaccaggcttgaagtcatcatgcccagcgttgtgaaaacagcggcagctaagtatagagttaatatttttcgactcggaccgatg

SEQ ID NO: 6450 - DNA, 203 bp, Homo sapiens
  source 1..203: mol_type = other DNA
ggcgcgccagtcctttaattaaaagttgaacctgtagcgtcagtaaaacgcagtaaccgcaagcaattgcctgtagcgtcagtaaaacgcaatacacaagatttgagcctgtagcgtcagtaaaacgctgcaaccacaagctattgactgtagcgtcagtaaaacgcaaacattcttgtggcgctcgccgactcggaccgatg

SEQ ID NO: 6451 - DNA, 203 bp, Homo sapiens
  source 1..203: mol_type = other DNA
ggcgcgccagtcctgtagcgctcaagtgcagagcttcccggctttaagggttactgctcgtaatgagagcacatgacattttgccaagatttcctagcaattgtcacgggagagaggagcccgttctcgggcacttttctctcaaacaatgttcgcgcgcctccgcgcgccccccctttttcagcccccgactcggaccgatg

SEQ ID NO: 6452 - DNA, 203 bp, Homo sapiens
  source 1..203: mol_type = other DNA
ggcgcgccagtccttaagtggatctccaatttggcctgttctgaactacaccatctactgctgtgaagaatgtcctgaaggcaagctggttacagccctgatcaggagccccgctcgtgactctcgatcgacgcggggtcaaaaactgtctaagcagcagcagaaacgcgggagcgtttctttttcctcgactcggaccgatg

SEQ ID NO: 6453 - DNA, 203 bp, Homo sapiens
  source 1..203: mol_type = other DNA
ggcgcgccagtccttatttgtttcatgatggcggcgtctaaggtatacagagtgtgcgagcagactctactagcaggcgctgttcggatgatggacaaattcttgcaaaagaaaacagtttttgtgccacagcttgacaaacaggtaaggttgactggtcttcacaattatgacaacacatgctggctcgactcggaccgatg

SEQ ID NO: 6454 - DNA, 203 bp, Homo sapiens
  source 1..203: mol_type = other DNA
ggcgcgccagtcctagagacacccaaaacagaagatgtactagttttcgcgccctatgactttgagtcattgggcaaagaccctcctaagttacatcagaggtatgagaaggcgtttgaacgccttagcggagctggtacatcgactccaacgactggcaaccagaacatgtcaggaaacagtggttccgactcggaccgatg

SEQ ID NO: 6455 - DNA, 203 bp, Homo sapiens
  source 1..203: mol_type = other DNA
ggcgcgccagtcctcacgctttccagacattacacattcaaagtgggtgagtggcctcattcacaatcacacggccacgcctggatttgtccactgcctggagacaagctgaaaaagatgggcagcttccacgaggttgtcaagtctcaccacctggtcaagaatggctgggatgtggttgtacaagtcgactcggaccgatg

SEQ ID NO: 6456 - DNA, 203 bp, Homo sapiens
  source 1..203: mol_type = other DNA
ggcgcgccagtcctcaaggcaaaatttttggttgcttttgtgcctccccacactgctgcgccaaaaacgcgcgacgaagctatggcatgcattcatgctgtgtgggatgttggcctcaattctgcattctcatttaatgtgccttattcttccccatctgacttcatggctgtttattctgcggatgccgactcggaccgatg

SEQ ID NO: 6457 - DNA, 203 bp, Homo sapiens
  source 1..203: mol_type = other DNA
ggcgcgccagtcctggatggcgagcccggtgagacagaaccacggcacgctttgtcccctgtggacatgcatgtccacacagacgtcagttttctgcttgacagattctttgatgttgagacaattgaactttcaaatttaacaggctccccaactactcatcttttggatccttttggttccactgccgactcggaccgatg

SEQ ID NO: 6458 - DNA, 203 bp, Homo sapiens
  source 1..203: mol_type = other DNA
ggcgcgccagtcctccagcttgcttgggctcgacttctcaacacttgtacatacttcttctccgacttggagttgtctattcagtttaagtttaccaccaccccatcttcagttggagagggctttgtgtgggtcaaatggttcccggttggagcaccaaccaagaccactgatgcctggcagctaaacgactcggaccgatg

SEQ ID NO: 6459 - DNA, 203 bp, Homo sapiens
  source 1..203: mol_type = other DNA
ggcgcgccagtcctggagtccacttacaattggctgcccggtgctcactttggctctatattgctgacatctgatgcacatgacaaaggagggtgttacttgcggtaccgctttccgcgagcaagcatgtattgccctcggcccattccaccggctttcactcgccctgctgacaaaactaggcacaacgactcggaccgatg

SEQ ID NO: 6460 - DNA, 203 bp, Homo sapiens
  source 1..203: mol_type = other DNA
ggcgcgccagtcctagagacatattctcctttttacaagacggcaaaaatgctttttaaacttgcaacactggctgtgacggcaatgcggaccaaggacccggtggttgtggtcatgctgattgctgattttggattagaggtgtttgacacaggttttttcttttcctattttcaagaaaagctgcacgactcggaccgatg

SEQ ID NO: 6461 - DNA, 203 bp, Homo sapiens
  source 1..203: mol_type = other DNA
ggcgcgccagtcctgttcaaggacatgcaacagcgtgctctcgctgtgaaagataaaggcctcttttccctgctgcaaatcccactagtcaacttgcccacaagcaggccagagcctgttgtgtgtatccttcggggtgcatcaggacagggaaaatcttatttggcaaatttgatggctcaggcaatcgactcggaccgatg

SEQ ID NO: 6462 - DNA, 203 bp, Homo sapiens
  source 1..203: mol_type = other DNA
ggcgcgccagtcctccccatggctcacttggatgataagggcattccattcacttcccctgttgttatttgtaccacaaacctgcattcatcttttacacccattactgtttcttgtccagaagctctcaagcggaggtttcggtttgatgtgacggtatctgtaaagcctggctttgtacgtactgtcgactcggaccgatg

SEQ ID NO: 6463 - DNA, 203 bp, Homo sapiens
  source 1..203: mol_type = other DNA
ggcgcgccagtcctaaacagacaagacacacacaaaatgcccatttttaaacaatcgtggtctgacttgtttaagaaatgttcaactgatgaggagcaaaaaatgttacaatttttgattgacaataaggattcagaaattttgagggcttttgtgtcggaacgctcaattttgttgcatgaagagtacgactcggaccgatg

SEQ ID NO: 6464 - DNA, 203 bp, Homo sapiens
  source 1..203: mol_type = other DNA
ggcgcgccagtcctctcgcgggggtattgtggcgcagcaattgtggcaggctcacctgcccgcatcattggcattcattctgctggtactgggtctgtagccttttgctccctggtgtccagagatgcgctggagcgcactctccctcagaaacagggcaacgttgttcgtcttgatgatgatgtgagcgactcggaccgatg

SEQ ID NO: 6465 - DNA, 203 bp, Homo sapiens
  source 1..203: mol_type = other DNA
ggcgcgccagtcctccagaaatggcttctgcgcgcagctcatgtttatgctcaacgggtctttgcccgtattggatttgacaaccaggctttgactgagcaggaagccatttgtggcattcccggccttgacaagatggaacaggacaccgctcccgggttgccctatgctcaacaaaacaaaagaagcgactcggaccgatg

SEQ ID NO: 6466 - DNA, 203 bp, Homo sapiens
  source 1..203: mol_type = other DNA
ggcgcgccagtcctgatgccccatgtggtggttggtaggcagcttttgggccggtttgtggcaaagtttcatgaggcaaatggatttgagactggttctgctattggatgtgacccagatgtggattggactcggtttggtcttgagctggaacgttataggtatgtgtatgcctgtgattactcccgcgactcggaccgatg

SEQ ID NO: 6467 - DNA, 203 bp, Homo sapiens
  source 1..203: mol_type = other DNA
ggcgcgccagtcctctgtacatccattttaaacactgttttaaacaatgtttacattcttgcagctatgatgaaggcttttgagaactttgagccggatgatatccaggtgatttgctatggggatgattgcctcattgcttctgaccttgagattgactttcaaaagttggtgcctgtgttttccagcgactcggaccgatg

SEQ ID NO: 6468 - DNA, 203 bp, Homo sapiens
  source 1..203: mol_type = other DNA
ggcgcgccagtccttgaaaagctcctgtctgttgcgcagttggctggccactgcgaaccagaacagtatgagcgcctgtttgagccttttgctgggatgtattacgtccctacttggcgtgatttgcgcctgcagtggctaatgaagcttggatgctaaatctttttctggttttgtttttctttgttcgactcggaccgatg

SEQ ID NO: 6469 - DNA, 203 bp, Homo sapiens
  source 1..203: mol_type = other DNA
ggcgcgccagtcctgacacccccagcaaggctgagcagtccgttgagcgaggatttacgtttcagcttgcacagtgggagacatccagaaacatttgggaccatttgacaatccctcttcccatgtgccctggtcttattaaggtctctggaatgtacaaagctttcattgaaacccacgcctacattcgactcggaccgatg

SEQ ID NO: 6470 - DNA, 203 bp, Homo sapiens
  source 1..203: mol_type = other DNA
ggcgcgccagtccttcttggttgccggagcgcagttttatacctggaaagttcactgatttcctgcaagtagctgttataccaactttggctgaagtttctgttcaaaactacaaaccagtgccttcctttccagtgagtaatgttttacagactaagcctcttgtaaatactgatttgacttttactcgactcggaccgatg

SEQ ID NO: 6471 - DNA, 203 bp, Homo sapiens
  source 1..203: mol_type = other DNA
ggcgcgccagtccttctatgactttccgcaacacttatgtgtctgcgctttctcttcagtacacccagtatagaggttccatttgtatggatttactttttacaggaagtgctatgtgtcaaggaaaatttgttgtgtgttatgtgcctcctggtcgggaacctcagtctttggatgaggccatgcagcgactcggaccgatg

SEQ ID NO: 6472 - DNA, 203 bp, Homo sapiens
  source 1..203: mol_type = other DNA
ggcgcgccagtcctgagcaaggaactgcttcgcgtacactcgtgcgcactaaccacataacagcagaatttgtggagaaaacacccctgaatggtttggctgcagtttttacgtcattgtctactagtggttattctactaagcttgtttctgaacccatccccgaagcaactttgtctaccattctgcgactcggaccgatg

SEQ ID NO: 6473 - DNA, 203 bp, Homo sapiens
  source 1..203: mol_type = other DNA
ggcgcgccagtccttctgagggtgccacaaatttttctttgttgaagttagcaggggatgttgaacttaaccccggcccaactatttggtcagtgatgcccggtggtgaactcattgaatttgctacaaaggtctctcaagtttacaagaccatcaaagaaaaatgcactgaccctaccacttggattcgactcggaccgatg

SEQ ID NO: 6474 - DNA, 203 bp, Homo sapiens
  source 1..203: mol_type = other DNA
ggcgcgccagtcctaggtctatccggcgcacctttttcgacgactcgtcatccgagtccgaagatggagaaccggaggttcctcaattcagaccccaggtctaccctaggccacgcagtatgagagtagtcagacatcccatgacagcgcgacgcgcccaacgcgtcattgacatgggatactctgatcgactcggaccgatg

SEQ ID NO: 6475 - DNA, 203 bp, Homo sapiens
  source 1..203: mol_type = other DNA
ggcgcgccagtcctcagcgcgttcattgcgaggagaatcaggcccttttgtccgaggggatttcctccactctctcagttttgaatggtttcttcaatcttttcaaaaatgtgcaatggtttttggatttcctcaaaagctgctatggcaaactttccaagcaattgaaaccaatgcagtctctccgccgactcggaccgatg

SEQ ID NO: 6476 - DNA, 203 bp, Homo sapiens
  source 1..203: mol_type = other DNA
ggcgcgccagtcctcaagaagcggtcactcgccgctattggaaggtgattgatgttagcgcagatgatcagtataaaactgtggatggcaggctggactacgccaaagccacgcaacctacccagattccccctgaattggctgtgttcaaaactcatgtccctcttttgaagggcgctctgcgtgaccgactcggaccgatg

SEQ ID NO: 6477 - DNA, 203 bp, Homo sapiens
  source 1..203: mol_type = other DNA
ggcgcgccagtcctactgctgaacatcgcagacgcttcgtcgaacaaaatccaacttttcattttaaggaaactgaagctgacttttatgaacgtgttgcattcctttctggcattcatggtcgaaagcaatccattcttaagaaaatcaaggagtggttcgcggacggcgtgcgtgtcagaaatcttcgactcggaccgatg

SEQ ID NO: 6478 - DNA, 203 bp, Homo sapiens
  source 1..203: mol_type = other DNA
ggcgcgccagtcctcacattacagctggacgcaattctgcaactcgcgaccagctggaggcagtggatgtaattgatcagtttgacatgccaagtgacgctgtcgcggttaagtttccagacaagcgcggctcctcctacaaaaacatcatgcaccaccttgcctccaccctccctattcgtggaaaacgactcggaccgatg

SEQ ID NO: 6479 - DNA, 203 bp, Homo sapiens
  source 1..203: mol_type = other DNA
ggcgcgccagtcctaccaaattgagacccactgtcgcaatcaacacttttgagtgcgacgtggaaccagccgtcctgtccaaattcgacagacggctcgaggaacctgacagttttgagttgacccttctgcacaagaatgacaggcgctatccagaggacacttctatggacaagcacctggaggctcgactcggaccgatg

SEQ ID NO: 6480 - DNA, 203 bp, Homo sapiens
  source 1..203: mol_type = other DNA
ggcgcgccagtcctgctgttgaggcttatgcttcctcattgtttgcacagattggtactgacaatggaatcatttcagagtatgaagctgttactggcattgagaatttggactcagtggagacaacaacgtcacctggactaccctacacgacagcggggattccaagagaggcgctgtttgacccacgactcggaccgatg

SEQ ID NO: 6481 - DNA, 203 bp, Homo sapiens
  source 1..203: mol_type = other DNA
ggcgcgccagtcctggccgaatgctgcttggaaaatttacagctaaaatgcatgctaacaatggattaggcattggttcagccgttggttgcaatccagatgtagactttactagatttgcttaccaaatcttggaatgggactatgtttatgacattgattacaaaaattttgatgcttcacattctcgactcggaccgatg

SEQ ID NO: 6482 - DNA, 203 bp, Homo sapiens
  source 1..203: mol_type = other DNA
ggcgcgccagtcctatgggaatgcaggactggacttgtgctgcctgacagggtcgcggctggccgtctgtactttgtatagtcagttgaaactcaccatggcatgtttgaaaattttctctctgaaacgcaaagataagagccactcatactctcctcgtgagattgagttgaaatataattcagattcgactcggaccgatg

SEQ ID NO: 6483 - DNA, 203 bp, Homo sapiens
  source 1..203: mol_type = other DNA
ggcgcgccagtcctggacctctagaatggaaaatggtaataccaataactctggcaacactggagtgatcaattacaatttttactccaactcatacactgacgcagttgatctatctggagcaatgtcttcgcaggaatcaaatgctgctgagaatgctgcatcagggcctacatctcttcttaaagcgactcggaccgatg

SEQ ID NO: 6484 - DNA, 203 bp, Homo sapiens
  source 1..203: mol_type = other DNA
ggcgcgccagtcctttgccgatgagggtacatcaggtggcccggcagtctcacggtttgtgacccttagggcccaatcgtggtcgacatctcaagatgtgtattcattccaagctgctcacctgccatatgctcttgttgcacaggaaacaccattcaaggcccttatgtccaaacaccagctgcttacgactcggaccgatg

SEQ ID NO: 6485 - DNA, 203 bp, Homo sapiens
  source 1..203: mol_type = other DNA
ggcgcgccagtcctataatccagacaagatgtatagcacatggcactaccaccacacttttgatgatacagataagcattggtacaaaccagaagaacagccatacggtggcatatcacctcagtccctgttttgctttccccatcagctgattaatcctaggacaaattcatcagcaacattgtgtgcgactcggaccgatg

SEQ ID NO: 6486 - DNA, 203 bp, Homo sapiens
  source 1..203: mol_type = other DNA
ggcgcgccagtccttaccttatgtggactgtggccccataactgatgtcactgtccactgtccctgggctattgtgattgtggttttgcgccagctactggtggccaacggtggaacacccagtgttgacattaatgtttccttggctccatgcaatgttgagtatcatggactccgtcagagttctgcgactcggaccgatg

SEQ ID NO: 6487 - DNA, 203 bp, Homo sapiens
  source 1..203: mol_type = other DNA
ggcgcgccagtcctagaattgtaggcttgttttggcctggacatcacagggctttaacgcaccaatgccaaccactatggctgaagcaatgcaaggccattatgttatctatgacaccggtgtggacagcagtgtagatttagttgttccctatgtggcaccatatgattttacccctgtgcgaactccgactcggaccgatg

SEQ ID NO: 6488 - DNA, 203 bp, Homo sapiens
  source 1..203: mol_type = other DNA
ggcgcgccagtcctttctaaagggaccctccaacatctcctccggcttccagggaaacatggattctccacttcagccagctgagacgggatgtgacaaggcaatggcacccagtgcttcaaatgagaaccccgtccctctgtcagttgagagcattggttcgtccagggtttcgttcttctgggacacgactcggaccgatg

SEQ ID NO: 6489 - DNA, 203 bp, Homo sapiens
  source 1..203: mol_type = other DNA
ggcgcgccagtcctggtatttccacatctcaacaatcacaaagatgactaatgttgacccgcaatacttgcggttgaacatctcagacatcctgcgggaccctgtaatacgtcagtccctacatgccacctatttgagatgtgggctatctgttgctgtgagagtgatgccagcaaatccagctagtacgactcggaccgatg

SEQ ID NO: 6490 - DNA, 203 bp, Homo sapiens
  source 1..203: mol_type = other DNA
ggcgcgccagtcctgcaagaaagagggttgctgctgtggtaacaaacacaactaccctgatgaactgaaccctttttcagagaatgggttctggagccgcttcaagaaagggcacctccaaggtccaatgcaggatgtgagctctttgattaacatcctgaagggtgcagaatggatttaccaccaatcgactcggaccgatg

SEQ ID NO: 6491 - DNA, 203 bp, Homo sapiens
  source 1..203: mol_type = other DNA
ggcgcgccagtccttgagaaaatgtgctgcccatgttaacccaagattgatgggcatgtttcctgaatttgacccatctccacctgatcctactcgccccgagccagttgttgtcgtcttgcgcggcgcacctgggcagggtaagagtgtgtgttctgagatgcttgccagaatgctttcttacacctcgactcggaccgatg

SEQ ID NO: 6492 - DNA, 203 bp, Homo sapiens
  source 1..203: mol_type = other DNA
ggcgcgccagtcctctcttttaaagttagttgagatgcaagggccaaaaggacaagccaatatggaaatggaaagaactttaatgaagaagaacatagtggaaatgacatatgagaagcacaacgggaggtttcaaactaccacagtcctgtttgtgcgtgatcggatttttctgatcaacactcacacgactcggaccgatg

SEQ ID NO: 6493 - DNA, 203 bp, Homo sapiens
  source 1..203: mol_type = other DNA
ggcgcgccagtcctctggcacaccaatagttggcttgatgaagacagaaggtagcagttatatctggtctggtgaatgtctcccatttaaaaatacaatgaacacttatgaaggctgtgttcctcatgtgttaccatataaggccgtgacagcccatggctactgtggctctgtcatggtcgcagatgcgactcggaccgatg

SEQ ID NO: 6494 - DNA, 203 bp, Homo sapiens
  source 1..203: mol_type = other DNA
ggcgcgccagtcctctggagtctggaaaggcatttgtggcatacactccttaggagatggtgccataggtgcagcaacagttttgtcaagacagcatttgctcaaccttcttgagggattcctggaattccagggaaaaatttatgatgtgcagaaaacagactttgtgtacacacccactagaacctcgactcggaccgatg

SEQ ID NO: 6495 - DNA, 203 bp, Homo sapiens
  source 1..203: mol_type = other DNA
ggcgcgccagtcctggctctttgccttctttcacaagaatcccggttggaatacaggatcagctgttggagttaatccagacttggcctggacacagatcttttatactgcccctagccggaatgtattggctatggattactctggatttgatgcttcacatacttctggcatgttttgcattttgacgactcggaccgatg

SEQ ID NO: 6496 - DNA, 203 bp, Homo sapiens
  source 1..203: mol_type = other DNA
ggcgcgccagtcctagcattttctgaccactcttggttatggaactttacagctttcctatattgattctctctgttattctaaacaccactgggatgatgaaacctaccgccttgacggaggattgccttctggatgctctggcacaacaatttttaacaccattatgaacaacattgttgcccgagcgactcggaccgatg

SEQ ID NO: 6497 - DNA, 203 bp, Homo sapiens
  source 1..203: mol_type = other DNA
ggcgcgccagtcctcacagtgcacgttccttaaacggggatttgtgctggatggtagtctcgtgcgaccagtcatggaagaacaacatttggctgaattgctaaaatgggctaggccaggaacattgcaggccaagttgctgtccattgcccagttggcatttcatcttccgcgctcggcgtataatccgactcggaccgatg

SEQ ID NO: 6498 - DNA, 203 bp, Homo sapiens
  source 1..203: mol_type = other DNA
ggcgcgccagtcctgcgctcggcgtataatcgccttatgctcccatttgaagaggctggatatgaaatccccagccatgaacgcctgaatgaggagtggcgcgagatgttcatttgaatggctacagttgtgagcagtttagtgattttctgcctgttgcttaagtagtttagttgagcccaaaaaaacgactcggaccgatg

SEQ ID NO: 6499 - DNA, 203 bp, Homo sapiens
  source 1..203: mol_type = other DNA
ggcgcgccagtcctgagcttccaggttgggaaacctggactgggtctatactgcctgatagggtcgcggctggccgcctgtaactagtatagtcagttgaaaaccccccatggaatctactactactctttcattttgcaactggatccccaagaaacagagagcccgtgtgtaccttaccaccagtgcgactcggaccgatg

SEQ ID NO: 6500 - DNA, 203 bp, Homo sapiens
  source 1..203: mol_type = other DNA
ggcgcgccagtccttcacacacgagaagtcgattggaccgtacacatacatggtctcagacatgattatgaaagaaaacagtagaacctcccttgccatggcatacgtggaagggaagacacttgtgttcaacaacggaacacaactaggacaagtacattcatccaatactgggaacaaaccacaagcgactcggaccgatg

SEQ ID NO: 6501 - DNA, 203 bp, Homo sapiens
  source 1..203: mol_type = other DNA
ggcgcgccagtcctaagagggctatagtgacagattaatgcaattaacagcaggtaattcttgcataacaacacaagaggcagccaaggcggtggtggcatatggacaatggcccagttacaatatagatgcaggagaacatttagaccttgcaactactcctggtacatctgtagataggttttacacgactcggaccgatg

SEQ ID NO: 6502 - DNA, 203 bp, Homo sapiens
  source 1..203: mol_type = other DNA
ggcgcgccagtccttgttttgtggtagccagatggccacaggtaaattacttattgcatataccccacctggtggttcctcccctacaacgagaactgatgcaatgctagctacacatgttatttgggatataggtttacaatcaacatgcaagcttgtggtcccctatatatcatcttcacagtacacgactcggaccgatg

SEQ ID NO: 6503 - DNA, 203 bp, Homo sapiens
  source 1..203: mol_type = other DNA
ggcgcgccagtcctggcaaaacaacctgacaagaaccactttgtcatacaatggatgggtaactgtattccagcaaacagcactggttgtacccccaggtgccccaacaacatgtcagttagtggtgacagtgagcgctgcggacaactttgtactaaggatccccactgatacagcatattttgcagcgactcggaccgatg

SEQ ID NO: 6504 - DNA, 203 bp, Homo sapiens
  source 1..203: mol_type = other DNA
ggcgcgccagtcctccaattcgactagcatttatactagagtagggaactgcccagcctcatttagaataccatttatgtctgtttgtaactattatacctccttttatgatggtgatggcaattttgaccagaacggtgctgcctatggtattaatcctggtgattttataggaaccatatctattacgactcggaccgatg

SEQ ID NO: 6505 - DNA, 203 bp, Homo sapiens
  source 1..203: mol_type = other DNA
ggcgcgccagtcctatgaggtgtgccaaactaagaacgccactgaattaacagagaccaaatgggctaactattcatgctcagttaggtttgatagaggttcatttacagcatggtttgtgggagaagacctgttactggtaccctaccatgcagcaaataattggagtcagacaacacatgtatacccgactcggaccgatg

SEQ ID NO: 6506 - DNA, 203 bp, Homo sapiens
  source 1..203: mol_type = other DNA
ggcgcgccagtcctctcttttgaaagctttagacctttatggatatgatttaccctttactacttacttaaaggatgagctgagaccaaaggagaaggtgaagatgggcaaaaccagggttattgagtgttcatcactcaatgataccataatgatgaagcaaacttttggtcgtctgtttcaggtgtcgactcggaccgatg

SEQ ID NO: 6507 - DNA, 203 bp, Homo sapiens
  source 1..203: mol_type = other DNA
ggcgcgccagtcctggatatatggtacgctgtgcaaacggcggaaattaatcctaccgttaaccgcccacctactccgagaagcctagtacctaattggatttatcaatggagttgcgctcagcaggtgaccctgacctgccagctccggctgatggacctgggctttccccacaggcgactgtggcccgactcggaccgatg

SEQ ID NO: 6508 - DNA, 203 bp, Homo sapiens
  source 1..203: mol_type = other DNA
ggcgcgccagtcctatgggaccgactactttggagagtccgtgtttctattgtttctttaatcaatcttatggtgacaatttatagtgccctgagtattgattggttgttgcttttgacaattattgagacatcacatagacataatgggagctcaagtaagcaggcaaacgtctggtgcgcatgacacgactcggaccgatg

SEQ ID NO: 6509 - DNA, 203 bp, Homo sapiens
  source 1..203: mol_type = other DNA
ggcgcgccagtcctcccggatacgggctgaacagggcgcaaacattcattatactaatatcaattattatagagatgcagctagcaatgcagcaagcaaaatggactattcccaggatccggacaagttcacgaaaccagtacttgatgctataactgaaccattacccacgctgaagtcccctagtgcgactcggaccgatg

SEQ ID NO: 6510 - DNA, 203 bp, Homo sapiens
  source 1..203: mol_type = other DNA
ggcgcgccagtcctgcactctactggtcttagcaataccagaatgggagattggggtgtctaatgctgatagggcatcctttaatctaacaaaccccgataagaacgggcatactatgactggtcaagaagcttattgcttacataatgggactaacatccattcttcactggtatttccacatcaatcgactcggaccgatg

SEQ ID NO: 6511 - DNA, 203 bp, Homo sapiens
  source 1..203: mol_type = other DNA
ggcgcgccagtcctcaatggcgtgcgagtttaacggactgcgcaatgccatcacccaagggctgccagtactcaatacacccggctctgggcagtttgtgactacagataatttccaatcaccaaacttgattccaaattttgatgtgacacaagtctttaatagtccaggtgaaattattaatttaccgactcggaccgatg

SEQ ID NO: 6512 - DNA, 203 bp, Homo sapiens
  source 1..203: mol_type = other DNA
ggcgcgccagtcctaggatgatttctcgatgcgcttgttgcgggatacagcagagatttcgcaagacggatttctgcaaggaccaatagatcaagcaatagaaaaagtaatcactgatgtagtgtctgacacgcgtgagtctagtagtgactttagcattggggctgttccagcattgaatgcggtggcgactcggaccgatg

SEQ ID NO: 6513 - DNA, 203 bp, Homo sapiens
  source 1..203: mol_type = other DNA
ggcgcgccagtcctaccaggacacacacctaaacaagatgactactgatagggcgaacataaagactgttaccaattatatcatgtctggcagcacgcggacagttgaatcagaagtagctgtggtcgaggattcacttaagcaatatggtccagcaactgggggtgtagtggttgggcagtataagacgactcggaccgatg

SEQ ID NO: 6514 - DNA, 203 bp, Homo sapiens
  source 1..203: mol_type = other DNA
ggcgcgccagtcctcaatctctgatcttctctgtagcgttgactcaggggaggtccgagattattgcagacgaaggggctggatagttccagacactcctactgagatcacggtttcccgtgattatggcaaactcagcatcattttacaagcggtaaccacatttgttacaatagcaggggtcatttcgactcggaccgatg

SEQ ID NO: 6515 - DNA, 203 bp, Homo sapiens
  source 1..203: mol_type = other DNA
ggcgcgccagtcctcaaggatagggcagtgtggcggagtgattgctaccactggtagggttcttggcatacatgtagggggtaatggagcacagggttttgcagctagcttatttagaaaatactttgccatcacacaaggaagtattgagttcaagagaaggttgagctggcagggcttaagagtgtcgactcggaccgatg

SEQ ID NO: 6516 - DNA, 203 bp, Homo sapiens
  source 1..203: mol_type = other DNA
ggcgcgccagtccttagtcaaggtgtataaacgaatctctttgtctgatttgaggatgatagcatatggtgatgatgtaatagcctcactcccttataagattgatgctggaaaattggcgattgctggacgagactatggtctaacaatgactccggctgacaaaggagagacattcactgatgtgacgactcggaccgatg

SEQ ID NO: 6517 - DNA, 203 bp, Homo sapiens
  source 1..203: mol_type = other DNA
ggcgcgccagtcctcttgggagaatgtcaccttcttaaagagatactttaggtcagatgagagatttcctttcctaattcatccagttatgcctatgagtgaaattttcgagtccattagatggacacgaaatgcaaaacacacccaagaacatgtcacctccctgtgctatttggcttggcacaatgcgactcggaccgatg

SEQ ID NO: 6518 - DNA, 203 bp, Homo sapiens
  source 1..203: mol_type = other DNA
ggcgcgccagtccttagaaacgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctggctctgacattgggacatttgatgtaaccgactcggaccgatg

SEQ ID NO: 6519 - DNA, 203 bp, Homo sapiens
  source 1..203: mol_type = other DNA
ggcgcgccagtcctcggacctggttcagtatccgggttgtcctgtattgttacggtgtatccgtcttggcacactgaaagggtatttttgggtaatcctttcctactgcctgatagggtggcgtgcccggccacgagagattaagggtagcaatttaaacatgagcaaactattttctactgtaggcacgactcggaccgatg

SEQ ID NO: 6520 - DNA, 203 bp, Homo sapiens
  source 1..203: mol_type = other DNA
ggcgcgccagtccttccctggttctagagtgacacaaggtgagaggtttttccttattgatcagcgtgagtggaactcaacacagagtgaatggcagttattgggcaagattgacatagtaaaagagttgcttgatcagtcatatgctgttgatggccttttgaaataccattcttatgcgaggtttgcgactcggaccgatg

SEQ ID NO: 6521 - DNA, 203 bp, Homo sapiens
  source 1..203: mol_type = other DNA
ggcgcgccagtcctgcttggacgtcattgttcagattaatccaacatcattccaggcagggggtctcatagcagcccttgtaccttatgaccaggttgatattgaatcaattgctgccatgactacttattgccatggcaagttgaattgcaacataaacaacgttgtaagaatgaaggtgccatacacgactcggaccgatg

SEQ ID NO: 6522 - DNA, 203 bp, Homo sapiens
  source 1..203: mol_type = other DNA
ggcgcgccagtcctagatgatgcgcaacgaatttcgactgtcgtcatctagcaacattgtcaatttggctaattatgaggatgcaagagccaaagtgtctctagcgctgggacaagaagagttttccagagactcgtcaagtaccgggggggaattgttgcatcatttttcacagtggacgtcgattccgactcggaccgatg

SEQ ID NO: 6523 - DNA, 203 bp, Homo sapiens
  source 1..203: mol_type = other DNA
ggcgcgccagtcctcgtgccttgccttcacttttacattccccggcacggtagggccaggcactcagatctggtcaaccacggtggaccctttttcctgtaacttgagggcgtctagcactgtgcaccccactaacttgagctcgattgcgggtatgttctgtttttggagaggtgacattgtatttgcgactcggaccgatg

SEQ ID NO: 6524 - DNA, 203 bp, Homo sapiens
  source 1..203: mol_type = other DNA
ggcgcgccagtccttctctgacacaccttacagggtgaatccaacgactcataagtccctctggccttatgcaactggcaagcttgtgtgctatgtgtacaatagactgaacgcacctgccagtgtatcaccaagcgtgtccattaatgtgtacaaaagtgctgtggatctggagttgtatgcacctgcgactcggaccgatg

SEQ ID NO: 6525 - DNA, 203 bp, Homo sapiens
  source 1..203: mol_type = other DNA
ggcgcgccagtcctgttttgtgacgggtacacttaggtggtttttaagtcttttccaactgtatcgtggttctctcgacattaccatgacatttgcaggaaaaactaatgtggatggcattgtgtactttgtgcctgagggtgttgcgatagagactgagagggaggagcagacccctttgctcacatcgactcggaccgatg

SEQ ID NO: 6526 - DNA, 203 bp, Homo sapiens
  source 1..203: mol_type = other DNA
ggcgcgccagtcctagagcaaaaatctggacaaatggtgctttgccttgtctccacgcatagataggacactcatatgtgagacagccaacctgatggtgggacgcgaggttgagtatgatatctttgtgaagaattgtgagacatatgctcggggtattgcatcaggcgactatgggacaaaagaagcgactcggaccgatg

SEQ ID NO: 6527 - DNA, 203 bp, Homo sapiens
  source 1..203: mol_type = other DNA
ggcgcgccagtcctggttaaatatggccaatttggagaagaaagggacacagttcaactcaccattcattatagcatcttctaatctttcccatccttgtccgaagacagtgtactgtacagatgccatcgctaggaggttgcatattaaggtcaaggttagcccgaaagaagaattctctactcatgcgactcggaccgatg

SEQ ID NO: 6528 - DNA, 203 bp, Homo sapiens
  source 1..203: mol_type = other DNA
ggcgcgccagtccttgataaatgtccctcgtttgcctaaatttagggacatacgcaatcacttttctactgaggagaacatacgcagggcagaaggcatgccagggactttgtgcactttggaccatgagaggttcacccttgttactgagagcgaccttaagatggtggaggcagctacatatgtctcgactcggaccgatg

SEQ ID NO: 6529 - DNA, 203 bp, Homo sapiens
  source 1..203: mol_type = other DNA
ggcgcgccagtcctccaaagacgaattgcgtcctctaagtaaggttatgctgggcaagaccagagccatagaggcttgccccgtttcgttcaccatcctatttcgcaggtatttgggatacgctttggcgcagattcagagccaccctggttttcacacagggatagcagtgggcgtggaccctgacccgactcggaccgatg

SEQ ID NO: 6530 - DNA, 203 bp, Homo sapiens
  source 1..203: mol_type = other DNA
ggcgcgccagtcctttgttaattccgttcatcagttgggctccatgagatactatgtccatggttctatgccatctggcacacctgctacatcggtgctcaattctataattaatgttgtgaacatctgccatgtgttgtgtgcattggagaaaataagtgtatttgaggttttcaaattattcaagacgactcggaccgatg

SEQ ID NO: 6531 - DNA, 203 bp, Homo sapiens
  source 1..203: mol_type = other DNA
ggcgcgccagtcctgaacattctatgtggatgagtggtccatctgtcatccgcgtatttctgaggagactgtttattcgatgctggcttggaagagcgacaatgcatccatgaaggatctgatagaaacgagtatatggtttatgttccatcatggcccccggaagtatgttagattctgtacttggccgactcggaccgatg

SEQ ID NO: 6532 - DNA, 203 bp, Homo sapiens
  source 1..203: mol_type = other DNA
ggcgcgccagtccttgcgcggtgttctgtgccgtgtgggtattgggctctacattccaacttacaaagagctggaggtgaggtatgataggcttgtcaagtataggttcatagatgatagcttttagattttacatatttgagtttccatttctgtgtagttttagtgagtataggagcttatgtatgcgactcggaccgatg

SEQ ID NO: 6533 - DNA, 203 bp, Homo sapiens
  source 1..203: mol_type = other DNA
ggcgcgccagtcctcacttgcgcaactcgcgtgactggttagtactcttaccactttccgcctgcctggtcgttcagcgctgctgacaggcactcccattgagggccgttcggcgctccactgaggcgtctacgtttagtgtggctacggtgttgaggccgtttcgcgcggccgactcgcctacgcgccgactcggaccgatg

SEQ ID NO: 6534 - DNA, 203 bp, Homo sapiens
  source 1..203: mol_type = other DNA
ggcgcgccagtcctactttaaggtaacaccgagactggtacttggtttctggagacaggctaaggatgcccttcaggtaccccgaggtaacaagcgacactcgggatctgagaaggggattggggcttctatccaagcgcccaatttaaaaagcttctatgcctgaataggtgaccggaggccggcaccgactcggaccgatg

SEQ ID NO: 6535 - DNA, 203 bp, Homo sapiens
  source 1..203: mol_type = other DNA
ggcgcgccagtcctggctgaataccattttacagttgtttcgttacgtcgatgaacctttcttcgactgggtctacaactcgcccgagaacctcacgctgcgagcgattgaacagctcgaggaactcactgggcttgagttgcgcgagggaggaccacccgccctcgtgatttggaacatcaagcactcgactcggaccgatg

SEQ ID NO: 6536 - DNA, 203 bp, Homo sapiens
  source 1..203: mol_type = other DNA
ggcgcgccagtccttgctctacactggcatcggcacggcctcgcggcccagcgaggtatgcatggttgacggtactgacatgtgtcttgctgatttccacgcaggtatcttcttgaaaggtactgagcatgccgtgttcgccctgttgacttccgacggatggtacgccatagacgatgaggacttttcgactcggaccgatg

SEQ ID NO: 6537 - DNA, 203 bp, Homo sapiens
  source 1..203: mol_type = other DNA
ggcgcgccagtccttgctcgctgacaagaagacagaggagactgctcttttggaggaccgcatcctcaccacgaggcacggtaccactacttccaccacacagagttctgttgggatcacctacgggtatgccgacagtgactctttcaggcctggccccaatacctcgggcctcgagactcgtgtggcgactcggaccgatg

SEQ ID NO: 6538 - DNA, 203 bp, Homo sapiens
  source 1..203: mol_type = other DNA
ggcgcgccagtcctatggtggtttccaaaacactgaccccaagtccgcagatccaatctacggacatgtgtacaacccctcaaggaacgactgccacggtaggttttctaacctgctggacgtcgcagaggcgtgtcccacactcctcgacttcgatgggaagccatacgtggtgaccaaaaacagcgcgactcggaccgatg

SEQ ID NO: 6539 - DNA, 203 bp, Homo sapiens
  source 1..203: mol_type = other DNA
ggcgcgccagtcctcgggcattgaggtcaggggactacccaaaacacctgaggatgcagcacactgttaccattctgaatgggacacaggtctgaactcgagctacacgttcgcggtaccatacctgtcgtccggtgacttctcctacacgcacaccgacaccccagccatggccacaaccaacggctcgactcggaccgatg

SEQ ID NO: 6540 - DNA, 203 bp, Homo sapiens
  source 1..203: mol_type = other DNA
ggcgcgccagtcctaggtcacgacaccccgccgggtccataccgatgtggcgtttctccttgaccgcagcacacatgtgcacacgaacaagaccacctttgcggtggacctgatggacaccaaggagaaggcgctagtgggagcaatcctgcgctcagccacatactacttttgtgacctggaaatcacgactcggaccgatg

SEQ ID NO: 6541 - DNA, 203 bp, Homo sapiens
  source 1..203: mol_type = other DNA
ggcgcgccagtcctcatgtgtgggcgaacacaagcgcgtgttttggcagcctaacggtgcgccacgcacaacccagttgggcgacaacccaatggtgttctcccacaacaaagtgacccgctttgcaatcccgttcacagcgcctcacaggttgttgtccacggtctacaacggggagtgcgagtacacgactcggaccgatg

SEQ ID NO: 6542 - DNA, 203 bp, Homo sapiens
  source 1..203: mol_type = other DNA
ggcgcgccagtcctcaaaaacagtcaccgcaattcgcggtgatagagaggtgttggcgcggaaatactcttccgccaagcactctctgccatccaccttcaacttcgggtttgtgaccgccgacgagccagtcgacgtttactaccggatgaagcgtgcagagctgtactgcccccgtgccctgcttccgactcggaccgatg

SEQ ID NO: 6543 - DNA, 203 bp, Homo sapiens
  source 1..203: mol_type = other DNA
ggcgcgccagtccttgcagaacgacatgtccactaaacacggtcccgacttcaaccggttggtgaccgcatttgaggagctgacacaaggagttaaggctatcaaggatggtctcgacgaggccaagccctggtacaaaatcatcaaactcctgagccgcctgtcgtgcatggccgctgtagcagcaccgactcggaccgatg

SEQ ID NO: 6544 - DNA, 203 bp, Homo sapiens
  source 1..203: mol_type = other DNA
ggcgcgccagtccttcaccatgacggaccttgtgcctggtatcttggagaaacagcgtgatctcaatgatccgtccaagtatcatgaagcaaaggagtggctcgagaatgcccgccaggcatgcctcaagaacggcaatgtccacatcgccaacctttgcaaagtcacagcaccagcaccaagcaagtcgactcggaccgatg

SEQ ID NO: 6545 - DNA, 203 bp, Homo sapiens
  source 1..203: mol_type = other DNA
ggcgcgccagtcctcaagaccagaaccagtggtcgtttgcctccgtggtaaatctggccaaggtaaaagtttccttgcgaacgtgcttgcacaggcaatctccacccacttcacgggcagaaccgactctgtgtggtactgtccaccagaccctgaccacttcgacggctataaccaacaagctgtcgcgactcggaccgatg

SEQ ID NO: 6546 - DNA, 203 bp, Homo sapiens
  source 1..203: mol_type = other DNA
ggcgcgccagtccttggtgatggatgatctgggacagaatcccgatggcaaggacttcaagtacttcgcccaaatggtatcaaccacgggattcatcccgcccatggcgtccctcgaggacaaggggaaacctttcaacagcaaggtcatcattgcaacctccaatctgtattctgggttcaccccaccgactcggaccgatg

SEQ ID NO: 6547 - DNA, 203 bp, Homo sapiens
  source 1..203: mol_type = other DNA
ggcgcgccagtcctccgttgaaatgaagagactgcaacaagatatgttcaagcctcaaccaccaattctcaacgtctaccaacttgtggatgaggtgattgagagagtcaacctccacgagaaggttgcctcgcagccaatcttcaaacagatctcgcttccttcccaaaagtctgtgctctacttcccgactcggaccgatg

SEQ ID NO: 6548 - DNA, 203 bp, Homo sapiens
  source 1..203: mol_type = other DNA
ggcgcgccagtcctcactgaaggttaaagccaaagcccccgtcgtgaaggaaggaccatacgaggggccagtgaagaagcctgtcgctttgaaagtgaaagcaaagaacatgatagtcacggagagtggagcgccacctaccgacttgcaaaagatggtaatggccaacacaaagcctgttgagctcacgactcggaccgatg

SEQ ID NO: 6549 - DNA, 203 bp, Homo sapiens
  source 1..203: mol_type = other DNA
ggcgcgccagtcctagtcgatgctgctgcaaatgaaggcacacgttgaccctgaaccacaccacgaggggttaattgtggacaccagagatgttgaagagcgtgtacacgtcatgcgcaaaaccaaacttgcacccaccgttgcacacggtgtgttcaaccccgagtacgggcctgctgcactgtccacgactcggaccgatg

SEQ ID NO: 6550 - DNA, 203 bp, Homo sapiens
  source 1..203: mol_type = other DNA
ggcgcgccagtccttcggttgcaacccagatgttgattggcagagattcggaacccattttgcccagtacaaaaacgtgtgggacgtggactattcggcctttgatgctaaccactgcagtgacgccatgaacatcatgttcgaggaggtattccgtccggaatttggcttccaccccaatgcggagtcgactcggaccgatg

SEQ ID NO: 6551 - DNA, 203 bp, Homo sapiens
  source 1..203: mol_type = other DNA
ggcgcgccagtcctactcgatgatctcctacggagatgacatcgttgtggctagtgattacgatctggactttgaagcactcaagcctcacttcaaatctgtcggtcagaccatcaccccagctgacaaaagtgacaaaggttttgttcttggtcagtccatcactgacgtcactttcctcaagaggccgactcggaccgatg

SEQ ID NO: 6552 - DNA, 203 bp, Homo sapiens
  source 1..203: mol_type = other DNA
ggcgcgccagtcctagggtctctttgagattccaagctacagatcactttacctgcgttgggtgaacgccgtgtgcggtgacgcataatccctcagatgtcacaattggcagaaagactctgaggcgagcgacgccgtaggagtgaaaaggccgaaaggtcttttcccgcttccctgatttttgcgaacgactcggaccgatg

SEQ ID NO: 6553 - DNA, 203 bp, Homo sapiens
  source 1..203: mol_type = other DNA
ggcgcgccagtcctgtttaccggactgtctttaagaacttggcaatcaggagccctaaaggagctgtggctataatgaaatggggtgtcggttaccttaagaagagaaagcaaaagaggcaaaaatctagtggtggctatgaaattgaggctgcaagacaggctctctatccaattactttaggagttcgactcggaccgatg

SEQ ID NO: 6554 - DNA, 203 bp, Homo sapiens
  source 1..203: mol_type = other DNA
ggcgcgccagtcctatggtcattttttgtggctatcagagtggaaatgaacctgtgtgtgtcgatttcaacaatcagactaacatcgttccttatgagaatgggaaagttatctttgggaacgtcaccattgtccctccaattgatagatttggtcttttgattccaacagacaattatgacactatacgactcggaccgatg

SEQ ID NO: 6555 - DNA, 203 bp, Homo sapiens
  source 1..203: mol_type = other DNA
ggcgcgccagtcctgagtgcgttaggatgagtcctggcattgaattgagtgaagaagtttgtggattcatggggccaaagtatgatgtccttttgagaacacaatggggaaaaagagagacagaacacatgcacagaactagaagaagtgttacagagacaacccatgagagctctggtggagaacatcgactcggaccgatg

SEQ ID NO: 6556 - DNA, 203 bp, Homo sapiens
  source 1..203: mol_type = other DNA
ggcgcgccagtcctgagaaatttgacatcatagaagctggtggctacacgaaaatgacaacattccttaaacatgacaaatgtttcatggttagggttccagaacatgatgtggttgaaataacagttgttaagaaaacaattaggccaactactgggtgtaaaacattcttactaggggctagtgtccgactcggaccgatg

SEQ ID NO: 6557 - DNA, 203 bp, Homo sapiens
  source 1..203: mol_type = other DNA
ggcgcgccagtcctaagattaccatgccattgattccatcattaccttaccaagtaactttaattggtcttgatccaaaatatggtattaccatttatagggttgattcccaggaagagtacacaaatttggccaaagttttaagtgaaaaatatgatctggttaggaaaataacaggttggtatggacgactcggaccgatg

SEQ ID NO: 6558 - DNA, 203 bp, Homo sapiens
  source 1..203: mol_type = other DNA
ggcgcgccagtcctagagcactaattggagacaaaatgttgttctgcgaggcaaactgggttgattgtaacactcatgattatgaattaagcttttggacatcagcattgatcacaacaaaaagccgaagttatgaacataaaccttgcaaaattcaacctaaagatgagatctttgaagatgccgatcgactcggaccgatg

SEQ ID NO: 6559 - DNA, 203 bp, Homo sapiens
  source 1..203: mol_type = other DNA
ggcgcgccagtcctctaataattccaactgttttccagttaatggtgaatggaataataacgtcaattgtctcaataacagtgttcttttgcgggagcatgaagaatacgttggtaactgcaacagacatagtagaagggatcaatcttggacactggaaaaggactgccatggtgacactaatggtgcgactcggaccgatg

SEQ ID NO: 6560 - DNA, 203 bp, Homo sapiens
  source 1..203: mol_type = other DNA
ggcgcgccagtcctctctgctggaaatatcaaattggaattggctatgttcacaatggcactctcaccacccaataccacgtcacttgtggccgagatctttggtggaagggtaaaagttactctccagttgaagagaatgttgtctctgactatgcttgttactttggtccgtggtctttcccgaaacgactcggaccgatg

SEQ ID NO: 6561 - DNA, 203 bp, Homo sapiens
  source 1..203: mol_type = other DNA
ggcgcgccagtcctgctggcaactccatcgtatttggaggtgaaagtgtccaggtgggtgagaacccttcctttgctcctcacttggacggtaaaattaaacagttgctcaacacaaggggatgctgggaagaatttgttctaaagtgtggagctggaaaaacaagaggtgtaatcaaggatacaatccgactcggaccgatg

SEQ ID NO: 6562 - DNA, 203 bp, Homo sapiens
  source 1..203: mol_type = other DNA
ggcgcgccagtcctagagtctttagtggcattaggatgcaatcatcaggagagggttgtgaattgttctcaattttatttggggttcaatgttatggatggatgacttactttgacatgccagcgtcttggatagctttggctcaccaagctttgccgccacaatggagggagactatcaccccaatgcgactcggaccgatg

SEQ ID NO: 6563 - DNA, 203 bp, Homo sapiens
  source 1..203: mol_type = other DNA
ggcgcgccagtcctcccatctggcaaattctttttgtggtcttcattacagtcatagttgtggaaacagtttgtggtataacacagagggagaagtcaactggtgaagtcactcaactagtaaccataggtgcagtgatcttcattatctattacatactggctgatggtgaaatactgaccttaatccgactcggaccgatg

SEQ ID NO: 6564 - DNA, 203 bp, Homo sapiens
  source 1..203: mol_type = other DNA
ggcgcgccagtcctcctgatttgaacggtaaaaaggtctacaaaaaatttaattgggaaattggagacttatttaaaaagagaattagatgtgacacatttgtcatggacattggagaatctcatcccaatcaagagattgaagccataggagatctaaaaaggttgaattggtttaaagaaaatgtgcgactcggaccgatg

SEQ ID NO: 6565 - DNA, 203 bp, Homo sapiens
  source 1..203: mol_type = other DNA
ggcgcgccagtcctgattgtaagaattggtgcattaaaataatggtaccaactcatgaacaggtgctacatgctctcccaaaaggttccacattaattcgaaacccttggagcagaaattctaccttggaaatgtattgtgttccagggtcgaatgaaccagggagaatggttagtaatgtgattaaacgactcggaccgatg

SEQ ID NO: 6566 - DNA, 203 bp, Homo sapiens
  source 1..203: mol_type = other DNA
ggcgcgccagtcctccaccccaacctttgggtaactacaaaagtgaatttcaagagaagttcaaatgggttcaacaatggtacaaatcaaaaaacaagcatggtaggatactaactaatgaggaagttatttcaaaatttaagagtgatggtgctctcggctttaggtgccaacattatggatccatacgactcggaccgatg

SEQ ID NO: 6567 - DNA, 203 bp, Homo sapiens
  source 1..203: mol_type = other DNA
ggcgcgccagtcctgttcgccactccttggacatggagcgtggttccacaattcacaccaatgagagatcaaattggaaaaagtttctccttgagaaaatggttccagatctaagtaggagaaataatacagctccaaacatgaattggttggttaggaatggaaacaggggtaatcttttagtttaacgactcggaccgatg

SEQ ID NO: 6568 - DNA, 203 bp, Homo sapiens
  source 1..203: mol_type = other DNA
ggcgcgccagtcctgcttcacgcacctcgcgtgaccggccagtactcttaccactttccgcctacttggtcgtcagcgctgttttgggcactcctgttgggggctgttcgacgctccacggtctcctccgtactgacatctacggtgttggggccgccacgtgcgagccgctcgcctggtgtgcttcgcgactcggaccgatg

SEQ ID NO: 6569 - DNA, 203 bp, Homo sapiens
  source 1..203: mol_type = other DNA
ggcgcgccagtcctactgtcacccgacgcccgcctttcacccccccccccctaggttctaccgtcgttcccgacgtttgaagggaggaaaccacacgcttgcaacaccactcccggtgtcaacgggatgcaaccgcaagatggaccttcgcccggaagtaaaacggcagctttacacagttttgcccgcgactcggaccgatg

SEQ ID NO: 6570 - DNA, 203 bp, Homo sapiens
  source 1..203: mol_type = other DNA
ggcgcgccagtcctcggtccactggcgggtgttagtagcagcactgttgtttcgtagcggagcatggtggccgtgggaactcctccttggtgacaagggcccacggggccgaaagccacgtccagacggacccaccatgtgtgcaaccccagcacggcaacttttactgcgaacaccaccttaaggtgcgactcggaccgatg

SEQ ID NO: 6571 - DNA, 203 bp, Homo sapiens
  source 1..203: mol_type = other DNA
ggcgcgccagtcctacactggtactggtactcggtcactggtgacaggctaaggatgcccttcaggtaccccgaggtaacacgggacactcgggatctgagaaggggattgggacttctttaaaagtgcccagtttaaaaagcttctacgcctgaataggcgaccggaggccggcgcctttccattaccgactcggaccgatg

SEQ ID NO: 6572 - DNA, 203 bp, Homo sapiens
  source 1..203: mol_type = other DNA
ggcgcgccagtcctccactactaaatccatgaatacgactgactgttttatcgctctgctatacgctctcagagagatcaaagcactgtttctgtcacgaacacaagggaagatggaattcacactttacaacggtgaaaagaaggtcttctactccagacccaacaaccacgacaactgttggctgacgactcggaccgatg

SEQ ID NO: 6573 - DNA, 203 bp, Homo sapiens
  source 1..203: mol_type = other DNA
ggcgcgccagtcctacgccatcctccaactgttcaggtacgttgacgagcccttcctcgaatgggtctacgactcacctgagaacctcactctcgaggcgatcaacaaactggaagaaatcacaggtcttgagctacacgaggggggaccgcccgcccttgtcgtctggaacatcaagcacttgctctcgactcggaccgatg

SEQ ID NO: 6574 - DNA, 203 bp, Homo sapiens
  source 1..203: mol_type = other DNA
ggcgcgccagtcctggacaccaaatccggccgacgttttggtttttgttccgtacgatcaagaaccattcaacgcagaatggaaagcaaaggttcagaagcggctcaggggcgccgggcaatccagcccgacgaccgggtcacaaaaccaatctggcaacactggcagcattattaacaattactacacgactcggaccgatg

SEQ ID NO: 6575 - DNA, 203 bp, Homo sapiens
  source 1..203: mol_type = other DNA
ggcgcgccagtcctccgaacggttcttcaaaacccacctgtttgactgggtcaccagtgacccgtttgggcggtgtcacttgttggagctaccgactgaccacaaaggcgtctacggtagcctgaccgactcgtacgcatacatgaggaatggttgggacgttgaagtcaccgcagtgggtaaccaatcgactcggaccgatg

SEQ ID NO: 6576 - DNA, 203 bp, Homo sapiens
  source 1..203: mol_type = other DNA
ggcgcgccagtcctagataacacacgggaaagccgacggtgacgccctggtcgtgctagctagtgctggcaaagactttgacttgcgtctgccggtcgacgcccgaacccaaaccacctctgcgggtgagtctgcggaccccgtgactgccaccgtcgagaactacggtggtgagacacaagtccagacgactcggaccgatg

SEQ ID NO: 6577 - DNA, 203 bp, Homo sapiens
  source 1..203: mol_type = other DNA
ggcgcgccagtcctggcgccagcacacggacattgcgttcatactggacaggttcgtgaaagtcaagccaaaggaacaagttaatgtgttggacctgatgcagatccctgcccacaccttggtaggggcgctcctgcgaacggccacctactacttctctgacctggagctggccgtcaagcacgaggcgactcggaccgatg

SEQ ID NO: 6578 - DNA, 203 bp, Homo sapiens
  source 1..203: mol_type = other DNA
ggcgcgccagtcctgcgatctcacctgggtcccaaacggcgcccctgagacagcactggacaacactaccaacccaacagcttaccacaaggaacccctcacacggctggcgctgccttacacggctccacaccgtgtcttagcgaccgtctacaacgggagcagtaagtacggtgacaccagcactacgactcggaccgatg

SEQ ID NO: 6579 - DNA, 203 bp, Homo sapiens
  source 1..203: mol_type = other DNA
ggcgcgccagtcctccatcatgctggccgacaccggcctcgagattctggacagcaccttcgtggtaaagaagatctccgactcgctctccagtctcttccacgtgccggctcccgccttcagtttcggagccccgatcctgttggccgggttggtcaaagtcgcctcgagtttcttccagtccacaccgactcggaccgatg

SEQ ID NO: 6580 - DNA, 203 bp, Homo sapiens
  source 1..203: mol_type = other DNA
ggcgcgccagtcctccgaagacctcgagagagcagaaaagcagctcaaagcacgtgacatcaacgacatatttgccgttcttaagaacggtgagtggctggtcaaactgatcctggccatccgcgactggattaaggcatggatcgcctcagaagagaagtttgtcaccatgacagacctggtgcctgcgactcggaccgatg

SEQ ID NO: 6581 - DNA, 203 bp, Homo sapiens
  source 1..203: mol_type = other DNA
ggcgcgccagtcctgcatccttgaaagacaacgggatctcaatgaccccggcaaatacaaggaggccaaggaatggctggacaacgcgcgtcaagcgtgtttgaagagcgggaacgtgcacattgccaatctgtgtaaggtggtcgctccggcgcccagcaagtcgagacccgaaccagtggtcgtgtcgactcggaccgatg

SEQ ID NO: 6582 - DNA, 203 bp, Homo sapiens
  source 1..203: mol_type = other DNA
ggcgcgccagtcctgccttcgcggcaaatccggccaagggaaaagctttctcgcgaacgttctcgcgcaggcaatttccacacacttcactggtaggaccgactcggtctggtactgcccgcccgaccctgaccactttgacggttacaatcagcagaccgtcgtcgtgatggacgacttgggccaaacgactcggaccgatg

SEQ ID NO: 6583 - DNA, 203 bp, Homo sapiens
  source 1..203: mol_type = other DNA
ggcgcgccagtcctacccagacggcaaagacttcaagtactttgcccaaatggtatccaccacggggttcatcccgcctatggcctcgctcgaggataagggtaaacccttcaacagcaaggtcataatagctacaaccaacctgtactcgggattcaccccaaagaccatggtgtgccccgatgcgccgactcggaccgatg

SEQ ID NO: 6584 - DNA, 203 bp, Homo sapiens
  source 1..203: mol_type = other DNA
ggcgcgccagtcctttaaccggaggtttcactttgacatcgacgtgagcgccaaagacgggtacaagatcaacaacaaactggacatagtcaaagcacttgaagacacccacgctaacccggtggcgatgttccaatacgactgcgctcttctcaacggaatggccgttgaaatgaagagaatgcagccgactcggaccgatg

SEQ ID NO: 6585 - DNA, 203 bp, Homo sapiens
  source 1..203: mol_type = other DNA
ggcgcgccagtcctcgcgcaagaggtaccaatcggtggatgacccactggacggcgacgtaactcttggcgacgcggaaaagaaccctctggagacgagtggcgctagcgctgtcggtttccgagagagatcccccaccgagcaagggacgcgcgaagacgcgaacgctgagcccgtcgtgttcggtacgactcggaccgatg

SEQ ID NO: 6586 - DNA, 203 bp, Homo sapiens
  source 1..203: mol_type = other DNA
ggcgcgccagtcctctgcctacctcgtgcctcgtcatctcttcgcggaaaagtacgacaagatcatgttggacggcagagccttgacagacagtgactacagagtgtttgagtttgagattaaagtaaaaggacaggacatgctctcagacgccgctctcatggtgttgcaccgtgggaatcgcgtgccgactcggaccgatg

SEQ ID NO: 6587 - DNA, 203 bp, Homo sapiens
  source 1..203: mol_type = other DNA
ggcgcgccagtcctgtgacatcacgaaacactttcgtgacgtagcgagaatgaagaagggaacccccgtcgtcggtgtgatcaacaatgctgacgtcgggagactcatattctctggtgaagcccttacttacaaggacatcgtcgtgtgtatggatggagacaccatgcctgggctctttgcctacacgactcggaccgatg

SEQ ID NO: 6588 - DNA, 203 bp, Homo sapiens
  source 1..203: mol_type = other DNA
ggcgcgccagtcctaggggttgatcgtcgacaccagagatgtggaggagcgtgtccacgtgatgcgcaaaaccaagctcgcgcccaccgtggcgcacggtgtgttcaaccctgagttcgggcctgccgctctgtccaacaaggacccgcgcctgaacgaaggggttgtccttgacgatgtcattttctcgactcggaccgatg

SEQ ID NO: 6589 - DNA, 203 bp, Homo sapiens
  source 1..203: mol_type = other DNA
ggcgcgccagtcctcgcccggtctcccctgggctctccaagggaaacgccgcggcgccctgatcgacttcgaaaacggcaccgtcgggcctgaggttgaggcagcactcaagctcatggaaagccgcgagtacaaattcgtctgccaaaccttcctgaaggacgaaattcggccgctagaaaaggtaccgactcggaccgatg

SEQ ID NO: 6590 - DNA, 203 bp, Homo sapiens
  source 1..203: mol_type = other DNA
ggcgcgccagtcctgcgctggcaagacacgcattgtcgacgtgttgcctgttgaacacattctctacaccagaatgatgattggcagattctgtgctcagatgcattcaaacaagggaccgcaaattggatcagcggtcggttgtaaccctgacgttgattggcaaagatttggcacacatttcgccccgactcggaccgatg

SEQ ID NO: 6591 - DNA, 203 bp, Homo sapiens
  source 1..203: mol_type = other DNA
ggcgcgccagtcctttgttgttgaaggtggaatgccgtccggttgttccgcaacaagcatcatcaacacaattttgaacaacatctacgtgctttacgccctgcgtaggcactatgagggagtcgagctggacacttacaccatgatctcttatggagacgacatcgtggtggcaagtgactacgacccgactcggaccgatg

SEQ ID NO: 6592 - DNA, 203 bp, Homo sapiens
  source 1..203: mol_type = other DNA
ggcgcgccagtcctctgattgtttccgcaagcatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggcgactcggaccgatg

SEQ ID NO: 6593 - DNA, 203 bp, Homo sapiens
  source 1..203: mol_type = other DNA
ggcgcgccagtcctggattgtcttgtccgggaagccggcaattatacctgacagggaggttctctaccaggagttcgatgagatggaagagtgctctcagcacttaccgtacatcgagcaagggatgatgctcgctgagcagttcaagcagaaggccctcggcctcctgcagaccgcgtcccgccaagcgactcggaccgatg

SEQ ID NO: 6594 - DNA, 203 bp, Homo sapiens
  source 1..203: mol_type = other DNA
ggcgcgccagtcctttttttttttttttccttttttttttttttttttttctttccttcttttttcctttcttttccttccttctttaatggtggctccatcttagccctagtcacggctagctgtgaaaggtccgtgagccgcatgactgcagagagtgctgatactggcctctctgcagatcatgtcgactcggaccgatg

SEQ ID NO: 6595 - DNA, 203 bp, Homo sapiens
  source 1..203: mol_type = other DNA
ggcgcgccagtcctaatgcagtattgggtagaaagaaacaaaggtctgccaagacggtgtgggttctcttcagcatgttggctttgatggtggccatggagattgagcaacagggcacgtcattagtcattaagcctcaaaggagtgatgttggacggccagttcgagttagcacaggctactgcatgcgactcggaccgatg

SEQ ID NO: 6596 - DNA, 203 bp, Homo sapiens
  source 1..203: mol_type = other DNA
ggcgcgccagtcctttctccgctatggacattgggataacgtgtgagaaaaccatacagtatgagtgtgttactttaaccacatctgaagagccgtttgatgttgattgttactgtaggaatgtcacaaatgtgttggttgagtattcaacgtgcaatccaacagtggaacgtgcaaaaaggtctctgcgactcggaccgatg

SEQ ID NO: 6597 - DNA, 203 bp, Homo sapiens
  source 1..203: mol_type = other DNA
ggcgcgccagtcctgtgatccaagatcacccacactctgaaactgtggctaaaccaacactgtggctgaaatggaatacagttaatgatcgagtgggcatgactgaggaatgggtgatgagaaatacctggaaggcaacaattcttaccctggctattatagctgtcactggactcaactggaaaggacgactcggaccgatg

SEQ ID NO: 6598 - DNA, 203 bp, Homo sapiens
  source 1..203: mol_type = other DNA
ggcgcgccagtcctcctggagggcatgttgattgccgagttagcctagtgaacctgaagctaaagggaacaacttacccttattgtggtgactcattcgtttggaagcggcgccctacggctacccatcatggtacagttgcaatggaagtcacctaccaaggaactgatgttccgtgcaaggtatctcgactcggaccgatg

SEQ ID NO: 6599 - DNA, 203 bp, Homo sapiens
  source 1..203: mol_type = other DNA
ggcgcgccagtcctgttatcgtggaaaaagatggacagaacggaggtaatgcaggaagtttgattacatcaaatccaatcatcacagcacaagggtcatcagtgttcttagaactggaggttccactgggtttttccactattaaggttggtgcagcaaaacagcaatggagacaggatggcagttcacgactcggaccgatg

SEQ ID NO: 6600 - DNA, 203 bp, Homo sapiens
  source 1..203: mol_type = other DNA
ggcgcgccagtcctgaaatcaatgacttcaagcatggttacaagtattatcctgaggacccagaaacattcctggcaagtttggttcaagacggtgaaaaacactgtgggtatcaaccttcaaacctgatagagttgcgaatgtggcagtctctagaaaaggaattgaacctttacttggaagaccagcgactcggaccgatg

SEQ ID NO: 6601 - DNA, 203 bp, Homo sapiens
  source 1..203: mol_type = other DNA
ggcgcgccagtcctatgattgtgcatggctctccttggatgtggatggagagctatgaagtgaatggaactgtgcaactacaaaagttgactctcacccacacagttgaatgtctctggccaattacacacactcttggaaacagaatggttttggactccaaattgatattgccaaaagaaatgggacgactcggaccgatg

SEQ ID NO: 6602 - DNA, 203 bp, Homo sapiens
  source 1..203: mol_type = other DNA
ggcgcgccagtcctggtccagcttctatcttgaatatggttgaaggctattcagaacaaaacaagtgtccctggaatcaaggtcctgtgacagtggaaagaggttattgtgaagggactgaagttgagatatccgaagactgtgaagaaaggggaccttgtacgaggtcaaaaacccaaggaggaacacgactcggaccgatg

SEQ ID NO: 6603 - DNA, 203 bp, Homo sapiens
  source 1..203: mol_type = other DNA
ggcgcgccagtcctctggttctttactacctaggcattctaacaaagattgaaaaagggaattggggaccttccttgattgtcacaatctccatcatgatgtggttacatatcatcgatgtaactgaattgttgcattacttgttggctgttggttacacatttgtctggcaaacatctgagcccatgcgactcggaccgatg

SEQ ID NO: 6604 - DNA, 203 bp, Homo sapiens
  source 1..203: mol_type = other DNA
ggcgcgccagtcctctgtggattgtggccatgcaagctatttttcagttgagacctgggtttgctgtagggttcgccctgtgcaaaacctggaggtttgaacggattgtcggcatggttgcttgcatgtggacaattcaagagttaacaactccatatgaagccttttggagatttatggatgcactgcgactcggaccgatg

SEQ ID NO: 6605 - DNA, 203 bp, Homo sapiens
  source 1..203: mol_type = other DNA
ggcgcgccagtcctggcttgcttgtgtatgcttactcagcctcccactcaacacgacagagttatctctatgtcgtcttgatgctatcactcaccaaaattcagaatgcgacaatcagactggctgttggaatgtttggtaccatgctactaatgttagtaggaaggaagtttgctgagagtgattggcgactcggaccgatg

SEQ ID NO: 6606 - DNA, 203 bp, Homo sapiens
  source 1..203: mol_type = other DNA
ggcgcgccagtcctaatacagatccttggataattggagttatggcattggtccttcttttctttctttttcaggttagttctggagagatggtagcagagtgggctgggtaccacgagtggaaaaaggactgtcctaagtctgttggttctataagtcttgaagtgaagagaatggctgatggcagacgactcggaccgatg

SEQ ID NO: 6607 - DNA, 203 bp, Homo sapiens
  source 1..203: mol_type = other DNA
ggcgcgccagtcctgtgagttttcattcatcagctgtgtcaagtaaaacacctggaagtctgattgatgtgatgtgtcatgccacatttgttaaccgcaaattaatccatatgcctcaaaagaactatgaacttatcatcatggatgaagcacattggacggacccatccagcatagcggctaggggacgactcggaccgatg

SEQ ID NO: 6608 - DNA, 203 bp, Homo sapiens
  source 1..203: mol_type = other DNA
ggcgcgccagtcctaggaccgcctggtttgttccctcccagaatgctgcgcaagggattgcgaaaaccttaagggagcatgggaagaaagttgctatcttgacaagtaaaacctttcatgatgtgtatccaaaattgaaaactgaaaagcctgattttattttgacaacagacatttctgaaatgggtcgactcggaccgatg

SEQ ID NO: 6609 - DNA, 203 bp, Homo sapiens
  source 1..203: mol_type = other DNA
ggcgcgccagtcctgctcccgtgtggctggacaccagactaaccagagaaaggaaagatttggctgggttcatagaatatgctgagaagaggagaagtagtgttttaacagccatcccaggactgctttatagtaggttcttgtcagcctttgacaccatttacatctactccacttctgatccatctcgactcggaccgatg

SEQ ID NO: 6610 - DNA, 203 bp, Homo sapiens
  source 1..203: mol_type = other DNA
ggcgcgccagtccttggattggaggagctcctttgagtctggttgcagcactggttttgatatcatttattttgcttgtgtgcttaataccagagcagggaatgcagaggacccaaatagacaccacattggctacactggttttggctattgtgacatttggcttacttgtgtttgccaatgagatgcgactcggaccgatg

SEQ ID NO: 6611 - DNA, 203 bp, Homo sapiens
  source 1..203: mol_type = other DNA
ggcgcgccagtcctagatggcttgaaaacacaaagaaagatttgtttggccagcctcaaactagtcctagtgtgaatactggaggaatcatccaggatctccttcagcttgatattagaccaatgaatgtgtggggaacctatgttgcactggtgacggttgctcggccacaagcgctccataatctacgactcggaccgatg

SEQ ID NO: 6612 - DNA, 203 bp, Homo sapiens
  source 1..203: mol_type = other DNA
ggcgcgccagtcctaaaatgttcactaagaagatagtgtcgggagtggtcgcaggaaaggagagtgcaatggaaagactcccgaccggtggagcttggatgaatctcaggatgggtgacctcactcttctggcaacaaccttgaagggaatgacctgtttcaatctattgggaggtttaacctttgctcgactcggaccgatg

SEQ ID NO: 6613 - DNA, 203 bp, Homo sapiens
  source 1..203: mol_type = other DNA
ggcgcgccagtccttggttgaatgagatgcaaaaaattaggaaggacattgacctgtggaaaccttcagcaggtcattgcaactgggaggaagtagagttctgttccaaccactttcacaagcttgttatgagagatgggagaaccttggttgttccttgcagacatgaagttgagcttgtggggcgtcgactcggaccgatg

SEQ ID NO: 6614 - DNA, 203 bp, Homo sapiens
  source 1..203: mol_type = other DNA
ggcgcgccagtcctgccagcgtcaaccagggtggttcaacagggatttctgggactgcttgtttagctaaggcatatgcacaaatgtggctgcttctttacttccacaggagagatctcagaattttgggaatggcaatttgttcagcagttccagccaactgggttccaacaggacgaacgacctggcgactcggaccgatg

SEQ ID NO: 6615 - DNA, 203 bp, Homo sapiens
  source 1..203: mol_type = other DNA
ggcgcgccagtcctactaatggaaaaaatgcgagtgagggcaactctgggattagctcaatgggtgtgacgaccctacccttccgcatttgtaaataattgagccagtcatttccgtagggaagagagttattcgctcctctcgagattgagcggcctgctccttggagcatgagatgggaggcccgacgactcggaccgatg

SEQ ID NO: 6616 - DNA, 203 bp, Homo sapiens
  source 1..203: mol_type = other DNA
ggcgcgccagtcctagcaaagctgaaaggactagcggttagaggagaccccttccatctctggtatcaaatttcatggagtttactccatggtggctagaacccatagcgggggtgaaccacattggctaaggttcaccagcttttgctcccgcgtttttcaaattgcctcatcttgaatggggggcgcgactcggaccgatg

SEQ ID NO: 6617 - DNA, 203 bp, Homo sapiens
  source 1..203: mol_type = other DNA
ggcgcgccagtcctacacctataatcttattatgtgtaggtgccttaatatttaccaaactagcatcaactatagaagtgggattagagaccacagtcagaagagctaaccgtgtactaagtgatgcactcaaaagataccctaggatggacataccaaaaatcgctagatctttctatgatttatttcgactcggaccgatg

SEQ ID NO: 6618 - DNA, 203 bp, Homo sapiens
  source 1..203: mol_type = other DNA
ggcgcgccagtcctggcttaggcataataggtatgtatcgcgggagagtgccaaacacagaactattttcagcagcagaaagctatgccaagagtttgaaagaaagcaataaaattaacttttcttcattaggactcacagatgaagaaaaagaggctgcagaacactttctaaatgtgagtgacgaccgactcggaccgatg

SEQ ID NO: 6619 - DNA, 203 bp, Homo sapiens
  source 1..203: mol_type = other DNA
ggcgcgccagtcctgattatgaccatgaacaatcccaaaggcatattcaagaagcttggagctgggacccaagttatagtagaactaggagcatatgtccaggctgaaagcataagtaaaatatgcaagacttggagccatcaaggaacaagatatgtgctgaagtccagataacagccaagcaacctcgactcggaccgatg

SEQ ID NO: 6620 - DNA, 203 bp, Homo sapiens
  source 1..203: mol_type = other DNA
ggcgcgccagtcctctcaaaacagtctctgctgaccaattggcaagagaggaacaaattgagaatcccagacaatctaggtttgttctaggagcaatagcactcggtgttgcaacagcagctgcagtcacagcaggtgttgcaattgccaaaaccatccggcttgagagtgaagtcacagcaattaagcgactcggaccgatg

SEQ ID NO: 6621 - DNA, 203 bp, Homo sapiens
  source 1..203: mol_type = other DNA
ggcgcgccagtcctaacagaaggtttctaaatgttgtgcggcaattttcagacaatgctggaataacaccagcaatatctttggacttaatgacagatgctgaactagccagggccgtttctaacatgccgacatctgcaggacaaataaaattgatgttggagaaccgtgcgatggtgcgaagaaagcgactcggaccgatg

SEQ ID NO: 6622 - DNA, 203 bp, Homo sapiens
  source 1..203: mol_type = other DNA
ggcgcgccagtcctagtatggttgcactgtctcctcttggggctctggttgcttgctacaaaggagtaagctgttccattggcagcaacagagtagggatcatcaagcagctgaacaagggttgctcctatataaccaaccaagatgcagacacagtgacaatagacaacactgtatatcagctaagccgactcggaccgatg

SEQ ID NO: 6623 - DNA, 203 bp, Homo sapiens
  source 1..203: mol_type = other DNA
ggcgcgccagtcctaaaataaaatttgggacaaatcataatgtctcgcaaggctccatgcaaatatgaagtgcggggcaaatgcaacagaggaagtgagtgtaagtttaaccacaattactggagttggccagatagatacttattaataagatcaaactatctattaaatcagcttttaaggaacaccgactcggaccgatg

SEQ ID NO: 6624 - DNA, 203 bp, Homo sapiens
  source 1..203: mol_type = other DNA
ggcgcgccagtcctggaagggctagggttgagaagtaatctgcaaggtatgttaactaataaactatatgaaactgtagattatatgctaagcttatgttgcaatgaaggtttctcacttgtgaaagagttcgaaggttttattatgagtgagatccttaggattactgaacatgctcaattcagtaccgactcggaccgatg

SEQ ID NO: 6625 - DNA, 203 bp, Homo sapiens
  source 1..203: mol_type = other DNA
ggcgcgccagtcctagaagagcaaagtggtctatatagatatcacatgggcggtattgaaggatggtgtcaaaaactctggacaatggaagctatatctttattggatgttgtatctgtaaagacacggtgtcaaatgacatctttattaaacggtgacaaccaatcaatagatgtaagtaaaccagtcgactcggaccgatg

SEQ ID NO: 6626 - DNA, 203 bp, Homo sapiens
  source 1..203: mol_type = other DNA
ggcgcgccagtcctcaagttatctgaaggtttagatgaagtgaaggcagattatcgcttagcagtaaaaatgctaaaagaaataagagatgcatacagaaatataggccataaacttaaagaaggggaaacatatatatcaagggatcttcagtttataagcaaggtgattcaatctgaaggagtgatcgactcggaccgatg

SEQ ID NO: 6627 - DNA, 203 bp, Homo sapiens
  source 1..203: mol_type = other DNA
ggcgcgccagtcctagctgttggatcagaacgacaagcaaaagtaacaagtgacatcaatagaacagcagttaccagtatcttaagtctttccccaaatcaacttttcagtgatagtgctatacactacagcagaaatgaagaagaagtgggaatcattgcagaaaacataacacctgtttatcctcacgactcggaccgatg

SEQ ID NO: 6628 - DNA, 203 bp, Homo sapiens
  source 1..203: mol_type = other DNA
ggcgcgccagtcctaatgagatgggtgtataaagggacaccaggcttgcgacgattactcaacaagatctgtcttgggagtttaggcattagctacaaatgtgtaaaacctttattacctaggtttatgagtgtaaatttcttacatagattatctgtcagtagtagacctatggaattcccagcatccgactcggaccgatg

SEQ ID NO: 6629 - DNA, 203 bp, Homo sapiens
  source 1..203: mol_type = other DNA
ggcgcgccagtcctggacttcaaaatattcctatgtgtctttaaaactaaacttttatgtagttggggatctcaagggaaaaacattaaagatgaagatatagtagatgaatcaatagataaattgttaaggattgacaatactttttggagaatgttcagcaaagttatgtttgaaccaaaggttaacgactcggaccgatg

SEQ ID NO: 6630 - DNA, 203 bp, Homo sapiens
  source 1..203: mol_type = other DNA
ggcgcgccagtccttatgaaagacctaaatcctaaagttttgtactttattggagaaggagcaggaaattggatggccagaacagcatgtgaatatcctgatattaaatttgtatatagaagtctgaaagatgaccttgatcatcattatcctctggaataccagagagtgataggtgaattaagcagcgactcggaccgatg

SEQ ID NO: 6631 - DNA, 203 bp, Homo sapiens
  source 1..203: mol_type = other DNA
ggcgcgccagtcctttataatcctagagtgccaaggagttgcgtgtcatcattgattgggaagatcaaggaaacaatttgttccaataatatcgtacatcttgactaagtcgaacaaggggaagtcgatatggatcgtgggaccagaagaatctgggtgtcgcaaaatcaaggtgatactgatttagacgactcggaccgatg

SEQ ID NO: 6632 - DNA, 203 bp, Homo sapiens
  source 1..203: mol_type = other DNA
ggcgcgccagtcctactgcctgaagaggagactacagaagcaaatgcagggcaatttctctcatttgcgagtttgtttcttcccaaactggttgtgggagagaaggcttgcttggaaaaagtccagcgacaaattcaggttcatgcagaacagggtttaattcaatatcccactgcatggcaatcagtcgactcggaccgatg

SEQ ID NO: 6633 - DNA, 203 bp, Homo sapiens
  source 1..203: mol_type = other DNA
ggcgcgccagtccttggacacatgatggtaatcttcagattgatgaggactaatttcttgattaaatatttactgatccaccagggtatgcatatggtagctggccacgatgccaatgatgctgtcattgctaattcagttgctcaggctcgcttttcaggactcctaattgtcaaaaccgttcttgacgactcggaccgatg

SEQ ID NO: 6634 - DNA, 203 bp, Homo sapiens
  source 1..203: mol_type = other DNA
ggcgcgccagtccttcatattctgcaaaaaaccgaccaaggagtaagacttcaccctttggcccgaacagccaaagtgcgtaatgaggttaatgcatttaaggccgccctaagctcacttgctaagcatggggaatatgccccttttgctcgccttctcaatctctcgggagttaacaacctagaacacgactcggaccgatg

SEQ ID NO: 6635 - DNA, 203 bp, Homo sapiens
  source 1..203: mol_type = other DNA
ggcgcgccagtcctaataccgttccctgggcctataagcaacaacccagaccaagatcatctggaggatgatcctagagactccagagacaccatcattcctaatggtgcaattgaccccgaggatggtgattttgaaaattacaatggctatcatgatgatgaagttgggacggcaggtgacttggtcgactcggaccgatg

SEQ ID NO: 6636 - DNA, 203 bp, Homo sapiens
  source 1..203: mol_type = other DNA
ggcgcgccagtcctacaaggaggtcaatacaactggcaccgaggcccagaacgtacgaccgccaatcgaagactctcaccagtgcacgaagaggacacccttatggatcaaggtgatgatgatccctcaagcttacctccgctggaatctgatgatgacgatgcatcaagtagccaacaagatcccgacgactcggaccgatg

SEQ ID NO: 6637 - DNA, 203 bp, Homo sapiens
  source 1..203: mol_type = other DNA
ggcgcgccagtcctgaatgcgcttaaaggaaaaatcgatgatccaaacagctatgtaccagatgctgtgcaagaggcttacaagaaccttgacagtacatcgaccctgaccgaggaaaattttgggaaaccttatatatctgctaaagacctgaaggagatcatgtatgatcatctacctggttttggcgactcggaccgatg

SEQ ID NO: 6638 - DNA, 203 bp, Homo sapiens
  source 1..203: mol_type = other DNA
ggcgcgccagtcctctgcaacctggacagacgaaactccagcaggagcagtcaatgctcttcgtcctgggctctcactccatcccaagcttcgtccaattctcctgccggggaagacaggaaagaaaggacatgcttcagacttaacatcacctgacaagattcaaacaatcatgaatgcaataccggcgactcggaccgatg

SEQ ID NO: 6639 - DNA, 203 bp, Homo sapiens
  source 1..203: mol_type = other DNA
ggcgcgccagtcctgaattgcaaccgatgtcccatcagcaacaaaacgctggggatttcgttcaggtgtgcctcccaaggtggtcagctatgaagccggagaatgggcagaaaattgctacaatctggagatcaaaaagtcagacggaagtgaatgcctccctctccctcccgacggtgtacgaggatcgactcggaccgatg

SEQ ID NO: 6640 - DNA, 203 bp, Homo sapiens
  source 1..203: mol_type = other DNA
ggcgcgccagtcctgcatttccaaattccatcaacccacaccaacaactcctcagatcagagcccggcgggaactgtccaaggaaaaattagctaccacccacccgccaacaactccgagctggttccaacggattcccctccagtggtttcagtgctcactgcaggacggacagaggaaatgtcgaccgactcggaccgatg

SEQ ID NO: 6641 - DNA, 203 bp, Homo sapiens
  source 1..203: mol_type = other DNA
ggcgcgccagtcctccaaggtctaaccaacggagagacaatcacaggtttcaccgcgaacccaatgacaaccaccattgccccaagtccaaccatgacaagcgaggttgataacaatgtaccaagtgaacagccgaacaacacagcatccattgaagactcccccccatcggcaagcaacgagacaatcgactcggaccgatg

SEQ ID NO: 6642 - DNA, 203 bp, Homo sapiens
  source 1..203: mol_type = other DNA
ggcgcgccagtcctttaccactccgagatggatccgatccaaggctcgaacaactccgcccagagcccacagaccaagaccacgccagcacccacaacatccccgatgacccaggacccgcaagagacggccaacagcagcaaaccaggaaccagcccaggaagcgcagccggaccaagtcagcccggcgactcggaccgatg

SEQ ID NO: 6643 - DNA, 203 bp, Homo sapiens
  source 1..203: mol_type = other DNA
ggcgcgccagtcctgtcttctatgtgagacccacctacggcatgagggcctcggacaggaccaagctgattctgtattagaggtctaccaaagactccacagtgataaaggagggaattttgaggctgccctgtggcaacaatgggaccgacagtcattaataatgttcatctctgcttttctcaacacgactcggaccgatg

SEQ ID NO: 6644 - DNA, 203 bp, Homo sapiens
  source 1..203: mol_type = other DNA
ggcgcgccagtcctcagtcaccaggctgttctcagtagtctgtccttggaagctcttggggagacaaaaagaggtcccagagagtcccaacaggttggcataaggtcattaacaccagcatagtcggctcgaccaagactgtaagcgagtcgatttcaactaaaaagattatttcttgttgtttaaaccgactcggaccgatg

SEQ ID NO: 6645 - DNA, 203 bp, Homo sapiens
  source 1..203: mol_type = other DNA
ggcgcgccagtccttttgatgtaagtcaaaaaggcatggctcttctgacaagactcaaaacaaatgactttgctcctgcctgggcgatgacaagaaatcttttcccacatctgttccagaacccaaattcggttattcaatctcccatctgggctttgagggtaattttggcagccggattgcaggatcgactcggaccgatg

SEQ ID NO: 6646 - DNA, 203 bp, Homo sapiens
  source 1..203: mol_type = other DNA
ggcgcgccagtcctctattttcgctaattgcattgagcactgctaataggtttgtatcacgttaaagatttagagtgtatgaattgtgcagatttaaacttgggttttgccttatgcttcataggtggtctttttgaaatggagattatcagcatttcttaaatgggaggagttagcaatcagaaattcgactcggaccgatg

SEQ ID NO: 6647 - DNA, 203 bp, Homo sapiens
  source 1..203: mol_type = other DNA
ggcgcgccagtcctggagataaatggacatcgggatagaacaatgcctaactattgggcggcttccatttttacatgtgtatataaccaatcttttcctatctttgcttatattggtgtaactttattttaataacatgtcaatgctatactgttaagagaaggtctgaggaagattaagaaaaaggccgactcggaccgatg

SEQ ID NO: 6648 - DNA, 203 bp, Homo sapiens
  source 1..203: mol_type = other DNA
ggcgcgccagtcctcttgcaatcaattccttgatgaaattattaattacactcttcatgatgcagcctttcttgattactatctcaaggcaacaggtgcacaggaccatttgacaaacattgcaactagagagaagcttaaaaacgaaattctaaacaatgattatgtccatcaattgttcttctggccgactcggaccgatg

SEQ ID NO: 6649 - DNA, 203 bp, Homo sapiens
  source 1..203: mol_type = other DNA
ggcgcgccagtcctatgtgctaggttacaatcctccaaacaaattctccactaaaagggtgccggaacaatttctagaacaagaggatttttcaatcgaaagtgtcctgaattatgcacaggaattacattatttattaccacagaataggaatttttccttttctctcaaagaaaaggaattaaatacgactcggaccgatg

SEQ ID NO: 6650 - DNA, 203 bp, Homo sapiens
  source 1..203: mol_type = other DNA
ggcgcgccagtcctttaagttacgatcagcggtcatgggagacaatcagtgtataaccgtattgtctgtttttccacttaaaacagaccctgaagagcaggagcaaagcgccgaagacaatgctgcaagagtagcagcaagtcttgcaaaagtaaccagtgcatgtgggatctttcttaaaccagatgcgactcggaccgatg

SEQ ID NO: 6651 - DNA, 203 bp, Homo sapiens
  source 1..203: mol_type = other DNA
ggcgcgccagtcctcaaaccctgtcatgagtcgctttgcagcggatattttttccaggacaccgagtggtaaacgtctccaaatattaggttatcttgaagggaccaggactctattggcctccaaaatcataaacaacaacagtgagacacctgtacttgataagctgaggaagatcaccctacaaacgactcggaccgatg

SEQ ID NO: 6652 - DNA, 203 bp, Homo sapiens
  source 1..203: mol_type = other DNA
ggcgcgccagtcctcgcagtatctcaaggtggtggtactcaaagtatttctgagtgatatagaaggaatattatggattaatgattacttggctccattattcggggctggttacttgattaaaccgattacatcaagtgcccggtcaagtgaatggtacctttgcttatcaaatttgatatctactacgactcggaccgatg

SEQ ID NO: 6653 - DNA, 203 bp, Homo sapiens
  source 1..203: mol_type = other DNA
ggcgcgccagtcctacaggagatcggcccatcagactcacaaggcatgtcttggtgttatcagagatgctttgcaagcacaagtccagcgaggcgtgtactggttgagtcacatcgcacagtatgctacaaagaatctccattgtgaatacataggccttggtttcccatctctagaaaaggtcctatcgactcggaccgatg

SEQ ID NO: 6654 - DNA, 203 bp, Homo sapiens
  source 1..203: mol_type = other DNA
ggcgcgccagtcctatcacaggtataatctagttgatactggactcggtccattgtcgtcagttattagacatttaactaacctccaggcagagatacgagacttagtattagattataacctgatgagggagagtcgcactcaaacgtaccattttattaagactgcaaaaggcagaatcacaaagtcgactcggaccgatg

SEQ ID NO: 6655 - DNA, 203 bp, Homo sapiens
  source 1..203: mol_type = other DNA
ggcgcgccagtccttaacatagactgaaaatgctaagaagagattggagtaaaagtataaaataaatttaattaaacttcaaagtgattaaatgataatgatcttgggaactcgatatgacctcaagtcaaaaataatgtcaatataattgtttagtaatatgagtgataatgtaaattttgataactcgactcggaccgatg

SEQ ID NO: 6656 - DNA, 203 bp, Homo sapiens
  source 1..203: mol_type = other DNA
ggcgcgccagtcctgcaccagtgtaccgatagcagtaagaaacgagctattcaaaagatttgtgtcttaattagtaatgatctaaaggagaatggattattagaagaggctaaaacattcaaaccagagtataaatcaatcgcccaagtatatggtaaattcttcaaacgatacatcgccgaaaaggacgactcggaccgatg

SEQ ID NO: 6657 - DNA, 203 bp, Homo sapiens
  source 1..203: mol_type = other DNA
ggcgcgccagtccttgattacattgagtgtttgagccatcatttaacatcaactgttgacattgacgttcaccagcaagattgtggtaatttaagcgttgtaatatttgcaaaagataataacattaagaaacagctgcagattcaggtatccgcttgagtggccatggagccgtcggtaattttatgcgactcggaccgatg

SEQ ID NO: 6658 - DNA, 203 bp, Homo sapiens
  source 1..203: mol_type = other DNA
ggcgcgccagtcctgcgtatctgttgacagaacatcaaattgaacagattaaacagaacagtgttgaccctaacaatacaccaaagattgaagtgaggagtcagttctaactgtttactttgcaggagaggaggtaccgagttctgggactcacgtccatcgccactttacttggttacaacctcacgcgactcggaccgatg

SEQ ID NO: 6659 - DNA, 203 bp, Homo sapiens
  source 1..203: mol_type = other DNA
ggcgcgccagtcctacggtgtgacaaggtgaagcatgacccatcttcgtgtgctaatggtgtgtgctgctaatcgctggactgccggagggaaaccggcacaaggcgtggccgccactggccgttgatgatcatgtggaactgagctttgctcaggccgactcacattaagtataatttagaactgaccgactcggaccgatg

SEQ ID NO: 6660 - DNA, 203 bp, Homo sapiens
  source 1..203: mol_type = other DNA
ggcgcgccagtcctaagctttgctgacactaagagctaatgactctggaaattgagcttcgaaaggtaccgggcaaccatgctttccgaggggctcttgggactggaaagtagaggatcccgctgggatgtcaaccaccctctaccaacggtgtcggagtgctcccttaataggacaatttgactgaccgactcggaccgatg

SEQ ID NO: 6661 - DNA, 203 bp, Homo sapiens
  source 1..203: mol_type = other DNA
ggcgcgccagtccttaacgtcactttcaactactgcttcagcagttaactcgtttgcttattcttactgtaatgttccagtggagagttgggattttaacatgattaaactgactgctgaaactagttgtgcttcacttactgcaatgactaatttggttaatacattagtgcctgatgatagggttacgactcggaccgatg

SEQ ID NO: 6662 - DNA, 203 bp, Homo sapiens
  source 1..203: mol_type = other DNA
ggcgcgccagtcctgtattccattctagtaatcaacacttgttacacggtgatgcaaatcctgataatatcatgagtgatagtgaaggttacttgaaattggttgacccagtttgcttgcttgaaaatcaagtgaatatggtaaatatagagtacgaatcgttaacccaagaagctgagaagaaagtacgactcggaccgatg

SEQ ID NO: 6663 - DNA, 203 bp, Homo sapiens
  source 1..203: mol_type = other DNA
ggcgcgccagtcctaatcatcgaccaatgatgcctgagctatcagtgcttaatgatttaacttactatgatactggtgaagtgagagatttggttaccgaagatctagatgatgaagatgacgtttaataacacaatatatatattcattgagactaaggaaactcttaacacagatgtacgacctgccgactcggaccgatg

SEQ ID NO: 6664 - DNA, 203 bp, Homo sapiens
  source 1..203: mol_type = other DNA
ggcgcgccagtcctatttggatccaaacatatcagaggtcaaactgtggttggaatatttcatagggagtgaagatttcttcgggttcaatggaccaaatgtggttgtgtcaaagtctttgttagctgccaaacgttttgaagttgttgttaatcacttaaggaaggttgcagcttttgaattggatgcgactcggaccgatg

SEQ ID NO: 6665 - DNA, 203 bp, Homo sapiens
  source 1..203: mol_type = other DNA
ggcgcgccagtcctatgagtctaaagaagtgatgactgaatggcttaaatacataatgatcgatccagtttatagatcatataaaaatagaggtgcttttggtaatctgaatcaacatgtgtttgcaaggactaagagtgagggattgtcatggtctcttattgacattggtacgacaaattttgaatcgactcggaccgatg

SEQ ID NO: 6666 - DNA, 203 bp, Homo sapiens
  source 1..203: mol_type = other DNA
ggcgcgccagtccttaaagccgactaagaaactagctggctcatacgttaagaaattcaacttagttgatgatgtgctggttgaggaatcgttgaaagatttgcgtaatgagggtctatacaagatggctgatataacacgtaggatgattgatgctgatataacgcctgaaaacgtgaagaagggaacgactcggaccgatg

SEQ ID NO: 6667 - DNA, 203 bp, Homo sapiens
  source 1..203: mol_type = other DNA
ggcgcgccagtcctctcatgggtcaagaaaaattaatagattggacatattattcaagggtggtacatcatctgccagtagtacaaacgaacatgctactgttaacggtaggttcagatacaggtcggagttatatcgggaacgtgatgtaaattcgtcgacagtattcaagacagcaacagctggaccgactcggaccgatg

SEQ ID NO: 6668 - DNA, 203 bp, Homo sapiens
  source 1..203: mol_type = other DNA
ggcgcgccagtcctgaacaatttatgcagcttcattgatgacagtgcttccggctgttaggttattaagttcaagggctagtaacatgggagctttgagtactcaaggaagtctcgtagaccgtgcaccacatgatgtgatggctcctcaattggctgtgacttccagtgatgacgtctcaaaggtttcgactcggaccgatg

SEQ ID NO: 6669 - DNA, 203 bp, Homo sapiens
  source 1..203: mol_type = other DNA
ggcgcgccagtcctgtctaatgcctgagtattgtgagaaacatttgaatgaattagtgtacaagacgttagatgataaggtcattcgcgactatacatctgatatcattatttctaatatttgtaaaggtaagttaagtaaagcgccaaaactagcattttatgctaatttctatctttcattgactacgactcggaccgatg

SEQ ID NO: 6670 - DNA, 203 bp, Homo sapiens
  source 1..203: mol_type = other DNA
ggcgcgccagtcctcttacgatatctctgatcgtacgtatcctaagtttgttaacataacatccagcttgtcaaacagtaatagacgtggttttcagattgaagctatgaagcatgttatatatatggctagacgtggtgtggctgtactcgccaacacacatccaacaaaaattggaaatactgtatcgactcggaccgatg

SEQ ID NO: 6671 - DNA, 203 bp, Homo sapiens
  source 1..203: mol_type = other DNA
ggcgcgccagtcctgcgattcaacctgatactgctactgcacaactgatcaaaacatattcaaacccaaaacagcgtggagataagggagaaattgtttacgatggagggcagagctctaagcttgccgaggttgttgatcagaccactgagccgcacaatgcagatggagctgtaaaggatgggaggcgactcggaccgatg

SEQ ID NO: 6672 - DNA, 203 bp, Homo sapiens
  source 1..203: mol_type = other DNA
ggcgcgccagtcctatagctccagtgaagttagatttagagaagcaaaaacttgataaattaaagttatttgaagcatcacctttcgaccctttgacagtgaagaataatcaagatgttgtggacaagttgtacgctactcagtcatcatcaattcaagaagttgtgccgacgaagacttttgccacacgactcggaccgatg

SEQ ID NO: 6673 - DNA, 203 bp, Homo sapiens
  source 1..203: mol_type = other DNA
ggcgcgccagtccttcattgttgccattagtcgacgcgaatttgaaggaggcatcctcatattacttcaaaaaattgatgccaagcattagcaatgttccagttgacgctcgtactttgcaatcagctacatctgccttggccgctgatacaggtctcgtagaccgtgcaccacatgtttctatgctgcgactcggaccgatg

SEQ ID NO: 6674 - DNA, 203 bp, Homo sapiens
  source 1..203: mol_type = other DNA
ggcgcgccagtcctaagacgagtgctaactggaaagggtatagcatattagtatcacggtacagaagcctaattcctaatgaactatttgagtcccttagaaacattagcggtgaatacaacattaatccgcaagatgagcactctttcttctttgccttagcacagataaatgctgatgaagaattccgactcggaccgatg

SEQ ID NO: 6675 - DNA, 203 bp, Homo sapiens
  source 1..203: mol_type = other DNA
ggcgcgccagtcctgctgacaagccattaatctctgagactatgttaaagatattgactattgatggaactacagggaaagatgggtacaggaactggttggataagctagttggtcataattacccggtttatgttgaaccggttgtcaacatcgtgaatttcattagtgcacgcttcatagctgaccgactcggaccgatg

SEQ ID NO: 6676 - DNA, 203 bp, Homo sapiens
  source 1..203: mol_type = other DNA
ggcgcgccagtcctatgagagcgcaacatgagtatgtaagtccaagctcatcaagagtgtatattaaagacccagctgtagtgtacacgcgatcctaagattgtgatgtgattagatgtggtggaatactatcttacgcttcataggtgtggttgccgacgttgcgtagtggacaaatagaacccgaccgactcggaccgatg

SEQ ID NO: 6677 - DNA, 203 bp, Homo sapiens
  source 1..203: mol_type = other DNA
ggcgcgccagtcctatcatgcaaacttatcaggtaaatgtttgatgctgtataacagcgagaaggatatcttcgaagggttgggatttaaggttaagggttcaagaatcaatgtttcaaaaactcagatcttgcgcaattatgagattaactttgaaaccattatcggtgtcgaaccgaatggattgacgactcggaccgatg

SEQ ID NO: 6678 - DNA, 203 bp, Homo sapiens
  source 1..203: mol_type = other DNA
ggcgcgccagtcctcgttgtacgccatagtaggtggtggtcagatcacttcgcatgactttgttaacgccatcataactgatcaagagcagttaattgatttcactcaatctgagagggcattatctactcaagtggtgaaattagtttccttcattttaaaggattcgtttacagcaaaaggactgacgactcggaccgatg

SEQ ID NO: 6679 - DNA, 203 bp, Homo sapiens
  source 1..203: mol_type = other DNA
ggcgcgccagtcctataaggctgatcatgaacgtgaggctgaactgactgatctaattaacaggattcgtgagaatgaagtcaccgttaatggtattctagagaaccagaaagctataacagctgctgaacgtgcagatttactattagaggttgtcgcttcgaccgctaagtcagtgtcggcagcagcgactcggaccgatg

SEQ ID NO: 6680 - DNA, 203 bp, Homo sapiens
  source 1..203: mol_type = other DNA
ggcgcgccagtcctatgaccttagaaatacaacacttcattgcaaactagaaggtaagcaaaatatcgctggatatacagtctatgagtatctgattggaccttgggctcattacggtgacatagactactcagttgtagttgatacgctcaatgaggagacgaaatggtattgtgagattattggtacgactcggaccgatg

SEQ ID NO: 6681 - DNA, 203 bp, Homo sapiens
  source 1..203: mol_type = other DNA
ggcgcgccagtcctacacttggaatcagtataatgcaggtaattggactaacattaaaccgtaagtaaattatcaatcttcggacatatgtaagcgtgggacacgtcaaaacagtgataacctggtcggcggagctacaaatccgcttgtcaggggaaactggatgtactaatgggatttgacccgaccgactcggaccgatg

SEQ ID NO: 6682 - DNA, 203 bp, Homo sapiens
  source 1..203: mol_type = other DNA
ggcgcgccagtcctagctttgatctttatcgtctttcagattcatgatagctcacaacgcagaggtggtgtttgtactcttttcgatgtattatacaattacctcgtacagcgcaaactgaatcaggagagtgagttcttaagctatggcacgtacaaggaaaagaagtacatatacatcaatgggaacgactcggaccgatg

SEQ ID NO: 6683 - DNA, 203 bp, Homo sapiens
  source 1..203: mol_type = other DNA
ggcgcgccagtcctttttgggaagacgtacaacattggtcagctgtactacagacagttgaatgttgaagtcaatactttgaagaaggtgttagccaatattgatgatcattcaagggttaagatgcacggtaattcacgtgatggctttgtaaaacgtcttgatgatgctgggaaaagtcgtgctaccgactcggaccgatg

SEQ ID NO: 6684 - DNA, 203 bp, Homo sapiens
  source 1..203: mol_type = other DNA
ggcgcgccagtcctgtcagatgcaaagttggatgataggattgtacaaggtaagggatcacgttatatgtctgcaagtgtatacagatcacgcctgaatacagaatccactactactaataacgctcagagtcccgtttctgaccctgtcaatgcaagtgctaacgtaaaaacgtcaccagctggtaccgactcggaccgatg

SEQ ID NO: 6685 - DNA, 203 bp, Homo sapiens
  source 1..203: mol_type = other DNA
ggcgcgccagtcctccacactgatgaatcagtgatgaagaaggaagatcatggagttattgttaatgaaagcacaacatttaaaattaattcagatgttgtctttgacgccgcagaggcaacttttgcagacacaagctccggtttgtcctcattgctaaaaactaagatgaagttttgattatcgatcgactcggaccgatg

SEQ ID NO: 6686 - DNA, 203 bp, Homo sapiens
  source 1..203: mol_type = other DNA
ggcgcgccagtccttaagatgaagttttgattatcgattagtcgattgtcttcgattctcatctcagaatgagagtttagaatcggtggttgatagggtcatccacgccctgtcctgctgacgaactctcgttcggagtccattgttttgttagaggtgttgtagcgcctaggtaatttagaactgaccgactcggaccgatg

SEQ ID NO: 6687 - DNA, 203 bp, Homo sapiens
  source 1..203: mol_type = other DNA
ggcgcgccagtcctgaaggattgttgttgttgcatgggggattagcgccaataacattagtgcgtgtttatcacgatgttaatgttggtggtctagtgaccggttcgatcgcagcatccgtttcaactctattgcgtaattgcatgttatacagttttgatatctatttcactccgaatggtgtttgtcgactcggaccgatg

SEQ ID NO: 6688 - DNA, 203 bp, Homo sapiens
  source 1..203: mol_type = other DNA
ggcgcgccagtccttacttcatctcggcgtaatgatgacgttctcggaacgtgagctattgtgggcttgtcgggctccacattggccgttcaggaaggtgtgagcttatggccgccttctgagagctgatttgttctccactggatggtggggtagcagggaatgaactggtggtataattgactgaccgactcggaccgatg

SEQ ID NO: 6689 - DNA, 203 bp, Homo sapiens
  source 1..203: mol_type = other DNA
ggcgcgccagtcctgctgccacgcaagtggaagtcgtgaatggaacgtgcatcattctcgccacagacatggggagttggtgtgatgattcaatcatgtacgagtgcgtcactattgactcgggagaagaaccagttgatgtggactgtttctgcaggggcgtcgagcgggtgtccctggaatacgggcgactcggaccgatg

SEQ ID NO: 6690 - DNA, 203 bp, Homo sapiens
  source 1..203: mol_type = other DNA
ggcgcgccagtcctaggtgtgggaagccagttggcggcagaagcaggaggtcggtgtcgattccagtgcatgctcatagtgatcttaccggaagagggcataagtggcttaggggggactcagtcaagacgcatctgacacgtgtggaaggctgggtatggaagaataagctcctgacgatggcctttcgactcggaccgatg

SEQ ID NO: 6691 - DNA, 203 bp, Homo sapiens
  source 1..203: mol_type = other DNA
ggcgcgccagtccttgtgcagttgtgtggatggtcacagacagcttaccgacaaggttcattgtcataacagtggccctttgtctggctcccacatatgccactcggtgcacacacctgcagaaccgggactttgtttcagggatccaagggacgactagagtctcattggtgttggaattgggtggccgactcggaccgatg

SEQ ID NO: 6692 - DNA, 203 bp, Homo sapiens
  source 1..203: mol_type = other DNA
ggcgcgccagtcctcacacgggtgactatttggcagctaatgagtcccacagcaatcgaaaaacggcatcttttacaacgcagtccgagaagaccatcttgacactgggagattatggagacatctctctcacgtgccgggtgactagtggagtggatcctgcccaaactgtggtattggaactggaccgactcggaccgatg

SEQ ID NO: 6693 - DNA, 203 bp, Homo sapiens
  source 1..203: mol_type = other DNA
ggcgcgccagtcctggcatcctgttgaagtctctggctggagtgcccgtggccaacatagagggcagtaagtaccatctccagagtggtcatgtcacctgtgatgtgggccttgaaaaactcaagatgaaaggaatgacatacacggtctgtgagggatcaaagtttgcttggaagaggccgccaacccgactcggaccgatg

SEQ ID NO: 6694 - DNA, 203 bp, Homo sapiens
  source 1..203: mol_type = other DNA
ggcgcgccagtcctgctctgcacacagcttttggtgcagcattcaacaccatttttggaggagtgggatttctcccacgtattctgttgggggtggccctggcttggctggggctcaactcacggaaccctaccctctcagtcgggtttttgatcactggtggacttgtgttaacaatgacactggggcgactcggaccgatg

SEQ ID NO: 6695 - DNA, 203 bp, Homo sapiens
  source 1..203: mol_type = other DNA
ggcgcgccagtcctgttggtgccgacatgggctgtgcaattgatgccaacaggatggagctacgttgtggtgagggccttgttgtgtggagagaggtcactgattggtatgatggctatgcattccacccagaatcgccccctgttcttgcggcatctctaaaggaagcatatgaggagggagtctgtcgactcggaccgatg

SEQ ID NO: 6696 - DNA, 203 bp, Homo sapiens
  source 1..203: mol_type = other DNA
ggcgcgccagtcctgggattgtgccccagaaccggcttgagatggccatgtggagacgtgtggaggctgtgctcaacttggcccttgcagagagtgatgccaacctcacggtggttgtggatagaagggatcctagtgactacaggggaggcaaagtggggatcttaaagcggtcaggcaaggagatgcgactcggaccgatg

SEQ ID NO: 6697 - DNA, 203 bp, Homo sapiens
  source 1..203: mol_type = other DNA
ggcgcgccagtcctaagacttcatggaagggatggagccaatcctttgtgtggagtgtcccagaatcgccacggcgttttatggttgggattgaggggactggggagtgtccacttgataaacgccgaacaggagtcttcacggtggcagagtttgggatgggaatgaggaccaagatcttcttggatcgactcggaccgatg

SEQ ID NO: 6698 - DNA, 203 bp, Homo sapiens
  source 1..203: mol_type = other DNA
ggcgcgccagtcctctacgggagactagttcttcagactgtgacaccggagtcatgggggctgcagtcaagagcggtcatgccgtccacaccgatcagagtctctggatgaagtcacacaggaacgcaacgggagtgttcatatcagaactgatagtgaccgacttacggaactgcacatggccagcccgactcggaccgatg

SEQ ID NO: 6699 - DNA, 203 bp, Homo sapiens
  source 1..203: mol_type = other DNA
ggcgcgccagtcctctggtgaggtcgatggtgctggctgacaacggagccatgttaagtgaaggtggagtccctggcattgtggccgtattcgtggtcctggagctagtcattaggagacgcccaacaactggcacctcagtggtgtggtgtggagtggtcgttcttggcctagtcgtaactgggctacgactcggaccgatg

SEQ ID NO: 6700 - DNA, 203 bp, Homo sapiens
  source 1..203: mol_type = other DNA
ggcgcgccagtcctacctatttcttgctcctcgtgctggagcttgggtttccagaggcctcactgagcaacatttggaagtgggctgactccttggcaatgggaacattgattctacaggcgtgcagtcaagagggcagagcccgagtgggctatctcctggcagctatgatgacccaaaaggacatgcgactcggaccgatg

SEQ ID NO: 6701 - DNA, 203 bp, Homo sapiens
  source 1..203: mol_type = other DNA
ggcgcgccagtcctgccataatccacacaggcttgaccatttttctatcagccgccacggcaatggcggtctggagcatgatcaagggtcaacgggaccagaagggactgtcctgggccacaccacttgtaggcctcttcggaggcgaaggtgtgggtcttagactgctggcgtttcgaaggcttgcacgactcggaccgatg

SEQ ID NO: 6702 - DNA, 203 bp, Homo sapiens
  source 1..203: mol_type = other DNA
ggcgcgccagtcctgagcgaaggaacagacggtctttcagtgaaccactaacagtggtgggcgtcatgctcactgtggcaagtgggatggtgagacacacatcccaggaggctctgtgcgctcttgtggctggggcctttctcctcctcatgatggtgctgggaacacggaagatgcagctcatcgcacgactcggaccgatg

SEQ ID NO: 6703 - DNA, 203 bp, Homo sapiens
  source 1..203: mol_type = other DNA
ggcgcgccagtcctgaatggtgcggtgaagtggaatggaacccagacctagtgaatgaggggggagaggtcaatctgaaagtgaggcaggacgccatggggaatctccatctcactgaggtggagaaggaagaacgcgctatggcgttatggcttcttgcagggttggtggcttcagcttttcactggcgactcggaccgatg

SEQ ID NO: 6704 - DNA, 203 bp, Homo sapiens
  source 1..203: mol_type = other DNA
ggcgcgccagtcctgccggcattctgatagtattggctatatggacattctttgagatgctgagctcggggcgaaggtctgaacttgtcttctctggacaggggaccgggaccgaaaggaatcggccttttgagatcaaggatggagcctaccgcatctacagtcccggtttgctgtggggacatcgccgactcggaccgatg

SEQ ID NO: 6705 - DNA, 203 bp, Homo sapiens
  source 1..203: mol_type = other DNA
ggcgcgccagtcctcagattggagtggggtatggagccaagggagtcctgcacaccatgtggcacgtcacaaggggagcagccctggttgtggaagaggcaatctccggaccctattgggctgacgtcagggaagatgttgtatgctatggtggagcatggagccttgagagccggtggaggggtgagcgactcggaccgatg

SEQ ID NO: 6706 - DNA, 203 bp, Homo sapiens
  source 1..203: mol_type = other DNA
ggcgcgccagtcctaccgtccaggtgcacgcatttccaccagggagaccccaagagacacaccaatgtcagccgggagaactcatcctggagaatggtaggaaacttggagcagttcctattgacctgagcaaaggtacctcgggaagtccgataatcaatgctcagggagaggtggtgggtctttaccgactcggaccgatg

SEQ ID NO: 6707 - DNA, 203 bp, Homo sapiens
  source 1..203: mol_type = other DNA
ggcgcgccagtcctgagctcgtgaggcagtgtgcaaaccgagggatgagaactctagttcttgcccctacccgggtggttctgaaggagatggagaaggcgcttgctggcaagaaggtccgcttccactcacccgcggtagaagggcagagcacagcgggagccgttgttgacgttatgtgccatgcccgactcggaccgatg

SEQ ID NO: 6708 - DNA, 203 bp, Homo sapiens
  source 1..203: mol_type = other DNA
ggcgcgccagtcctgtggagatgactggaaccagaaagatcacgacagcatcggcagctcaacgccggggcagggtgggaaggacatctggacgcactgatgagtacatatactctggacagtgtgacgatgatgacaccagcctcgttcaatggaaggaggcacagatactcttggacaacattacccgactcggaccgatg

SEQ ID NO: 6709 - DNA, 203 bp, Homo sapiens
  source 1..203: mol_type = other DNA
ggcgcgccagtcctacactgaggggtccagttgctactttttatggacccgagcagatgaagatgccagaagtggctggccactacaggctgaatgaggagaaaaggaaacacttccggcacttgatgacccaatgtgactttacgccttggctggcatggcatgttgctaccaacaccagcaatgtgcgactcggaccgatg

SEQ ID NO: 6710 - DNA, 203 bp, Homo sapiens
  source 1..203: mol_type = other DNA
ggcgcgccagtcctgttgaggtggccgttctaggggtggccactcttggcatactgtggtgctttgtggcaagaacttcggttagccgaatgtttttgggcacggttgtgctctttgctgccctcttgttgctgtggattggtggagtggactacggatacatggcagggatagccctgatattctaccgactcggaccgatg

SEQ ID NO: 6711 - DNA, 203 bp, Homo sapiens
  source 1..203: mol_type = other DNA
ggcgcgccagtcctatcttcctcactgtgctgcagccagagccggggaaacagcgaagtagcgatgataatagactggcatacttcctcctaggactccttagcttggctggacttgtgacggctaacgaaatgggcatgctggataaaacaaaagctgaccttgcagggctaatgtggcacggagagcgactcggaccgatg

SEQ ID NO: 6712 - DNA, 203 bp, Homo sapiens
  source 1..203: mol_type = other DNA
ggcgcgccagtcctcaaaggcatccagcctgggaggagtggacaaatgtggacatccagccagcacgatcctgggggacgtatgtgttgatcgtctctctgttcaccccctacatgttgcaccagcttcagacaaaaatacaacaactggtgaatagttcggtggctagtggtgctcaggctatgagacgactcggaccgatg

SEQ ID NO: 6713 - DNA, 203 bp, Homo sapiens
  source 1..203: mol_type = other DNA
ggcgcgccagtcctgaggctggggctgttggtctagctgcgttgggccagttggtccatcccgagactgagacactctggacaatgccaatggcgtgtggtatggcgggactcgtgcgagggagcttctggggcctgttgcccatgggacaccgattatggctcaagacaactggaacacgcagaggacgactcggaccgatg

SEQ ID NO: 6714 - DNA, 203 bp, Homo sapiens
  source 1..203: mol_type = other DNA
ggcgcgccagtcctggtgccgatggagaaactcttggggacatctggaagaggcggctgaatggttgctctagggaggagttttttcagtaccgacgaagtggagtcatggagacggaacgtgacagggctcgagagcttctgaagagaggtgagacaaacatgggactggctgtctctcgagggacgcgactcggaccgatg

SEQ ID NO: 6715 - DNA, 203 bp, Homo sapiens
  source 1..203: mol_type = other DNA
ggcgcgccagtcctcctgacgcgtcctgcgtgttcaaggttttggccccgtatagaccagaggtacttgaggctcttcacagattccagcttcaatggggcggggggctagtccgcgtccccttttcccgcaattccacgcatgagatgtacttctccactgctgttagtggcaacatcgtcaattcacgactcggaccgatg

SEQ ID NO: 6716 - DNA, 203 bp, Homo sapiens
  source 1..203: mol_type = other DNA
ggcgcgccagtcctgtgaacatccagtccaggaagttgttagccagatttggagaccagcggggacctgccaaggttcccgaagtggatctggggactggcacacgctgtgtggtactggcagaggataaggttagggaagctgatgtggccgaaagaataactgctctcaaaacccaatatggtgaccgactcggaccgatg

SEQ ID NO: 6717 - DNA, 203 bp, Homo sapiens
  source 1..203: mol_type = other DNA
ggcgcgccagtcctgctcgcccctccagctcgggaggctgcgtcatggacatcataactagaagagaccaacgtggttcaggtcaggtggtgacttacgctctgaacaccctcacgaacatcaaggtgcagctcatccgcatgatggagggagagggcgtgatcgggccatcagactcacaggatcctcgactcggaccgatg

SEQ ID NO: 6718 - DNA, 203 bp, Homo sapiens
  source 1..203: mol_type = other DNA
ggcgcgccagtccttcggagggttactccagctgggaagaggttcccttctgctctcaccatttccatgagctgacgatgaaggacggcagggtcataattgtcccatgcagagatcaagatgagctggtggggcgggcaagagtgtctcctgggtgtggctggagcgtcagggaaacagcatgtctccgactcggaccgatg

SEQ ID NO: 6719 - DNA, 203 bp, Homo sapiens
  source 1..203: mol_type = other DNA
ggcgcgccagtccttcaaaggcctacggacagatgtggctgttaagctactttcacaggagggatctgagaacgcttggtttggcaatctgctcagctgtgcccattgactgggtcccgcagggacgaaccacatggagcatccacgcgagtggagcgtggatgaccacagaggacatgctggaagtgcgactcggaccgatg

SEQ ID NO: 6720 - DNA, 203 bp, Homo sapiens
  source 1..203: mol_type = other DNA
ggcgcgccagtcctgagccccaacgacgaactgtggcagcacaccatttggtgacgggaagctggtcgctcccgacgcaggccgtcgtaagaactttgtgagaccaaagcctcccagagagggccgaactgggaggttatgaaggcccctggctttggccaggaggggggagagggaaaattggcattcgactcggaccgatg

SEQ ID NO: 6721 - DNA, 203 bp, Homo sapiens
  source 1..203: mol_type = other DNA
ggcgcgccagtcctcgtaagaactttgtgagaccaaagcctcccagagagggccgaactgggaggttatgaaggcccctggctttggccaggaggggggagagggaaaattggcattccctctcaggagatttcctccccctacaactaaatttccccctgccatgcagggggggcggttcttgttctcgactcggaccgatg

SEQ ID NO: 6722 - DNA, 203 bp, Homo sapiens
  source 1..203: mol_type = other DNA
ggcgcgccagtcctacacgaaaacacatgctcaaactaaagactgttttttcttgatgttgaaagctattgctatggctaaagaacatatcttcattgaagatgggtccttttactccatagctattgctcttcgcttaataaacgcatcattggcaacgattttaaacaaacccgacatgctcaaatcgactcggaccgatg

SEQ ID NO: 6723 - DNA, 203 bp, Homo sapiens
  source 1..203: mol_type = other DNA
ggcgcgccagtcctttacgaaattttctgcattcgacggacgaacgattgaaacggacatgacatacgcacaagtaactgaggaatgttctatgaagatggcttctcgctttaatcaacatatggacttcaccaattatttggacgcatacaggaaccccacatatgaacctgaagatattgtggagccgactcggaccgatg

SEQ ID NO: 6724 - DNA, 203 bp, Homo sapiens
  source 1..203: mol_type = other DNA
ggcgcgccagtcctaccaagtcgcagattgtgattgtaatacatgtgattgctgtaacgacccggaactattggataggctttctacagtggccagaattcatggcacgaattgcgtgtgtctgttgactcgtttctatcaaggatttaaaacagccgatctttatgatatgactaagcaaattagtacgactcggaccgatg

SEQ ID NO: 6725 - DNA, 203 bp, Homo sapiens
  source 1..203: mol_type = other DNA
ggcgcgccagtcctccccggtatacgataaccgtgtaacaattaagaagaacacaatcttagctgcacagaatctattacccgcttttgccaaaattgaaccaatcgagaagactatggacatacaaacagtacccgcatgtaaaggatgtgataactgctctcctatcgatgctcaacgatctttgccgactcggaccgatg

SEQ ID NO: 6726 - DNA, 203 bp, Homo sapiens
  source 1..203: mol_type = other DNA
ggcgcgccagtcctctgaacaagacaaaggttcgattgtcatcgctagagacgtagtttaccgcaatcttttcagattcacggtggtgttgaacgaaaacggaacggaaaaacgacgcggatttggacaaatattcatgttaggaggtcgattaggtatgataccgaaacacttcctttacgtgatggcgactcggaccgatg

SEQ ID NO: 6727 - DNA, 203 bp, Homo sapiens
  source 1..203: mol_type = other DNA
ggcgcgccagtcctggttggacataatggatggaacgccgtatgctacaatgaactcgttttttgagcatacttcgtctattttttatggtgatgacttcataatgaatatacgaccagaggttattgatgtttacaatcaagaaactctcacacccgttcttaagaagaatttggaaatgacaatgacgactcggaccgatg

SEQ ID NO: 6728 - DNA, 203 bp, Homo sapiens
  source 1..203: mol_type = other DNA
ggcgcgccagtcctgctgatgtagaattaaaattacaagtcaacgctcaaccattccaagctgggcgtttattattagtttatattccaggttataaatatataggcgaggatcgacagaaatattatgacgatcgcactaatgttgacgatgctagcttggttccgttgactggttcccctcgtgtccgactcggaccgatg

SEQ ID NO: 6729 - DNA, 203 bp, Homo sapiens
  source 1..203: mol_type = other DNA
ggcgcgccagtcctgatcctaatgcctcttacagttctgtagttgacttgcgttctgacacagatgtaacgttcaacgttccattcgtttcagttcagccatggaaattatctagcgcagatgtcacatcacctttgaaggattatcagcactctgttggtaggttgtacgtactcattcttaatgaacgactcggaccgatg

SEQ ID NO: 6730 - DNA, 203 bp, Homo sapiens
  source 1..203: mol_type = other DNA
ggcgcgccagtcctttacgtgccacttccacagtgtctgatactatctcatgtcttgttgaagtttctggagcatcagattttgaattatctatgccacgacaaccgaagatttacccaacgttaagggccgccaaatcaacaactctgaatagagttatacgtggtattgcacaggtcaacgtagctcgactcggaccgatg

SEQ ID NO: 6731 - DNA, 203 bp, Homo sapiens
  source 1..203: mol_type = other DNA
ggcgcgccagtcctgaatctacaccggtatccccagaaatcatccaaaagacaggtgaagtaggagaatctagtatgagacaaccgcaagggacatctttcactagctctgcactaactgtaggagaaaaagtaacatcgttacgacaaattttaaagcgatttcatttaatctattctaatttaactcgactcggaccgatg

SEQ ID NO: 6732 - DNA, 203 bp, Homo sapiens
  source 1..203: mol_type = other DNA
ggcgcgccagtcctgcggcgcgtattcgattgatcccagagaatggcgctacagaagctaatgctggtccagttcaagaagacaatactgtcatcgatgagactagaacagctgctgatgtatatatgccacgaaatcttgaaggaactttcgaatttcaggtgcctcattactcgaggtatcctctccgactcggaccgatg

SEQ ID NO: 6733 - DNA, 203 bp, Homo sapiens
  source 1..203: mol_type = other DNA
ggcgcgccagtcctaacctgcccctctaacgccagacgagcggcataaaactcgaacttctggcacgttccaccaccccttctcctatcccaacccccattgcgctctcaaggtcgcgcttttccgagactagctcggattcaaaaagttcctggcaccctttaccccttcaggcccttaaggtaggacgactcggaccgatg

SEQ ID NO: 6734 - DNA, 203 bp, Homo sapiens
  source 1..203: mol_type = other DNA
ggcgcgccagtcctactgaccttgtgctgtgatctcggtgcggaagtgctactgcgtagtgattgtaagatccttttgtggttctgccctggcaaggctacagagtgctgtgatccgctgcggatgccatcctggtaacaggacccccagtgtgcgcaacagtatgttcacggtcttccgtgttcacccgactcggaccgatg

SEQ ID NO: 6735 - DNA, 203 bp, Homo sapiens
  source 1..203: mol_type = other DNA
ggcgcgccagtcctacattcggaacactgctttcgtgaaacagtgtgtgtccaatccctgtgatcagtatcaaccacaccacctaggaatgctaggaaggtaccccggttcgccgggatctgatcctaggctaattgtctacggtggtgctcctttttattttccacttcaactcactggttacaactcgactcggaccgatg

SEQ ID NO: 6736 - DNA, 203 bp, Homo sapiens
  source 1..203: mol_type = other DNA
ggcgcgccagtcctgcgcagattccgtgtggagacacgtgagaaaaccctctattcttacgtggaccccgcggttgacgcctacttaaagcgcgaacgaaggtttcccttctcccttcccaaaccctcccatttctacgactgcctcttttgcaaccatccctctgaagacgatgaggattcactcctcgactcggaccgatg

SEQ ID NO: 6737 - DNA, 203 bp, Homo sapiens
  source 1..203: mol_type = other DNA
ggcgcgccagtcctcaccctcgacggagagtatggcgatccctgtccacttcactctggtgttcttgaccccaaacccagataccaaaagccccctgaggacattcttgaggattctaactggtgtgacgtccttaacgaggatgttacttacagcactgattctctccagaatgccttcgaccaactcgactcggaccgatg

SEQ ID NO: 6738 - DNA, 203 bp, Homo sapiens
  source 1..203: mol_type = other DNA
ggcgcgccagtcctggctcttgctctgctccccggttctgctcaggtgaaggactcttcccacatctccaaactctacttcaagctcttctctctttcccaattccctggtgtccctaccacacctctttctctccccaagcccactggcaacatcatctcccaaggccaaagtcagaccaacatttacgactcggaccgatg

SEQ ID NO: 6739 - DNA, 203 bp, Homo sapiens
  source 1..203: mol_type = other DNA
ggcgcgccagtcctttctacccagcacggtaacgcgatgatcaccaccggttccaccgccccagtggtcgtcgcatacccacctaccccctccgtgccccttcccaaccccgactgcccttccgaacctggtccgtcaggtgaccgcacatggctcctggacactttcgagtggtcccaggaaaaccccgactcggaccgatg

SEQ ID NO: 6740 - DNA, 203 bp, Homo sapiens
  source 1..203: mol_type = other DNA
ggcgcgccagtcctcatgtggtggtgcctggctggtcagaatggaatgcagtacaacaccctagccaaccccacctaccccttttccgcctccaccaactggggcacccagaatggggttgcggcaactgcttacccgctacctgcttcttttgtgcaggcgtatccagactgcccctggaccgccatcgactcggaccgatg

SEQ ID NO: 6741 - DNA, 203 bp, Homo sapiens
  source 1..203: mol_type = other DNA
ggcgcgccagtcctgcacgatacccatgcctacttcaactgtggctggcgcatgcaggtggtggtgaacggtactcagttccacgctggtgcccttctcatatacgccgtcccggaacgccccctgcttccgaacggtgttgaatatgagcacaccacctttgtctacccctacaccatcctcaacctcgactcggaccgatg

SEQ ID NO: 6742 - DNA, 203 bp, Homo sapiens
  source 1..203: mol_type = other DNA
ggcgcgccagtcctctaccagtctaacaccgcaacattggaggtcccctacgtcggttgcacacccaataccaccacctgtgtgcactcgccgtggactttctacattgcgatcctcacccccttggctgtagcttcctcctccaaccagaccctttctgtttcagtttacataactcctgttaattccgactcggaccgatg

SEQ ID NO: 6743 - DNA, 203 bp, Homo sapiens
  source 1..203: mol_type = other DNA
ggcgcgccagtcctcttcacagggtcttcccagcattacggccgcctagttgtatgctactcaccgccaagcggcgctcctcccgctaccatcacggaagcgatgcgcggcacctacactgtgtgggacatcaattcttcctccactcttgacttcaccattcctttcatctcccaatcctactggaacgactcggaccgatg

SEQ ID NO: 6744 - DNA, 203 bp, Homo sapiens
  source 1..203: mol_type = other DNA
ggcgcgccagtcctcgcgcaagtcaccttccactattttccccccggcgcaacaccctatgacgccacctctcccaatgcttccactgacctggctaactgtttcaccgtcgatgctcagatcccaccgacatcgatggacacagtctgcctgtccttcccctacctttcagttctttctgctattcccgactcggaccgatg

SEQ ID NO: 6745 - DNA, 203 bp, Homo sapiens
  source 1..203: mol_type = other DNA
ggcgcgccagtcctcacttcctactttggattctctaacttccagggcggtagcgatgtgctcaacaccacgcttggaactattgtgatctatgttgggtggcagggcgatgcccctacgggcaccgctcttactatctatcagaagatcgcttttggcaacttccgtggtttcgttcctcgcaaccccgactcggaccgatg

SEQ ID NO: 6746 - DNA, 203 bp, Homo sapiens
  source 1..203: mol_type = other DNA
ggcgcgccagtcctgcccaaacttactgcctactcccaacccaacatggtaacgaagacgaacgccatcgtcaagttgccagtttaccggccaatggcgaccaccaaagccatggtgcgccgtcaatgtgccggggagtccctcttccaaccctgtctctgctctcgcgtttacattgttcgcgcacacgactcggaccgatg

SEQ ID NO: 6747 - DNA, 203 bp, Homo sapiens
  source 1..203: mol_type = other DNA
ggcgcgccagtcctgcgcatgacctacacccactgggccctgcgttgtgtcgacagcgatggaacacgccagatttccctttctcgcttcaagttgtctgctgttgtggcatacgaggatccggaaggagaggtctaccgagaggtagaacctttccactggtccttggccgtcgcgatggtgggcagcgactcggaccgatg

SEQ ID NO: 6748 - DNA, 203 bp, Homo sapiens
  source 1..203: mol_type = other DNA
ggcgcgccagtcctcccttgggactattctgcttccaacaactgcacccactttgtctctaacatcaccggtgttgaacttcccaacactggcttctcccttgctctcggaatcggggcactggcgatcggggctggtgttatggccgttcaaactgccaaaggccgtatcacccgccaggggttgctcgactcggaccgatg

SEQ ID NO: 6749 - DNA, 203 bp, Homo sapiens
  source 1..203: mol_type = other DNA
ggcgcgccagtccttgcggatctggcaccacagcttcgcacctatttcactgagagaaacaccactctgggcgctctcttctattggctggcaaccaagcttggtttgttagtcactccagaggaggcggaagttgccgccatcgagcctcaaggcgtgcgggacttaaaggaaggtgtccaggctgtcgactcggaccgatg

SEQ ID NO: 6750 - DNA, 203 bp, Homo sapiens
  source 1..203: mol_type = other DNA
ggcgcgccagtcctcctgtatgggccacctggcactgggaaatccttgcttggctccctccttgcctctgtcctcgctcagaagctctctggtgatcccaacgatgtgtactcccccacatcagcttcctgtgaatacttcgatgggtacacaggacaagtcgtccacttcattgacgacttgggacacgactcggaccgatg

SEQ ID NO: 6751 - DNA, 203 bp, Homo sapiens
  source 1..203: mol_type = other DNA
ggcgcgccagtccttgaatttaacgatttcgaccagctcgttgacgcgatcgttgctaggttggatcgggcctctggtgttagctcccgccttgctgctctcatcaagcggcagggtgcccactcagagcgcaccttcgagaccgctccttctgagatcgacgcggacgaggttctcgaaatcctctccgactcggaccgatg

SEQ ID NO: 6752 - DNA, 203 bp, Homo sapiens
  source 1..203: mol_type = other DNA
ggcgcgccagtcctgaccaagaaagaggacacaccggatgaaccgcaagcggcttattcgggcatgcctcaacttggtaagaaagacgccaaggcaaagggcccaaaacccgcccccaccaggggcgtcgtgcgacaagccggcccctcccctgctcttcccaagattgccgacaacgtcttgccaatcgactcggaccgatg

SEQ ID NO: 6753 - DNA, 203 bp, Homo sapiens
  source 1..203: mol_type = other DNA
ggcgcgccagtcctgatctggacccctacctcccgccagtatcgtgacctccgtcgctttctgggctcccacccctaccctactggccacctcatctctgctttccaaggcgttccgatgttcatacggttctccaagaatcatatggtcactctggacgtcgaatctgttgtccacgaacccgtcgccgactcggaccgatg

SEQ ID NO: 6754 - DNA, 203 bp, Homo sapiens
  source 1..203: mol_type = other DNA
ggcgcgccagtcctgtatgacttggactacaagtgttttgatgccaccctcccttcctgcgcattcagaattgttgaagattacctcgtgaaattgactggcgacgagcgcgtccgcgcgtacgtcgaaaccatcaggcattccaagcatgtctatggtagtcagacttacgagatgatcggcggcaacgactcggaccgatg

SEQ ID NO: 6755 - DNA, 203 bp, Homo sapiens
  source 1..203: mol_type = other DNA
ggcgcgccagtcctgctcaatctctgtgcagcttgacctcagaactctggcctcccactgttcgtcctggtagaatagacaagcttttcactatccctaagaccactctctccgtggcattttcctctcagtgtcctgctccctcacgggactgcacccaggaactgtgagcttccccccctgtccttcgactcggaccgatg

SEQ ID NO: 6756 - DNA, 203 bp, Homo sapiens
  source 1..203: mol_type = other DNA
ggcgcgccagtcctcctcagaactctggcctcccactgttcgtcctggtagaatagacaagcttttcactatccctaagaccactctctccgtggcattttcctctcagtgtcctgctccctcacgggactgcacccaggaactgtgagcttccccccctgtccttgaaatttctattcttttcttgccgactcggaccgatg

SEQ ID NO: 6757 - DNA, 203 bp, Homo sapiens
  source 1..203: mol_type = other DNA
ggcgcgccagtcctgtgatagggtggctcaattgaccttaggaaacagcactatcactactcaagaggcagcgaacatcacagttgcctatggtgaatggccatcgtacttaagtgatttggatgctaccgctgtagacaagactaccaaaccaggcgtttcatgtgatagattctacacattacctgcgactcggaccgatg

SEQ ID NO: 6758 - DNA, 203 bp, Homo sapiens
  source 1..203: mol_type = other DNA
ggcgcgccagtcctgaaagaaatgggaggcaactactaaaggatgggagtggaaacttccagacgcactgacagagcttggcgtttttggacagaattgtcagttccatttcttatataggtgtgggtggtctatacacgtgcaatgtaatgccacgaagtttcatcagggcacattactagtggtagcgactcggaccgatg

SEQ ID NO: 6759 - DNA, 203 bp, Homo sapiens
  source 1..203: mol_type = other DNA
ggcgcgccagtcctgagcaatagcccaaggtattcctactacaaacacgccaggttcctaccagttcctcactactgatgaagatagtagtgcatgtatacttcctgatttcacaccaacccaagaaatccacattccaggagaggtcaagaatctacaggcactgtgtcaagttgagtccttactggcgactcggaccgatg

SEQ ID NO: 6760 - DNA, 203 bp, Homo sapiens
  source 1..203: mol_type = other DNA
ggcgcgccagtcctcacttgagataactttcatgtttactgggtcattcatgacaacggggaagctgctgttagcctatacccctccaggtggtagtgcaccagctagtagagaagatgccatgcttggcactcatgtaatatgggattttggattacagagctccataaccctagttgtcccttggacgactcggaccgatg

SEQ ID NO: 6761 - DNA, 203 bp, Homo sapiens
  source 1..203: mol_type = other DNA
ggcgcgccagtcctatgctagtgatgagggcatgatggaaactagacatgtcgtcaatacaaacacagtatcagaaacatctatagagagcttctatggtcgttgtggtctcgtatccatcaaagaaatagccgataacaagcaggttgagaaatggttggttaattttaatgaatttgtacagctaacgactcggaccgatg

SEQ ID NO: 6762 - DNA, 203 bp, Homo sapiens
  source 1..203: mol_type = other DNA
ggcgcgccagtcctctaacccatcagcaatctttagtgccaacactgttcctgctagattcagcgtcccgtttgtgggaacagcaaatgcgtacacgattatgtacgacggatacaatgtgtttggatcaaacagaccatcagctgattatggcatgatcaacagcagtcacatgggtagcatggcctcgactcggaccgatg

SEQ ID NO: 6763 - DNA, 203 bp, Homo sapiens
  source 1..203: mol_type = other DNA
ggcgcgccagtccttcaggtgccagcatggagtgatcggtgttgtgactgctgggggccagggagtggttggatttgctgatgtgcgcgacctcttctgggttgagcatgaagcaatggaacaaggccttactgattacattcagcaacttggaaacagttttggtcagggttttacagcagaaattacgactcggaccgatg

SEQ ID NO: 6764 - DNA, 203 bp, Homo sapiens
  source 1..203: mol_type = other DNA
ggcgcgccagtcctccaattatgccagtcaactttcagagatgttaattggcgctgacggtatggtggagaggtgcctgcaaacctttgtgaaagtgatctcagcggttgtaattgccaccaggtctcaaggtgatgttcctactatacttgcaacccttgctctcatcggatgcgatggtagtccctcgactcggaccgatg

SEQ ID NO: 6765 - DNA, 203 bp, Homo sapiens
  source 1..203: mol_type = other DNA
ggcgcgccagtcctaagcgagagaaaggcaagagtttaccaccaatttaaagactttaccattactggaagcgcaggtcgcaactttggaacactcctgcccaaccactgaacaacaggagaccatctttggaaacattcagtacctagctcaccactgcaggagatatgccccactttatgcagctgcgactcggaccgatg

SEQ ID NO: 6766 - DNA, 203 bp, Homo sapiens
  source 1..203: mol_type = other DNA
ggcgcgccagtcctatgcgattcctccagacagtgaccattttgacggataccagcagcaggccgtggtagttatggatgatctcaaccagaacccggatgggaaagatatggttgctttttgtcaaatggtctccaccgtgccttaccatgtacctatggctgccattgaagagaagggaatgctctcgactcggaccgatg

SEQ ID NO: 6767 - DNA, 203 bp, Homo sapiens
  source 1..203: mol_type = other DNA
ggcgcgccagtccttcactaagccacaaggcaagattgattgggttgaaccctctaagaaacatgggtttccagtgattaatgcaccatccaaaaccaaacttgagcccagtgttttctttgatgtgtttgagggagtcaaagaaccagctgctcttcatccaaaggaccccaggcttgaggttaactcgactcggaccgatg

SEQ ID NO: 6768 - DNA, 203 bp, Homo sapiens
  source 1..203: mol_type = other DNA
ggcgcgccagtccttggaagaagcactcttttccaaatacactggtaacgtagacattgagatgccagaggaaatgaaagaggcggtggatcattatgctaatcagcttttggcactagacataccaactgagccacttagcatggaggaagccatttatggcacggaaggccttgaagctctggattcgactcggaccgatg

SEQ ID NO: 6769 - DNA, 203 bp, Homo sapiens
  source 1..203: mol_type = other DNA
ggcgcgccagtccttacgaggagttttgccgcaagatcagatcagtaccagttggcagagctcttcacttaccatcatactcttcactgctgcgagagtggtatgagaagttttaaattacagttcaattgattatccggattggcctaaacttcaattggatacaatacacccaccggatggggtgtcgactcggaccgatg

SEQ ID NO: 6770 - DNA, 203 bp, Homo sapiens
  source 1..203: mol_type = other DNA
ggcgcgccagtcctctcacactcatttcccccctcgcctgtcacaggcaacccccaccccttctcttacgggagttagggccaaggatctgttgcataggcgttgtatcccctaaccttttacctacccatcccaataggactggtatttcggttttgattgagtaatggatactgattctatacctgcgactcggaccgatg

SEQ ID NO: 6771 - DNA, 203 bp, Homo sapiens
  source 1..203: mol_type = other DNA
ggcgcgccagtcctttacccattcaggggaaaaatggagtttctttcatggatctgacttgatatgaccaagagtcaacactttgcgtgttggccgtatggaatgctttaaggtttattctttggattatgacttcagggttggccgcccaggataaaaggcaattgtggtaagtgatgttagtcattcgactcggaccgatg

SEQ ID NO: 6772 - DNA, 203 bp, Homo sapiens
  source 1..203: mol_type = other DNA
ggcgcgccagtcctagtccttgacgaatgcgtcccgtctgtcccgacggtgaggcgtatggcgcatgctcatggcattacccaatggtgtatctgtgaggggggggctcctcacacttagtctagtgctacctgacagggccgcggctggtcgtttgtgtatggtataaccagtagtaatcccccatgcgactcggaccgatg

SEQ ID NO: 6773 - DNA, 203 bp, Homo sapiens
  source 1..203: mol_type = other DNA
ggcgcgccagtcctgattgctttaacttcccctcctcccttaccaagacattctctaagatggcaatctatgaggatgactcctcggagtcaattacatgctgtaactggattccacggaatcgtcgtaacaaagtaagaaaacaaaaacccaggagtaaggcctccagagtcgagatgtcaccagggcgactcggaccgatg

SEQ ID NO: 6774 - DNA, 203 bp, Homo sapiens
  source 1..203: mol_type = other DNA
ggcgcgccagtcctcctcttgtcaccttggccgatgatggctatctctatgtgcataaacataaaggtgagactaaatttgttaggagggatgaaattctcacaaaatatggcagatgtattgttgagatggaagaagtttttcaatgtggacaagtccaatcaaatcaaacgggaaacaaaccatcgcgactcggaccgatg

SEQ ID NO: 6775 - DNA, 203 bp, Homo sapiens
  source 1..203: mol_type = other DNA
ggcgcgccagtccttacacatttgattcattaaattggcaaaatacacagtatggagagtggacatgccccttgccaggcgcccttatggacactggggtgtttggacagaacttgagattccactatttatatagatctggtttttgtgtacatgtacaggtgaatgcttcttccttccatcagggtcgactcggaccgatg

SEQ ID NO: 6776 - DNA, 203 bp, Homo sapiens
  source 1..203: mol_type = other DNA
ggcgcgccagtccttgtttattggttgccatggtgcccgaacatcagacaccaaaacagcaaaacaatgacttccaatactatgagactaaggaattttgtggaactgaatatccaacagaacagttgaccctcttcccacatcaattcttaaacctgagaacaaataattctgttacaattgtttaccgactcggaccgatg

SEQ ID NO: 6777 - DNA, 203 bp, Homo sapiens
  source 1..203: mol_type = other DNA
ggcgcgccagtcctccttacacaaattgcaccccttctggttttggattgagtcataattttgttactttagtaattaggattgttgttcctctgtcctattcaacaggtgcttccactcaaatccctattactgtaagtgttgcccccatgtgttcttcatttgctggtttgagatctgcagttaaacgactcggaccgatg

SEQ ID NO: 6778 - DNA, 203 bp, Homo sapiens
  source 1..203: mol_type = other DNA
ggcgcgccagtcctaatgtaaatatttctaagagtgctactgtacagggagaatcagactcaattccatctgctctaaatgctcacattgaacaagcggtcacaagtgcattaaacacccggccacaacacagccatgacaatgggcttgagattatacagggagatgcacccgctctaactgctgcacgactcggaccgatg

SEQ ID NO: 6779 - DNA, 203 bp, Homo sapiens
  source 1..203: mol_type = other DNA
ggcgcgccagtcctaaaggccccttcactgcttggtggtggaaagatgatataattataacctcatatcatgcttgcaatgattggtatgcatatcttgaaaggaaaaacccagtttttaggtatagaattagtatgtcaactaagagatggtggaagaacccttaccttgttgaggccgttggcgtgcgactcggaccgatg

SEQ ID NO: 6780 - DNA, 203 bp, Homo sapiens
  source 1..203: mol_type = other DNA
ggcgcgccagtcctactgaatatagattcccccaatactgtgaattgctaaactttagagatcaccaacagagagacctatggagttgtgtgggtgatgctgagccaggtttttgtggtagtatgctcttttctgaaggcaaagtcatagggatgctcactgccaaatctgaatgtacatatgctgatcgactcggaccgatg

SEQ ID NO: 6781 - DNA, 203 bp, Homo sapiens
  source 1..203: mol_type = other DNA
ggcgcgccagtcctggagtggagggctttctcaaggacaaattatttaactctttgttttccattcttgttaaggccataggatctcttgtgatctacataaatgctaaagatgaatgtaagctttctacccttttagctcttggtagcatgttaggtgtggatttcatgtcaaaagaccccttcacacgactcggaccgatg

SEQ ID NO: 6782 - DNA, 203 bp, Homo sapiens
  source 1..203: mol_type = other DNA
ggcgcgccagtcctgatctggaatttgccaaatctcttatgaaatcttctctgttccctgtttgtacatccactggttcctatactgctctaggactgtttgaccaatggcttgttcttcccgctcactcaaaccccaaggattctattgttttcaaaggtgagagtgttaaaatagtcgactctatgcgactcggaccgatg

SEQ ID NO: 6783 - DNA, 203 bp, Homo sapiens
  source 1..203: mol_type = other DNA
ggcgcgccagtcctggtttggatctgaacacatctgctgggtacccctacaacacaatggggataaggaagagagacttaatcccacacagaggtgaaccattgacacaattgcagaaagctctcgatttacatggttatgatcttcccttctctacttatctaaaggatgaacttagacccaaggcacgactcggaccgatg

SEQ ID NO: 6784 - DNA, 203 bp, Homo sapiens
  source 1..203: mol_type = other DNA
ggcgcgccagtcctgttgttcatggagggatgccatcaggatgttcagggacctccatttttaattctatcattaataatttagttgttaggactttagttcttaagtgctataaaggaatcaacttagatttactaagaatccttgcttatggagatgacttacttgtctcatacccatttccattgcgactcggaccgatg

SEQ ID NO: 6785 - DNA, 203 bp, Homo sapiens
  source 1..203: mol_type = other DNA
ggcgcgccagtcctgaccctgcggtgcttgctgatgcgggcaaggagttaggcctcacaatgaccccagctgataaatctgattcttttagtggttgtagtaagttaactgaagttactttcttgaagagatcttttgtctttgatgaacaattcccttttctttgccacccagtgttccctatgtctcgactcggaccgatg

SEQ ID NO: 6786 - DNA, 203 bp, Homo sapiens
  source 1..203: mol_type = other DNA
ggcgcgccagtcctgaaattcatgagtccattagatggactaggagtgctgcaacaacacaggaacatgtgacatcgttgtgcttattggcttggcataacggaaaggaagtttatgaagaattttgtgaaaagattcgcagcactccagttgggcgagctttatctttgccatcttttgaggtgcttcgactcggaccgatg

SEQ ID NO: 6787 - DNA, 203 bp, Homo sapiens
  source 1..203: mol_type = other DNA
ggcgcgccagtcctcaccaagtgaattcttttcacttgatgacttgtgtcgccaacaaattttaaagatggtttatattgaccaatacgcttttcacatgttacatgaagacataaattgtatagggtttactctatcaatttatgatgaagataaacgaatgaaggacataacttattgggatctgacgactcggaccgatg

SEQ ID NO: 6788 - DNA, 203 bp, Homo sapiens
  source 1..203: mol_type = other DNA
ggcgcgccagtcctattgtgaatatcatgaaaatttatatgatgcactaatgtcggccgaatttgaacaagtttggtttacattattgcttaaatatcttgattttgtaccagtaccaatgaattggagaggaatgccagaatttcctaccatttatgtatcaaaacatttttggtatgaattatatccgactcggaccgatg

SEQ ID NO: 6789 - DNA, 203 bp, Homo sapiens
  source 1..203: mol_type = other DNA
ggcgcgccagtcctcttataaaaacaggactccgatagttattgaggcacaaacatcaggagataatatgactcttaaacaaccacgaccagttgttatagaagctcagacatctgctgattgtgttactttagctaaaaacacacaacgaatgattgaagcatttgcaagttctgatactgtaacaccgactcggaccgatg

SEQ ID NO: 6790 - DNA, 203 bp, Homo sapiens
  source 1..203: mol_type = other DNA
ggcgcgccagtcctgtgataaaacttatacgctaaatgatgttaagaaaggacaatatatattgcgacaaggattagaatatacgatgccgacaattgatggtgattgtggagccccactaatcatcaatgaaacacaggttactagaaagatagctggtatacatgttgctggtgcagcatgtggtccgactcggaccgatg

SEQ ID NO: 6791 - DNA, 203 bp, Homo sapiens
  source 1..203: mol_type = other DNA
ggcgcgccagtcctgagcttatgcagaatctataacccaaaaagatttggagcgtacatttagtaaaatagatgttacgatgcaaatccaattggatttagattcttcattagatttttctagaaccgaacccaaaattcctgctggagtcgaatttggaccggaagctctcactttttgtgatcttccgactcggaccgatg

SEQ ID NO: 6792 - DNA, 203 bp, Homo sapiens
  source 1..203: mol_type = other DNA
ggcgcgccagtcctggagtagctccccaggatatccttggataaaggatagagtgaaaggaactaaaggaaaacaaggctggtttggtactgatggagaatttattctcaacgaagatgtcgaattagccgtacaacgacgactacaagcagctcgtgaaggaaaacgattacctgtgatgtgggtcgcgactcggaccgatg

SEQ ID NO: 6793 - DNA, 203 bp, Homo sapiens
  source 1..203: mol_type = other DNA
ggcgcgccagtcctcgatgagagattttagtaaacatgtttccctcgtctcttatggagatgataatgtaattaacttcagtgatgaagttagtgcatggtataacatgtctactattgcagaggctttttcaacacttggattcacttatacagatgagctcaagggagttagaggcgaggtaccaacgactcggaccgatg

SEQ ID NO: 6794 - DNA, 203 bp, Homo sapiens
  source 1..203: mol_type = other DNA
ggcgcgccagtcctttcgaaataccatacctgctgataaccaagaaaacgattctaccaatgtacataacacgaaactcgcgtcgacctcagcggagaatgccattgagaaggaacaaatcaccacctttcatgatgtggaaactccaaataggatcgatacccccatggctcaggatacttcatcggcgactcggaccgatg

SEQ ID NO: 6795 - DNA, 203 bp, Homo sapiens
  source 1..203: mol_type = other DNA
ggcgcgccagtcctctaggagcatggatgatacgcacagtattattcagtttctacaacgccccgttctcattgacaacattgagattgttgcaggaacaactgccgataacaacacagcactcagtagatatgtgctagatagaacaaacccgcaaaaatacattaaacaatggacattaccatcaacgactcggaccgatg

SEQ ID NO: 6796 - DNA, 203 bp, Homo sapiens
  source 1..203: mol_type = other DNA
ggcgcgccagtcctcccgtgcaggtgttacaggttatccgggagtcgaactagatttccaattagacaattcagttgagatgactattccatatgcatcttttcaagaagcatatgatttagttagtgggaatgaagattttgtgcagttgtacctttttacaattgcaccggttttgggaccttcagcgactcggaccgatg

SEQ ID NO: 6797 - DNA, 203 bp, Homo sapiens
  source 1..203: mol_type = other DNA
ggcgcgccagtcctctgaatcagcgaattcaaaagtagacctttcagtctatatgtggttagataacatatctctcgttatccccacatatagattgaatccaaatcttccaaccggacaaactctaacccgcatagttcagaattccgattctgataaactcaaagaagcacttaagattgctaagtcgactcggaccgatg

SEQ ID NO: 6798 - DNA, 203 bp, Homo sapiens
  source 1..203: mol_type = other DNA
ggcgcgccagtcctacccgataagtaacggagatgattggggcggtgtaataccagtgggaatgccttgctactctaagactattagagcagttaaaggcgccacttcgacgtcaaaaaccgaagtgatggacccagcaccgtgtgaatatgttgcaaatcttttctcatattggcgtgcaactatgtcgactcggaccgatg

SEQ ID NO: 6799 - DNA, 203 bp, Homo sapiens
  source 1..203: mol_type = other DNA
ggcgcgccagtcctgaactcaaactcagcgaccaagaaggaaggttgatccagaacagtataacaatagagagaatggttctctccgcatttgatgaaaggaggaacaggtacctagaggaacatcccagtgcggggaaggacccgaagaagaccggaggtccaatctaccgaaggagagacgggaaacgactcggaccgatg

SEQ ID NO: 6800 - DNA, 203 bp, Homo sapiens
  source 1..203: mol_type = other DNA
ggcgcgccagtccttgggtgagagagctgattctgtatgacaaagaggagataaggagaatttggcgtcaagcgaacaatggagaagacgcaactgctggtctcactcatatgatgatctggcattccaacctaaatgatgccacataccagagaacaagagccctcgtgcggactggaatggacccccgactcggaccgatg

SEQ ID NO: 6801 - DNA, 203 bp, Homo sapiens
  source 1..203: mol_type = other DNA
ggcgcgccagtcctgagagaatgtgcaacatcctcaaagggaaatttcaaacagcagcacaaagagcaatgatggatcaggtgcgagaaagcagaaatcctgggaatgctgaaattgaagatctcatctttctggcacggtctgcactcatcctgagaggatccgtagcccataagtcctgcttgcctcgactcggaccgatg

SEQ ID NO: 6802 - DNA, 203 bp, Homo sapiens
  source 1..203: mol_type = other DNA
ggcgcgccagtcctgcttgtgtgtacgggctcgctgtggccagtggatatgattttgagagggaagggtactctctggttgggatagatcctttccgtctgcttcagaacagtcaggtcttcagtcttattagaccaaatgagaatccagcacataaaagtcaattggtatggatggcatgccattctcgactcggaccgatg

SEQ ID NO: 6803 - DNA, 203 bp, Homo sapiens
  source 1..203: mol_type = other DNA
ggcgcgccagtcctggaaacaccaatcaacagagagcatctgcaggacaaatcagtgtacagcccactttctcagtacagagaaatcttcccttcgaaagaccgaccattatggctgcgtttaaggggaataccgagggcagaacatctgacatgaggactgaaatcataaggatgatggaaagtgcccgactcggaccgatg

SEQ ID NO: 6804 - DNA, 203 bp, Homo sapiens
  source 1..203: mol_type = other DNA
ggcgcgccagtcctttggtctggacatcagaactgccactcgtgaaggaaagcatatagtggagcggattctggaggaagaatctgacgaggcacttaaaatgactatcgcttcagtgcctgcttcacgctacctaactgaaatgactcttgaggaaatgtcaagggattggttaatgctcattcccacgactcggaccgatg

SEQ ID NO: 6805 - DNA, 203 bp, Homo sapiens
  source 1..203: mol_type = other DNA
ggcgcgccagtcctaaatgacattccatggagcaaaggaagttgcactcagttactcaactggtgcgcttgccagttgcatgggtctcatatacaaccggatgggaacagtgaccacagaagtggctcttggcctagtatgtgccacttgtgaacagattgctgatgcccaacatcggtcccacaggccgactcggaccgatg

SEQ ID NO: 6806 - DNA, 203 bp, Homo sapiens
  source 1..203: mol_type = other DNA
ggcgcgccagtcctagatggcgactaccaccaacccactaatcaggcatgagaacagaatggtactagccagcactacggctaaggccatggagcagatggctggatcaagtgagcaggcagcagaagccatggaagtcgcaagtcaggctaggcaaatggtgcaggctatgaggacaattgggactccgactcggaccgatg

SEQ ID NO: 6807 - DNA, 203 bp, Homo sapiens
  source 1..203: mol_type = other DNA
ggcgcgccagtcctagaattgctccacacagagcataatggaatgctgtgtgcaacaagcctgggacatcccctcattctagacacatgcactattgaaggactagtctatggcaacccttcttgtgacctgctgttgggaggaagagaatggtcctacatcgtcgaaagatcatcagctgtaaatggcgactcggaccgatg

SEQ ID NO: 6808 - DNA, 203 bp, Homo sapiens
  source 1..203: mol_type = other DNA
ggcgcgccagtcctaggactatttggagccatagctggattcatagaaggaggttggccaggactagtcgctggctggtatggtttccagcattcaaatgatcaaggggttggtatggctgcagatagggattcaactcaaaaggcaattgataaaataacatccaaggtgaataatatagtcgacaacgactcggaccgatg

SEQ ID NO: 6809 - DNA, 203 bp, Homo sapiens
  source 1..203: mol_type = other DNA
ggcgcgccagtcctgcatggtccagctcaagctgccatgatgggaaggcatggttacatgtttgtgtcactggggatgatagaaatgcgactgctagcatcatttatgatgggatgcttaccgacagtattggttcatggtctaagaacatcctcagaactcaggagtcagaatgcgtttgcatcaatcgactcggaccgatg

SEQ ID NO: 6810 - DNA, 203 bp, Homo sapiens
  source 1..203: mol_type = other DNA
ggcgcgccagtcctacaagcagcgtatatatagaagtattgcatttgactcaaggaacttgctgggagcagatgtacacaccaggaggggaggtaagaaatgatgatgttgaccaaagtttaatcattgctgctaggaacattgtcaggagagcaacagtatcagcagacccattggcttcactcctgcgactcggaccgatg

SEQ ID NO: 6811 - DNA, 203 bp, Homo sapiens
  source 1..203: mol_type = other DNA
ggcgcgccagtcctgcaatcttacgaaaggggagaaagctaatgtattgatagggcaaggagacgtagtgttggtaatgaaacggaaacgggactctagcatacttactgacagccagacagcgaccaaaagaattcggatggccatcaattagtgtcgaattgtttaaaaacgaccttgtttctactcgactcggaccgatg

SEQ ID NO: 6812 - DNA, 203 bp, Homo sapiens
  source 1..203: mol_type = other DNA
ggcgcgccagtcctaaacgatggaagttgtccagcaaacgagagtggataagctgacccaaggtcgccagacttatgactggacattgaatagaaaccagccggctgcaactgctttggccaacaccatagaagtattcagatcgaacggtctaacagccaatgagtcaggaaggttaatagatttcccgactcggaccgatg

SEQ ID NO: 6813 - DNA, 203 bp, Homo sapiens
  source 1..203: mol_type = other DNA
ggcgcgccagtcctcaaatgttgtgagaaagatgatgactaactcacaagacacagagctctcctttacagttaccggagacaacaccaaatggaatgagaatcagaatcctcgaatatttctagcaatgataacatacatcacaaggaaccaacctgaatggtttagaaatgtcttgagcattgccccgactcggaccgatg

SEQ ID NO: 6814 - DNA, 203 bp, Homo sapiens
  source 1..203: mol_type = other DNA
ggcgcgccagtcctagggaatacaagcaggagtggatagattctataggacttgcaagctagttggaatcaacatgagcaaaaagaagtcttacataaatcggacaggaacatttgagttcacaagctttttctaccgctatgggtttgtagccaacttcagcatggagctgcccagctttggagtttcgactcggaccgatg

SEQ ID NO: 6815 - DNA, 203 bp, Homo sapiens
  source 1..203: mol_type = other DNA
ggcgcgccagtcctcatttgaattgaagaagctgtgggagcagacccgctcaaaggcaggactgttggtttcagatggagggccgaatttatacaacatccggaatcttcacattccagaagtttgcttgaagtgggagttgatggatgaagattaccagggaagactgtgtaaccctctgaacccgtcgactcggaccgatg

SEQ ID NO: 6816 - DNA, 203 bp, Homo sapiens
  source 1..203: mol_type = other DNA
ggcgcgccagtcctttgtcagtcataaggaagttgaatccgtcaacaatgctgtggtaatgccagcccatggtccggccaagagcatggaatatgatgccgttgcaactacacattcatggattcccaagagaaatcgctccattctcaacactagccaaaggggaattcttgaggatgaacaaatgtcgactcggaccgatg

SEQ ID NO: 6817 - DNA, 203 bp, Homo sapiens
  source 1..203: mol_type = other DNA
ggcgcgccagtcctaccagaagtgctgcactctattcgagaaattcttccctagcagttcatatcggaggccagttggaatttccagcatgatggaggccatggtgtctagggcccgaattgatgcacggattgacttcgagtctggaaggattaagaaagaagaatttgctgagatcttgaagatctcgactcggaccgatg

SEQ ID NO: 6818 - DNA, 203 bp, Homo sapiens
  source 1..203: mol_type = other DNA
ggcgcgccagtccttcagatcgatagcaagctggatccagagtgagttcaacaaggcatgtgaattgaccgattcgagctggatagaactcgatgagataggggaagatgttgccccaattgagcacattgcaagcatgagaaggaactacttcacagcggaagtgtctcattgcagggccactgagtcgactcggaccgatg

SEQ ID NO: 6819 - DNA, 203 bp, Homo sapiens
  source 1..203: mol_type = other DNA
ggcgcgccagtcctagatgaaatgggggatggaaatgagacgctgccttcttcaatctcttcaacagattgagagcatgatcgaggctgagtcttctatcaaagagaaagacatgaccaaagaattctttgaaaacagatcggagacatggccaattggagagtcacctaagggagtggaggaaggctcgactcggaccgatg

SEQ ID NO: 6820 - DNA, 203 bp, Homo sapiens
  source 1..203: mol_type = other DNA
ggcgcgccagtccttgcgcttcttgcgtgaccggttagtactcttaacactctccgcctacttggtcgtcagcgctgtcttgggcacatctgttggggttagttcgacgctctacggtatcccccgcgtgacgaactacggtgttggggccgcttcgtgcgagccgatcgcctggtgtgtttcggctgcgactcggaccgatg

SEQ ID NO: 6821 - DNA, 203 bp, Homo sapiens
  source 1..203: mol_type = other DNA
ggcgcgccagtcctcactagcgagtgttagtagtagtactgttgcttcgtagcggagcatgacggccgtgggaatccctccttggcaacaaggacccacggggccgaaagccacgtcctgaaggacccgtcatgtgtgcaaccccagcacggcagctttattatgaaacccactttaaggtgacactgcgactcggaccgatg

SEQ ID NO: 6822 - DNA, 203 bp, Homo sapiens
  source 1..203: mol_type = other DNA
ggcgcgccagtcctgaatcggtaccgccttgcgaccaagcgaagtgtgtatggtggacggcacggacatgtgcctggctgacttccacgctggcattttcctgaaaggacaggaacacgctgtgtttgcctgtgtcacctccaacgggtggtacgcgattgacgacgaggacttttacccctggacgccgactcggaccgatg

SEQ ID NO: 6823 - DNA, 203 bp, Homo sapiens
  source 1..203: mol_type = other DNA
ggcgcgccagtcctcggacccgtccgatgtcctggtatatgttccgtacgatcaagaaccactcaacggagaatggaaagcaaaggttcagaaacgactcaagggagccgggcaatccagcccggcaaccgggtcgcagaaccagtcaggcaacactggaagcatcattaacaactactacatgcagccgactcggaccgatg

SEQ ID NO: 6824 - DNA, 203 bp, Homo sapiens
  source 1..203: mol_type = other DNA
ggcgcgccagtcctaataccagaattccatggacacacaacttggtgacaacgctattagcggaggctccaacgaaggttccacggacaccacttccacacacacaaacaacacccaaaacaacgattggttctcgcgcctagccagttcggccttcaccggactgtttggcgctcttttggccgacacgactcggaccgatg

SEQ ID NO: 6825 - DNA, 203 bp, Homo sapiens
  source 1..203: mol_type = other DNA
ggcgcgccagtcctggtttttcaagaaacacctgtttgattggacaccaaatctatcgtttggacactgtcactacctggaactcccctccgaacacaaaggcgtgttcggcagcctcatggactcctacgcctacatgaggaacgggtgggacattgaggtgaccgctgttggaaaccagttcaatgcgactcggaccgatg

SEQ ID NO: 6826 - DNA, 203 bp, Homo sapiens
  source 1..203: mol_type = other DNA
ggcgcgccagtcctgtggttgcctcctcgtcgcactcgtcccggagctgaaagaacttgacacgcggcagaagtaccagttgaccctcttcccacaccagttcatcaacccacgcaccaacatgacggctcacatcaacgtgccgttcgtgggtgtcaacaggtacgaccaatacaagctccacaagccgactcggaccgatg

SEQ ID NO: 6827 - DNA, 203 bp, Homo sapiens
  source 1..203: mol_type = other DNA
ggcgcgccagtcctccacagaacccgagcgggccgcgcactgtatacattctgagtgggacactggtcttaattctaagttcaccttttccattccttacctctctgctgctgactacgcttacactgcttctgacgtggccgagaccacgagtgtgcagggatgggtgtgcatttatcagattacgccgactcggaccgatg

SEQ ID NO: 6828 - DNA, 203 bp, Homo sapiens
  source 1..203: mol_type = other DNA
ggcgcgccagtcctttgctgttcttgcacagcgggtaagcaacaggctgcccacctccttcaactacggtgctgtgaaggctgacaccatcacggagctgttgatccgcatgaagcgtgcggagacatactgccccaggcctttgctagctcttgacaccacccacgaccgccgtaagcaggagatcacgactcggaccgatg

SEQ ID NO: 6829 - DNA, 203 bp, Homo sapiens
  source 1..203: mol_type = other DNA
ggcgcgccagtcctctgataccggccttgagattctggacagcacgtttgtcgtgaagaagatctccgactcgctctccagtctctttcacgtcccggcccccgtcttcagtttcggagccccgattctgttggctgggttggtcaaggtcgcctccagtttcttccggtcaacacccgaagacctcgcgactcggaccgatg

SEQ ID NO: 6830 - DNA, 203 bp, Homo sapiens
  source 1..203: mol_type = other DNA
ggcgcgccagtcctagcaacgggacctcaacgacccaagcaagtacaaggaggctaaggagtggctcgacaacgcgcgccaagcgtgtttgaagagcgggaacgtccacattgccaacctgtgcaaagtggtcgccccggctcccagcaagtcgggacccgatcccgtggtcgtttgtctccgtggcacgactcggaccgatg

SEQ ID NO: 6831 - DNA, 203 bp, Homo sapiens
  source 1..203: mol_type = other DNA
ggcgcgccagtcctagccccaaccacctctacagaatgtctaccaacttgttcaggaggtgattgaccgggttgagctccacgagaaagtgtcgaaccacccgatcttcaaacaaatctcaattccttcccaaaagtccgtgttgtactttctcatcgagaagggacagcacgaagcagcaattgaatcgactcggaccgatg

SEQ ID NO: 6832 - DNA, 203 bp, Homo sapiens
  source 1..203: mol_type = other DNA
ggcgcgccagtcctagcccaccaaacccgcggaagagcaaccacaagctgaaggaccctacgccgggccgctcgagcgtcagaaacctctgaaagtgaaagctaagctgccacagcaggagggaccctacgctggcccgatggagagacagaaaccactgaaagtgaaagtgaaagccccggtcgcgacgactcggaccgatg

SEQ ID NO: 6833 - DNA, 203 bp, Homo sapiens
  source 1..203: mol_type = other DNA
ggcgcgccagtcctaggaaggaccttacgagggaccggtgaagaagcctgtcgctttgaaagtgaaagctaagaacctgattgtcactgagagtggtgccccaccgaccgacttgcaaaagatggttagtggcaacacaaagcctgttgagctcatcctcgacgggaagacagtagccatctgctgtgcgactcggaccgatg

SEQ ID NO: 6834 - DNA, 203 bp, Homo sapiens
  source 1..203: mol_type = other DNA
ggcgcgccagtcctctactggagtgtttggcaccgcctacctcgtgcctcgtcatcttttcgctgagaagtatgacaagatcatgttggacggcagagccatgacagacagtgattacagagtgtttgagtttgagattaaagtaaaaggacaggacatgctctcagacgccgcgctcatggtgctgccgactcggaccgatg

SEQ ID NO: 6835 - DNA, 203 bp, Homo sapiens
  source 1..203: mol_type = other DNA
ggcgcgccagtcctctggcctctttgcctacagagccgccaccaaggctggctactgtggaggagctgttctcgccaaggacggcgccgacacattcatcgttggcacacactccgcaggtggcaatggagttggatactgctcttgtgtttccaggtccgtgctccagaggatgaaggcacacattgcgactcggaccgatg

SEQ ID NO: 6836 - DNA, 203 bp, Homo sapiens
  source 1..203: mol_type = other DNA
ggcgcgccagtcctaccctgaaccacaacacgaggggttgatcgttgacaccagagatgtggaagagcgtgtgcacgtcatgcgcaaaaccaagctagcacccaccgtggcacacggtgtgttcaaccctgagtttgggcccgccgccctgtccaacaaggacccgcgcctgaacgaaggagttgtcccgactcggaccgatg

SEQ ID NO: 6837 - DNA, 203 bp, Homo sapiens
  source 1..203: mol_type = other DNA
ggcgcgccagtcctccatggagccagacaccgcgcctggccttccctgggctctccaggggaagcgccgcggcgcgctgatcgacttcgagaacggcacggtcggacccgaagttgaggctgccttgaagctcatggagaaaagagaatacaagtttgcttgccagaccttcctgaaggacgaggttccgactcggaccgatg

SEQ ID NO: 6838 - DNA, 203 bp, Homo sapiens
  source 1..203: mol_type = other DNA
ggcgcgccagtcctcctacgagaacaaacgcatcactgttgaaggcgggatgccgtctggctgttccgcaactagcatcatcaacacaattctgaacaacatctacgtgctctacgcgctgcgtagacactatgagggagttgagctggacacttacaccatgatttcctacggggatgacatcgtggcgactcggaccgatg

SEQ ID NO: 6839 - DNA, 203 bp, Homo sapiens
  source 1..203: mol_type = other DNA
ggcgcgccagtccttcgcaagtgattacgatctggactttgaggctcttaagccccacttcaaatctcttggccaaaccatcactccagctgacaaaagcgacaaaggttttgttcttggtcactccattgccgatgtcactttcctcaaaagacacttccacatggattatggaactgggttttacacgactcggaccgatg

SEQ ID NO: 6840 - DNA, 203 bp, Homo sapiens
  source 1..203: mol_type = other DNA
ggcgcgccagtcctaacctgtgatggcttcgaagaccctcgaggccatcctctcctttgcacgccgtgggaccatacaggagaagttgatctccgtggcaggactcgcagtccactctggacctgacgagtaccggcgtctctttgagcccttccagggtctctttgagattccaagctacagatcaccgactcggaccgatg

SEQ ID NO: 6841 - DNA, 203 bp, Homo sapiens
  source 1..203: mol_type = other DNA
ggcgcgccagtcctactctgacagagaatgaaaatcccgaagacattgactgctggtgctatggagtgcccaacgtgtatgtcacatacggacgttgcaaacatgatggacaaccgcgaaggaacagacgatccgtggctttgacaaaccatgttgaagaaacattgaacacccgtggagagaggtggcgactcggaccgatg

SEQ ID NO: 6842 - DNA, 203 bp, Homo sapiens
  source 1..203: mol_type = other DNA
ggcgcgccagtccttacaaggcaaccctctcagaacataagacagccaaccattgcccaacggcaggagaagcctttttagatgaagagagtgatgaccaacatatttgcaaacgtgggttctctgaccgaggctggggaaatggatgtgggttatttggaaaaggaagtattgtcgcctgctcaaaacgactcggaccgatg

SEQ ID NO: 6843 - DNA, 203 bp, Homo sapiens
  source 1..203: mol_type = other DNA
ggcgcgccagtcctgatgagccacacgctacaacagtcaccgtcacgagcatggggaaccaagaaggatccctgaaggcatccatggttggggctacaaaaatctcttattctgaaaacaaatatcacatcaaaggaggacatgcagtttgccaaatacaactacagggactaaccatgaaaggaagccgactcggaccgatg

SEQ ID NO: 6844 - DNA, 203 bp, Homo sapiens
  source 1..203: mol_type = other DNA
ggcgcgccagtccttacccaacatcgccgcgtgaaattgctgccgtcattgcacaaacattctcaaatggcgcatgtgggctcaactctgtggatgagttagaacaccaaatgtggaaaggaattgaagatgaaattaaccacgttctaagtgagaatggtctggatctgtctgtagtcgtgcaggaccgactcggaccgatg

SEQ ID NO: 6845 - DNA, 203 bp, Homo sapiens
  source 1..203: mol_type = other DNA
ggcgcgccagtcctggaacttggcaaattaccagattggaattacaatcatacagggaatgtctttggcctccaatgcacacagcaggaatcacttctgtgatggaaagtgatttgttcatgccccgagagctgggaggacctgtcaccttacataaccatatcccaggttacgcgacacaggtttatcgactcggaccgatg

SEQ ID NO: 6846 - DNA, 203 bp, Homo sapiens
  source 1..203: mol_type = other DNA
ggcgcgccagtcctccatggtcacacgtcctgatgggcacaggtctgttaatagtgtcaactgtgcacccagctggattggttctggccgctttcgcattctggtattatcagtacaccaagcaacgcagcaatattctatgggaactaccagaagtcgccgagcggacaccaatgttgactgaaggacgactcggaccgatg

SEQ ID NO: 6847 - DNA, 203 bp, Homo sapiens
  source 1..203: mol_type = other DNA
ggcgcgccagtcctgacctgcatccaggatctgggaaaacccgacaagtactgcccgctcttcttaggaaatgtgtggaaaaaaggcttagaacactcgtcctggctccaacaaaagtagtgttgagtgaaatgcatgaagcagttaaagacttaccagttaggttccacacgagcgccgcgctggaacgactcggaccgatg

SEQ ID NO: 6848 - DNA, 203 bp, Homo sapiens
  source 1..203: mol_type = other DNA
ggcgcgccagtcctttggcagcagttgtgttaatgacagcaacacctcctggaacaagtgatccattcccggagtctaatgggacaatagaagacacacaggtgactattccagatgaaccttggaaaagaggcaacgaatggatacttgatgatccccggccaactgcgtggttcctgccttccatccgactcggaccgatg

SEQ ID NO: 6849 - DNA, 203 bp, Homo sapiens
  source 1..203: mol_type = other DNA
ggcgcgccagtcctggagatttggtgtgctggaaagaagcgttgatgatcctggataacatggaaatccctggaggattcacgatgagcctctttggtagtgaggctaggaaagtcgagcacgttccaggggaataccgtttaaaaccagaagcaaggaaacggttcaggcaactgatgaggaagtatcgactcggaccgatg

SEQ ID NO: 6850 - DNA, 203 bp, Homo sapiens
  source 1..203: mol_type = other DNA
ggcgcgccagtcctagaatgtttgctgacggacagacccaaaaagcgttcatagagtacgcaacaacaacacgatcaataacagccgtgatcgaaaaggtggctatggtgccagaggccttaaaagacaaggtgcaggatgctttcgacacctactacactttgtacaaggcagaagaaaaatcacgccgactcggaccgatg

SEQ ID NO: 6851 - DNA, 203 bp, Homo sapiens
  source 1..203: mol_type = other DNA
ggcgcgccagtcctagttaccaaatcgctcttgaacagatacctgatgccctaataacgacattgtgcttgggagccttggctgcagccacaggaggaatccttctctatttgttgctgccaaaaggaatgtctcgcatgacactggctttcttcactatgttggtaacgggggctggtttatggatgcgactcggaccgatg

SEQ ID NO: 6852 - DNA, 203 bp, Homo sapiens
  source 1..203: mol_type = other DNA
ggcgcgccagtcctgtcaactatggagccatatcattacagggaatatcccagggagcggctgccctttttcagatggacaaggggtatcctttcatgcggttgagaattccgctggttctgctgttggcaggggccatcaacaacctcactgccatcacagcaggactagggttcctatgtgctatgcgactcggaccgatg

SEQ ID NO: 6853 - DNA, 203 bp, Homo sapiens
  source 1..203: mol_type = other DNA
ggcgcgccagtcctgctgcagtaggaatggctcatgccttatggaatgcccaggcaaatcgcagaggtggcacaggatccggaatgaccccaggggaggcttggaagaaacagctgaataagcttgggaaaacacaatttgagcagtacaagagatcatgcatacttgaagtggacaggacacatgcccgactcggaccgatg

SEQ ID NO: 6854 - DNA, 203 bp, Homo sapiens
  source 1..203: mol_type = other DNA
ggcgcgccagtcctgtaatggccttcaccctgggtgtgcaagggcatgaaaagccaataatgagaacaactctagggtggaatctcataagattcaaggacaagacagatgtgttcaacatggaagtaatccctggggacacactgttatgtgacattggagaaagttcaccgagcattgcagtggaacgactcggaccgatg

SEQ ID NO: 6855 - DNA, 203 bp, Homo sapiens
  source 1..203: mol_type = other DNA
ggcgcgccagtcctattgatgaggacaagataagacgacgggtggaccttctaagagaagagtacaagaagacctggttccatgatttaaaccatccatacaggacgtggcattacattggctcttacttgacaagaggaggaggaacagcggcatccatgaccaatggcatagtcaaactcatgtcacgactcggaccgatg

SEQ ID NO: 6856 - DNA, 203 bp, Homo sapiens
  source 1..203: mol_type = other DNA
ggcgcgccagtcctcaaccatgggacgcagtggctggggtggcatgcatggccatgactgacacaacaccatttggacagcagagagtgtttaaagagaaagtggataccaaaccgccagaacccaacaagacagtgcgtcatgtgatggccatgactaatagctggatcatgaaatacttggccaggcgactcggaccgatg

SEQ ID NO: 6857 - DNA, 203 bp, Homo sapiens
  source 1..203: mol_type = other DNA
ggcgcgccagtcctgaatgtagaacatgtgtgtacaacatgatggggaaacgagagaagaaaccatctgaatttgggaaagccaaagggagccgagccatatggtatatgtggctcggagctcggtttcttgagtttgaggcactgggtttcttaaatgaagatcactgggtctcccggaagaactctcgactcggaccgatg

SEQ ID NO: 6858 - DNA, 203 bp, Homo sapiens
  source 1..203: mol_type = other DNA
ggcgcgccagtcctctgatcgggagggctaggatttcccctggaaatggctggttggttagagagactgccccattaagcaaggcctatgctaacatgtggaaactgttttactttcaccgtagagatctaaggctgatggctaatgcaatcaactcagctgtccccattgactgggtcccaacgggacgactcggaccgatg

SEQ ID NO: 6859 - DNA, 203 bp, Homo sapiens
  source 1..203: mol_type = other DNA
ggcgcgccagtcctatgattggcacatcaaagagaagcagttgggctgaagctcttcctcacactgtacaaaaggtgagaggcattgtggggacacaagagaggtaccgtgattaccttgaaactcaaaacaggttcaggaccatagtccaacatcttgttggagatatcctgtgagagcaataaaaacgactcggaccgatg

SEQ ID NO: 6860 - DNA, 203 bp, Homo sapiens
  source 1..203: mol_type = other DNA
ggcgcgccagtcctattttaaagacaaaagtgtcaggccaagattgagaaaatcttgccacagcttggcagactgtgcagcctgcagccctagagggagactgaccaactccctttagtagaaaaggtcagggaagaacttgaggatgggtgtggcctcaagatctcttctcaaaaaacggactgaaccgactcggaccgatg

SEQ ID NO: 6861 - DNA, 203 bp, Homo sapiens
  source 1..203: mol_type = other DNA
ggcgcgccagtcctaccacacctagatgaagatagtaggggagcctccgccaatggtggctttacatattgagctactgcattggtcgatggggactagcggttagaggagaccctctcctacgcatggattttgcaatatgttgacatcagggaaagaccgggtgtttgtcggttccggagagctcccgactcggaccgatg

SEQ ID NO: 6862 - DNA, 203 bp, Homo sapiens
  source 1..203: mol_type = other DNA
ggcgcgccagtcctggtcgatggggactagcggttagaggagaccctctcctacgcatggattttgcaatatgttgacatcagggaaagaccgggtgtttgtcggttccggagagctccggaggccagggcgccgtttgcccgtagtttataactggccttcggggatcgaaggagttgccaaacactcgactcggaccgatg

SEQ ID NO: 6863 - DNA, 203 bp, Homo sapiens
  source 1..203: mol_type = other DNA
ggcgcgccagtcctgtcaaggttgagccacatacaggaaactatgtcgcggccaatgaaacccacagtgggaggaaaaccgcattgttcacagtctcttcggaaaaaacaattctaaccatgggcgaatacggagacgtgtcgctgatgtgcagagtcgctagtggcgtcgatctggcacaaaccgttcgactcggaccgatg

SEQ ID NO: 6864 - DNA, 203 bp, Homo sapiens
  source 1..203: mol_type = other DNA
ggcgcgccagtcctgttcttgagctcgacaagacagcagaacacctccccacggcatggcaggttcacagagattggtttaacgatctagctctgccttggaaacatgagggaatggtgggttggaacaatgctgaacgcctggttgagtttggagttcctcatgccgtgaagatggatgtttacaaccgactcggaccgatg

SEQ ID NO: 6865 - DNA, 203 bp, Homo sapiens
  source 1..203: mol_type = other DNA
ggcgcgccagtcctgagatgcagctccccccaggagacaacatcatctatgttggggaactaaaacaccagtggttccagaaggggagtagcattggtagagttttccagaaaacaaggaaaggcatagagaggctgacagtgctgggggaacatgcgtgggacttcggttccactggcggatttttgcgactcggaccgatg

SEQ ID NO: 6866 - DNA, 203 bp, Homo sapiens
  source 1..203: mol_type = other DNA
ggcgcgccagtcctaccatgacgcttggagtgggggctgacgttggatgtgctgtggacactgaaagaatggaacttcgctgtggtgaaggtttggtcgtgtggagagaggtgtcagaatggtatgataactatgctttttaccctgaaacaccggcggcccttgcttcggctttgaaggagatggttcgactcggaccgatg

SEQ ID NO: 6867 - DNA, 203 bp, Homo sapiens
  source 1..203: mol_type = other DNA
ggcgcgccagtcctgatcaaggtggcctggtgcgctcgatggtggtggctgacaatggagagctgctcagcgaaggaggaatccctggaattgtggcagtgttcgtggtccttgaatacatcattcgcaaaaggccgagtgcaggactgacggttgtgtggggaggagtcgtggtcttggcgctgcttcgactcggaccgatg

SEQ ID NO: 6868 - DNA, 203 bp, Homo sapiens
  source 1..203: mol_type = other DNA
ggcgcgccagtcctgtcactggcatggtaacgctgcagagcatgctgcgttatgttattgctgtgggggtgacatttcacctcgagctagggccagaaatcgtggctttgatgctgctccaggcagtgttcgagctaagggtcggactcctcggtgcgtttgtgctgcgcagaagtctaacaacccgccgactcggaccgatg

SEQ ID NO: 6869 - DNA, 203 bp, Homo sapiens
  source 1..203: mol_type = other DNA
ggcgcgccagtcctgaggtggtgaccatctattttctcctcttggtcctggaacttggtctgccgagcgcaaacctggaggccttgtgggggtgggcagacgcattagccatgggagcaatgatattcagagcttgcacggctgagggaaaaaccggactgggactcctgttggtggctctcatgacccgactcggaccgatg

SEQ ID NO: 6870 - DNA, 203 bp, Homo sapiens
  source 1..203: mol_type = other DNA
ggcgcgccagtccttggggacaccgccaggtcggagttggctttggttctaagggcgtcctccacacaatgtggcacgtgactaggggagctgccatattcattgacaatgcagtggctggaccctattgggcagatgtgaaggaggatgttgtgtgctacgggggagcctggagcctggaggagaaacgactcggaccgatg

SEQ ID NO: 6871 - DNA, 203 bp, Homo sapiens
  source 1..203: mol_type = other DNA
ggcgcgccagtccttggaaaggagaaaaggttcaagttcatgcctttcctccaggaagagctcatgaagtgcatcagtgccaacctggagaattggttctggatactggaaggaggattggtgcaatacccattgatctggcgaaagggacatccggcagccccatactcaacgcccagggggcggtgcgactcggaccgatg

SEQ ID NO: 6872 - DNA, 203 bp, Homo sapiens
  source 1..203: mol_type = other DNA
ggcgcgccagtcctagacaaaaagggaagagtgtgatttgcctaaacagcaagacctttgaaaaagactattccagagttagagatgagaaaccagattttgtggtgacaacagacatttcagaaatgggggcaaatcttgatgtgagtcgcgtcatagatgggcgaacgaacattaagccagaggagcgactcggaccgatg

SEQ ID NO: 6873 - DNA, 203 bp, Homo sapiens
  source 1..203: mol_type = other DNA
ggcgcgccagtcctgtggcatatgcttcgggacggcggagtcttggggacatgctgacaggaatgtcaggggttcctgagctcctgcgccacagatgcatgagtgccatggatgtcttttacacactgctttatgaggagcctggcagcagagcaatgaagatggcagagagagatgctccagaagcccgactcggaccgatg

SEQ ID NO: 6874 - DNA, 203 bp, Homo sapiens
  source 1..203: mol_type = other DNA
ggcgcgccagtcctcttgtgttctacaccttgttgacagtgctgcagcctgaagctggcaagcagaggagcagcgacgacaacaagctggcttacttcctcctgacactctgcagcctagctggcctggtggctgccaacgagatgggattcctggaaaagaccaaggcagatttatctgctgtgctacgactcggaccgatg

SEQ ID NO: 6875 - DNA, 203 bp, Homo sapiens
  source 1..203: mol_type = other DNA
ggcgcgccagtcctcaggccatgcgagatcttggggggggaactcctttctttggagtggctggacacgtcctgactctcggagtggtatccctagtgggagcgacaccaacctccttggtggtgggcgtaggactagcagcttttcacctggccatcgtggtgtccggcctggaggctgagctgacccgactcggaccgatg

SEQ ID NO: 6876 - DNA, 203 bp, Homo sapiens
  source 1..203: mol_type = other DNA
ggcgcgccagtcctcagagagcccacaaagttttcttctcggcaatggtacgcaatcccatggtggacggagatgtcatcaacccatttggagatggggaagtgaaacctgccctgtatgaaaggaagatgagcttgatactggcgatgatcctgtgtttcatgtctgtggttttgaaccgaacggtgcgactcggaccgatg

SEQ ID NO: 6877 - DNA, 203 bp, Homo sapiens
  source 1..203: mol_type = other DNA
ggcgcgccagtcctcccgcagttacggaggcatcggctgtaggactggcagcagcagggcagcttatcaggcctgaggctgacacgctctggaccatgccggtggcttgtgggctgagtggtgtggtcaggggaagcctatgggggtttctgcctcttgggcacaggctatggctgagaacttccggacgactcggaccgatg

SEQ ID NO: 6878 - DNA, 203 bp, Homo sapiens
  source 1..203: mol_type = other DNA
ggcgcgccagtcctagaatggtgacaagcctgggttggaatttaatcaagtttagggctggaatgaatgtgtttaccatgcaaccacatcgcgctgatactgtgatgtgcgatattggagagagtagcccggacgccgccattgaaggtgagagaacccgcaaagtgatactgctcatggagcagtggcgactcggaccgatg

SEQ ID NO: 6879 - DNA, 203 bp, Homo sapiens
  source 1..203: mol_type = other DNA
ggcgcgccagtcctcaatacagtgatacctggcatgtggatagggaacacccataccgaacgtggcagtactggggtagctatcgcacagcgcccactggctctgcagcttcactgattaatggagttgtgaagctcctcagctggccgtggaatgcacgggaagatgtggtgcggatggcaatgacacgactcggaccgatg

SEQ ID NO: 6880 - DNA, 203 bp, Homo sapiens
  source 1..203: mol_type = other DNA
ggcgcgccagtcctttgaagaagctgtcgctgttggagggaggtcttttctatgcggacgacacagccggatgggacaccagggtcaccaatgcggatctggaagatgaagagcagatcctgcgttacatggaaggtgaacacaaacagctggcagccactgttatgcaaaaggcatatcatgccaagcgactcggaccgatg

SEQ ID NO: 6881 - DNA, 203 bp, Homo sapiens
  source 1..203: mol_type = other DNA
ggcgcgccagtccttcacacaaccccaggctgctacgagtggagaggtggctgcgtgaccacggagaagaacgccttggaagaatgctgatcagtggagatgattgtgtggtgagacccatagatgacaggtttagcaaggccctctacttcttgaatgatatggccaagactagaaaggacatcggccgactcggaccgatg

SEQ ID NO: 6882 - DNA, 203 bp, Homo sapiens
  source 1..203: mol_type = other DNA
ggcgcgccagtcctgaatgggagcattcagctggcttctcaagctgggaggaggttcccttctgctcgcaccatttccatgagttggtgatgaaggacggacgcaccctggtcgtgccatgccgagatcaggacgaactggtggggagggcacgcgtctcaccggggtgtggttggagtgtccgcgagcgactcggaccgatg

SEQ ID NO: 6883 - DNA, 203 bp, Homo sapiens
  source 1..203: mol_type = other DNA
ggcgcgccagtcctgctggccggtggtagaaaaccccccaacagggtgccaaacggcaacacgccagtgagagtggcgacgggaacatggtcgctcccgacgtagggcactctatccaattttgtgagaccccccgcaccatggaaggccaaacatggtgcatgaagggaaaggcccccggaagcttgcgactcggaccgatg

SEQ ID NO: 6884 - DNA, 203 bp, Homo sapiens
  source 1..203: mol_type = other DNA
ggcgcgccagtcctggaaaacgagtcaaacaagtggccccaccaccaactaggggtcacatggagagaggactctctctcttaaccaagaacgacaatgtgtcgcgacaggcaaaacggcaacgaaaccctcggcaacagctttctggaatctttggcggtggtgttggcgcctggctgcgtgtgctacgactcggaccgatg

SEQ ID NO: 6885 - DNA, 203 bp, Homo sapiens
  source 1..203: mol_type = other DNA
ggcgcgccagtcctcacatggacatcggaacggcaatcttatggcttgccctggcaacggcatctctcggacagcgtatgtttaagcaactgaactctcttcgtaagcgcgtgaagcgcctcgaaaaacaacgtagtggaccgaaccttgtcatgatcattgggctcttggctcttggcttatgctatcgactcggaccgatg

SEQ ID NO: 6886 - DNA, 203 bp, Homo sapiens
  source 1..203: mol_type = other DNA
ggcgcgccagtcctgattgtggatcaagcgttgaagggtttcatctacggtatcaccgttgtgtgccccaagtgcgacgtcgacgagctccccaaccacaagtctcaaaccaagttggcttgttggaggaagtggagatgattggcttcaggttctttcgtgaaaatgttcccgtcatcgtggtgtgccgactcggaccgatg

SEQ ID NO: 6887 - DNA, 203 bp, Homo sapiens
  source 1..203: mol_type = other DNA
ggcgcgccagtcctatcgtgagggatgtcccgacccaattccaatttggcgacgttggcaccatcacgctcacgtgtggtgtcacaacagaccgcatagctggacactactatcacattcgtgagggagtcaaagctggattggtacttcgtgaggccgtggattcttggcctggcatgatcaaaatgcgactcggaccgatg

SEQ ID NO: 6888 - DNA, 203 bp, Homo sapiens
  source 1..203: mol_type = other DNA
ggcgcgccagtcctggtgggttcacttccggcatggacaaaattgtcagatggggaattacaactgctaatgaaataaagatcgatggtctcatcaaccctcaaattgattggcaaacttcggtgcttagggacatacgatccatttctttcacgtgcgaaatgatctttgacaacatctcgttcagccgactcggaccgatg

SEQ ID NO: 6889 - DNA, 203 bp, Homo sapiens
  source 1..203: mol_type = other DNA
ggcgcgccagtcctgaggatctgctgggaaacttgcggttctcatggtcttggttcccgagtagctggctggtcatggctttcataggtttggcgctattccttgttttcggaagagttggatcttttgttgtttttgtggtgatcatagctgtgtacgtgcggtcggtttctgctgacgtcggatgccgactcggaccgatg

SEQ ID NO: 6890 - DNA, 203 bp, Homo sapiens
  source 1..203: mol_type = other DNA
ggcgcgccagtcctgtcactcatggacggcttgagggggatatgggattgttgccaactctctttgggtcatttcctgagaaaccctctgacaaggttatccggattgtggcgtcaagacctgatatccggcgtctctgtggaaaagcggtttctttccagtttcagtacacagggtttcgacgggctcgactcggaccgatg

SEQ ID NO: 6891 - DNA, 203 bp, Homo sapiens
  source 1..203: mol_type = other DNA
ggcgcgccagtcctggaactatgcctgagataccaaaacctaagccaaaaatcgtggaggagccaataggagatgaatatgaccctgaagttgatgacatcctacacaactacggaaaagctcatgcctgttcggattttcgctcgtcgaactcacggacaggagttgggttcgacaggtccattctgcgactcggaccgatg

SEQ ID NO: 6892 - DNA, 203 bp, Homo sapiens
  source 1..203: mol_type = other DNA
ggcgcgccagtcctaatctcctgtgtctcgcggtgtctcttcagttgatcggagcgaaaacacgggtttctacactgacgcgcctggttctcaccatcctagccatgctcatatttggaatgcccaacatattttcatctgtggggctttctgcttgggtcttgttggcagcatcatcatctttgcggcgactcggaccgatg

SEQ ID NO: 6893 - DNA, 203 bp, Homo sapiens
  source 1..203: mol_type = other DNA
ggcgcgccagtcctctttatggcttgctagaactgtcagcggcagcgattctaatcggggcctacaacggaatatctcagacactcccaccggaagtcttggtattttgcctcgtgatgggttggaagacgtccctggccattctcaccgttgtgtctctgatgttcagtttgcacgcatgctacaggcgactcggaccgatg

SEQ ID NO: 6894 - DNA, 203 bp, Homo sapiens
  source 1..203: mol_type = other DNA
ggcgcgccagtcctattgtcgtcctggtcggatgtgcgttaacctctgtatccttctttcttggagccttgtacgtagttgtagcttccagcacaaatctaccacttcatgtggtgcgctacatccgcataagactttcggagcagaacagatctgacgatcttcttggcattggagtgtccggcggtcgactcggaccgatg

SEQ ID NO: 6895 - DNA, 203 bp, Homo sapiens
  source 1..203: mol_type = other DNA
ggcgcgccagtcctgttagtgatgactttggaaaaggatcatccggctcaccattcttcattaatggtgaccccgttgggttctatggtttcgggttttatgtggatggtatctaccgttcgatcgtggccggtggaaagcccactgatgtcaatgaacctatcggtgacgatgccaccaggcgtttccgactcggaccgatg

SEQ ID NO: 6896 - DNA, 203 bp, Homo sapiens
  source 1..203: mol_type = other DNA
ggcgcgccagtcctatcacatggcatcccggaaaaggcaagacgcgccgggtcattgtcgaggaaaccaaacagaattacgcggccaacctgcgaaccatcatcctgaccccaacccgagtcgtcatggctgaggtgattgaagcattgaaaaactacgacatcaagtgtgacaaaaatttgtcgtaccgactcggaccgatg

SEQ ID NO: 6897 - DNA, 203 bp, Homo sapiens
  source 1..203: mol_type = other DNA
ggcgcgccagtcctcaggccaatgcattggcagctgcgatccccggtgcggtcccactgcatcgtgcaaatttctctgccaactatgcccaggccagtagtgaagagacaaccttggtcgtgtcgacggatatctcggagatgggagccaaccttggagtcgacctcgtcattgatactcggaaagcgcgactcggaccgatg

SEQ ID NO: 6898 - DNA, 203 bp, Homo sapiens
  source 1..203: mol_type = other DNA
ggcgcgccagtcctgtggtcgtgtggatcctggggtttctggtagcaatgctcaagcccacgaagatgtcttatgagtcgatgccgtctggggaccctttcaatggtggcatggtactcacagcccctagcgtcctccactacatgggagttcctctcggattctgtgtcatcatctttcttgctatgcgactcggaccgatg

SEQ ID NO: 6899 - DNA, 203 bp, Homo sapiens
  source 1..203: mol_type = other DNA
ggcgcgccagtcctgaaccacaggaaactcaaagtcaagcatctactatctcggggtcattcttcacttctcgcgttaggggggagagggccacgatgttggactcgctgcaggtcttcttcttcgtaactgtgctaatgaatgaattcatcatctgggtgcaggagaactggatcgcacagatgtaccgactcggaccgatg

SEQ ID NO: 6900 - DNA, 203 bp, Homo sapiens
  source 1..203: mol_type = other DNA
ggcgcgccagtcctgtgatgaaacaccccgaaatggtgagcactgtgggcggattcagacttgacagaattccgttcagagccgtgcttccatctggtttcgccatagtcaccacatccagcttgtccagctcactcgtcggtcttgcagcgtcaagcttgttcctaaccatcgcgtattatcagaaccgactcggaccgatg

SEQ ID NO: 6901 - DNA, 203 bp, Homo sapiens
  source 1..203: mol_type = other DNA
ggcgcgccagtcctctggctgcccttgttgcacgattttctcggcacttggatagtatcgtcctgccccctcccgatttactcaagggaacccgagccgacccaactgccagcgtagcttctatggatgtgagtgatatggaggatcgtgtcaaacgaataaaacatgaaaaccagaccacctggtttcgactcggaccgatg

SEQ ID NO: 6902 - DNA, 203 bp, Homo sapiens
  source 1..203: mol_type = other DNA
ggcgcgccagtcctgtcgatccagaacatccgtacaaaagcttcaagtactttggatcatttgtgactgatgatgttaaggttggtgggcaggcaattaacccgctcgtaagaaaaatcatgtggccttgggaagcgataacttcggttgttggattcctcatgaccgacgtctccacatactcgcaacgactcggaccgatg

SEQ ID NO: 6903 - DNA, 203 bp, Homo sapiens
  source 1..203: mol_type = other DNA
ggcgcgccagtcctataggatcatggagcaagaatgtaccgtggagagatgtccaggatgccgttcaagatcaagccttctggaacctcgtcggacaagagcgacgccttcatctccaagggaaatgcgagatgtgtctttacaacactatgggaaagaaggagaagaaaccgagcctggctggtgagcgactcggaccgatg

SEQ ID NO: 6904 - DNA, 203 bp, Homo sapiens
  source 1..203: mol_type = other DNA
ggcgcgccagtcctgccaagggatctcgaaccatctggtacatgtggctaggaagccgtttcctcgaatttgaggctcttggtttccttaacgctgaccactgggtgagccgggaaaacttccccggtggtgttggaggtctaggagtgaactacttcggatattacctaaaagacatcgctggtcgacgactcggaccgatg

SEQ ID NO: 6905 - DNA, 203 bp, Homo sapiens
  source 1..203: mol_type = other DNA
ggcgcgccagtcctggtaaatatctctttgctgacgacatagctggatgggacacaaaaatcagctctgaggaccttgaagatgaggagaccttgttaaccgagctcacagccaatccataccataaagctctaattagagccaccatgaagctcgcttaccagaacatcgttgccatgttcccacgacgactcggaccgatg

SEQ ID NO: 6906 - DNA, 203 bp, Homo sapiens
  source 1..203: mol_type = other DNA
ggcgcgccagtcctacccattcaaagtatggtagtgggacggtcatggatgtggtgggacggcgagatcaacgaggctctgggcaagtagtgacatatgccttgaacactgtgaccaatggcaaagtacaagtcgctagggtattggagagcgaaggattgctcaacgctgacatcaatgtgattgaccgactcggaccgatg

SEQ ID NO: 6907 - DNA, 203 bp, Homo sapiens
  source 1..203: mol_type = other DNA
ggcgcgccagtcctaagtggcttaccaagaacatggaaaacgtcctgagtaacatggttatagcaggggatgatgtagtcgtctctactgacaacagagagttctcatcctctctcgagtaccttgagctgacgggaaagacgcggaagaacattccccaaggtgcaccctcccgaatggagtgcaatcgactcggaccgatg

SEQ ID NO: 6908 - DNA, 203 bp, Homo sapiens
  source 1..203: mol_type = other DNA
ggcgcgccagtcctatgtgggccttgtacttctttcaccgacgtgatcttcgcttaggatttgtagccattacctcttctgtccccacaaactggtttcccattggacgcacctcttggtcaattcaccaacatcatgagtggatgacaacatgcgacatgctacgtgtgtggaatgacgtgtggatccgactcggaccgatg

SEQ ID NO: 6909 - DNA, 203 bp, Homo sapiens
  source 1..203: mol_type = other DNA
ggcgcgccagtcctcacgacaacccatggatgaccatgaaggagcccatcaatgcctgggaagatatcccctatcttcataaaaaacaagacattgaatgtggcagtcttattggttccaaggaaagagccacctgggctcgcgacatggagaacagcgttctgagtgtccgcaagatcctggactcccgactcggaccgatg

SEQ ID NO: 6910 - DNA, 203 bp, Homo sapiens
  source 1..203: mol_type = other DNA
ggcgcgccagtccttggagtttgcatctgtctctatcccaagccctcagtggtttaagacagggggtatttggaactgatttccataacccctcatgcgcgacttttagagcagggcacgaaagtgtcgggcatgacgcacccgctcccccgagtcccctgaaaatagggtgggcaatgcactcctgacgactcggaccgatg

SEQ ID NO: 6911 - DNA, 203 bp, Homo sapiens
  source 1..203: mol_type = other DNA
ggcgcgccagtcctggcacgaaagtgtcgggcctgacgcacccgctcccccgagtcccctggaaacagggtgggcctcgaaaaatccaccgtaggaaggagcccaatcctacaagaaccctctggtcataggcacctgacctgggataagagtggcgccttatctcatatttagctagctggtggactcgactcggaccgatg

SEQ ID NO: 6912 - DNA, 203 bp, Homo sapiens
  source 1..203: mol_type = other DNA
ggcgcgccagtcctgattgtgagcgatttgcgtgcgtgcatcccgcttcactgatctcttgttagatctttttgtaatctaaactttataaaaacatccactccctgtaatctatgcttgtgggcgtagatttttcatagtggtgtttatattcatttctgctgttaacagctttcagccagggacgtcgactcggaccgatg

SEQ ID NO: 6913 - DNA, 203 bp, Homo sapiens
  source 1..203: mol_type = other DNA
ggcgcgccagtcctctggaaacagacggaatttgtcctgaaaatcatgtgatggtggattgtcgccgacttcttaaacaagagtgttgtgtgcagtctagcctaatacgtgaaattgttatgaatgcaagtccatatgatttggaggtgctacttcaagatgctttgcagtcccgtgaagcagttttgcgactcggaccgatg

SEQ ID NO: 6914 - DNA, 203 bp, Homo sapiens
  source 1..203: mol_type = other DNA
ggcgcgccagtcctgttacaacccccttaggtatgtctttagaggcatgctatgtgagaggttgtaatcctaaaggatggaccatgggtttgtttcggcgtagaagtgtgtgtaacactggtcgttgcactgttaataagcatgtggcctatcagttatatatgattgatcctgcaggtgtctgtcttcgactcggaccgatg

SEQ ID NO: 6915 - DNA, 203 bp, Homo sapiens
  source 1..203: mol_type = other DNA
ggcgcgccagtcctggtgcaggtcaattcgtgggttgggtcatacccttagcctttatgcctgtgcaatcccggaaatttattgttccatgggttatgtacttgcgtaagcgtggcgaaaagggtgcttacaataaagatcatggacgtggcggttttggacatgtttatgattttaaagttgaagatcgactcggaccgatg

SEQ ID NO: 6916 - DNA, 203 bp, Homo sapiens
  source 1..203: mol_type = other DNA
ggcgcgccagtcctctttctccatgtaaggagcttgaaggtgtaggtgctaaagttagtgcctttttacagaaattagaggataatcccctatttttatttgatgaggctggcgaggaagttcttgctcctaaattgtattgtgcctttacagctcctgaagatgatgactttcttgaggaaagtgatcgactcggaccgatg

SEQ ID NO: 6917 - DNA, 203 bp, Homo sapiens
  source 1..203: mol_type = other DNA
ggcgcgccagtcctgttgaagaagatgatgtagaaggtgaggaaactgatttaactgtcacaagtgctggacagccttgtgttgctagtgaacaggaggagtcttctgaagtcttagaggacactttggatgatggtccaagtgtggagacatctgattcacaagttgaagaagatgtagaaatgtcgcgactcggaccgatg

SEQ ID NO: 6918 - DNA, 203 bp, Homo sapiens
  source 1..203: mol_type = other DNA
ggcgcgccagtcctgattttgttgatcttgaatctgtgattcaggattatgaaaatgtttgttttgagttttatactacagagccagaatttgttaaagttttgggtctgtatgtgcctaaagcaactcgcaacaattgctggttgcgatcagttttggcagtgatgcagaaattgccctgtcaatttcgactcggaccgatg

SEQ ID NO: 6919 - DNA, 203 bp, Homo sapiens
  source 1..203: mol_type = other DNA
ggcgcgccagtccttggaaatgcattaaatgtgatttagctcttaagcttaaaggcttggatgctatgttcttttatggtgatgttgtttcacatatatgcaagtgtggtgagtctatggtacttattgatgttgatgtgccatttacagcccactttgctcttaaagataagttgttttgtgcatttcgactcggaccgatg

SEQ ID NO: 6920 - DNA, 203 bp, Homo sapiens
  source 1..203: mol_type = other DNA
ggcgcgccagtcctgtgtttatgaggttttatattattattgcctcttttattaagctctttagcttgtttaggcatgttgcctatggttgtagtaaatctggttgtttgttttgttacaagaggaatcgtagtctacgtgttaaatgtagtactatcgttggtggcatgatacgctattacgatgttcgactcggaccgatg

SEQ ID NO: 6921 - DNA, 203 bp, Homo sapiens
  source 1..203: mol_type = other DNA
ggcgcgccagtcctatggctaatggtggcactggcttttgttcaaaacatcaatggaattgcattgattgtgattcttataaaccaggtaatacttttattactgttgaggccgctcttgatctatctaaggaattgaaacggcccattcagcctacagatgttgcttatcatacggttactgatgttcgactcggaccgatg

SEQ ID NO: 6922 - DNA, 203 bp, Homo sapiens
  source 1..203: mol_type = other DNA
ggcgcgccagtccttgtaataacttggtgccaacatatttgaagagtgacaacattgtggcagctgatttaggtgttctgattcaaaattctgcaaagcatgtgcagggtaatgttgctaaaatagctggtgtttcctgtatatggtctgtggatgcttttaatcagtttagttctgatttccagcatcgactcggaccgatg

SEQ ID NO: 6923 - DNA, 203 bp, Homo sapiens
  source 1..203: mol_type = other DNA
ggcgcgccagtcctaaattgaagaaagcatgttgtaaaactggtttgaaactgaagcttacttataataagcagatggctaatgtctctgttttaactacaccctttagtcttaaagggggtgcagtttttagttattttgtttatgtgtgttttgtgttgagtttggtctgttttattggactgtggcgactcggaccgatg

SEQ ID NO: 6924 - DNA, 203 bp, Homo sapiens
  source 1..203: mol_type = other DNA
ggcgcgccagtccttttatccgttttccagaagtgttgcgagaagggcttgtacgtatcgtgcgtactcgttctatgtcgtattgcagagttggattatgtgaggaagctgatgagggtatatgctttaattttaatggttcttgggtgcttaataatgattattatagatcattgcctgggacctttcgactcggaccgatg

SEQ ID NO: 6925 - DNA, 203 bp, Homo sapiens
  source 1..203: mol_type = other DNA
ggcgcgccagtcctgataagtgttctgtagaagattttaatgtgtgggctctgtccaatggatttagccaagttaaatctgaccttgttatagatgctttagcttctatgactggtgtgtctttggaaacactgttggctgctattaagcgtcttaagaatggtttccaaggacgtcagattatgggtcgactcggaccgatg

SEQ ID NO: 6926 - DNA, 203 bp, Homo sapiens
  source 1..203: mol_type = other DNA
ggcgcgccagtcctagttgctcttttgaggatgaattgacacctagcgatgtttatcaacaactcgctggtatcaagttacaatcaaaacgcactagattgtttaaaggcactgtttgttggattatggcttctacatttttgtttagttgcataattacagcatttgtgaaatggactatgtttatgcgactcggaccgatg

SEQ ID NO: 6927 - DNA, 203 bp, Homo sapiens
  source 1..203: mol_type = other DNA
ggcgcgccagtcctggtacaatttcttctacagttagattgcaagctggaactgctactgaatatgcttccaactcatctatattgtctttatgtgcgttttctgtagatcctaagaaaacgtatttagattttatacaacaaggaggaacacctattgccaattgtgttaaaatgttgtgtgaccatcgactcggaccgatg

SEQ ID NO: 6928 - DNA, 203 bp, Homo sapiens
  source 1..203: mol_type = other DNA
ggcgcgccagtcctgtgtcttatgttttgacacatgatgtttgtcgagtttgtggattttggcgggatggaagttgttcatgtgttagcactgacactactgttcaatcaaaagatactaattttttaaacgggttcggggtacgagtgtagatgcccgtctcgtaccctgcgccagtggtttatctacgactcggaccgatg

SEQ ID NO: 6929 - DNA, 203 bp, Homo sapiens
  source 1..203: mol_type = other DNA
ggcgcgccagtcctgctatgagcgtgtaaaagattgtaagtttgtggctgaacacgatttctttacatttgatgtagaaggtagtcgtgtgccacacattgtacgcaaggatttaacaaagtatactatgttggatctttgctatgcattgcgacattttgatcgcaatgattgcatgctgctttgtgcgactcggaccgatg

SEQ ID NO: 6930 - DNA, 203 bp, Homo sapiens
  source 1..203: mol_type = other DNA
ggcgcgccagtcctctaatacatgttttgggcctcttgttaggcaaatttttgtggatggtgtgccttttgttgtttcaattggctaccattataaagaacttggtattgtgatgaatatggatgtggatacacatcgttatcgcttgtctttaaaagacttgcttttatatgctgctgatccagcttcgactcggaccgatg

SEQ ID NO: 6931 - DNA, 203 bp, Homo sapiens
  source 1..203: mol_type = other DNA
ggcgcgccagtcctctgtacttatgggttgggattatcctaagtgtgatcgtgctatgccaaacctactacgtattgttagtagtttggtattagcccgaaaacatgagacatgttgttcgcaaagcgataggttttatcgacttgcgaatgaatgcgcacaagttttgagtgaaattgttatgtgtgcgactcggaccgatg

SEQ ID NO: 6932 - DNA, 203 bp, Homo sapiens
  source 1..203: mol_type = other DNA
ggcgcgccagtcctaaaaagcatataaatttttgaatataaatgattgcactcgtattgttccggccaaggtcagggtggagtgctatgataagtttaaaattaatgacaccactcgtaagtatgtgtttactaccataaatgcattacctgagatggtgactgatattgttgttgtagatgaagttacgactcggaccgatg

SEQ ID NO: 6933 - DNA, 203 bp, Homo sapiens
  source 1..203: mol_type = other DNA
ggcgcgccagtcctgtatgcttaccaattatgagctttctgttattaatgctcgtattcgcgctaagcattatgtttatattggtgatcctgctcaattgccagcaccacgtgtgttattgagcaagggtacacttgaacctaaatattttaacactgttactaagctcatgtgttgcttagggccagcgactcggaccgatg

SEQ ID NO: 6934 - DNA, 203 bp, Homo sapiens
  source 1..203: mol_type = other DNA
ggcgcgccagtcctttacccttgatgggtattgtaagctttttataactaaagaagaagctgttaaacgcgtgcgtgcctgggttggctttgatgctgaaggtgctcatgccacgcgtgatagcattgggacaaatttcccacttcaattaggattttccacaggaattgattttgttgtggaagccacgactcggaccgatg

SEQ ID NO: 6935 - DNA, 203 bp, Homo sapiens
  source 1..203: mol_type = other DNA
ggcgcgccagtcctctggtttgtttgctgatagagatggttacagctttaaaaaggctgtggcgaaagctcctcctggtgaacaatttaagcacctcatccctttgatgacgagaggtcatcgctgggatgttgttagacctagaatagtacaaatgtttgcagatcatttaattgatctgtctgattcgactcggaccgatg

SEQ ID NO: 6936 - DNA, 203 bp, Homo sapiens
  source 1..203: mol_type = other DNA
ggcgcgccagtcctgtgttgtgctagttacatgggcagccaactttgagctcacttgtctccgctactttgcaaaagtagggcgtgagatttcttgtaatgtatgcactaaacgtgccacagtttacaattctagaactggttactatggttgttggcgccatagtgttacatgtgattacttgtatacgactcggaccgatg

SEQ ID NO: 6937 - DNA, 203 bp, Homo sapiens
  source 1..203: mol_type = other DNA
ggcgcgccagtcctttgttaagtctgttaagactcttttgtattcttttgaggcacataaggactcttttaaagacggtttgtgtatgttttggaactgtaatgtggataagtatccaccgaatgcagttgtatgtagatttgacactagagtgttgaataatttaaatcttcctggctgtaatggagcgactcggaccgatg

SEQ ID NO: 6938 - DNA, 203 bp, Homo sapiens
  source 1..203: mol_type = other DNA
ggcgcgccagtcctaagattttcagtttatgctttggtgtaacgatgagaaagttatgactttctatcctcgtttgcaagctgcatctgactggaagcctggttattctatgcctgtattatataagtatttgaattctccaatggaaagagttagtctctggaattatgggaagccagttactttgccgactcggaccgatg

SEQ ID NO: 6939 - DNA, 203 bp, Homo sapiens
  source 1..203: mol_type = other DNA
ggcgcgccagtcctatttgtgtaagcccaaggttgagatagatggaaatgttatgcatgccaattatttgttttggagaaattccacagtttggaacgggggtgcttatagcctgtttgatatggctaaattcccgcttaagttggctggtactgccgtaataaatttaagagcagaccagattaatgcgactcggaccgatg

SEQ ID NO: 6940 - DNA, 203 bp, Homo sapiens
  source 1..203: mol_type = other DNA
ggcgcgccagtcctagattaaatttgagaatcctcacatcctaggaagatgcatagttttagatgttaaaggtgtagaagaattgcatgacgatttagttaattacattcgtgataaaggttgtgttgctgaccaatccaggaaatggattggccattgcaccatagctcaactcacggatgcagcaccgactcggaccgatg

SEQ ID NO: 6941 - DNA, 203 bp, Homo sapiens
  source 1..203: mol_type = other DNA
ggcgcgccagtccttgtccattaaggaaaatgttgattttataaacagcatgcaattcaattataaaatcaccatcaacccctcatcaccggctagacttgaaatagttaagctcggtgctgaaaagaaagatggtttttatgaaaccatagttagtcactggatgggaattcgttttgaatacacatcgactcggaccgatg

SEQ ID NO: 6942 - DNA, 203 bp, Homo sapiens
  source 1..203: mol_type = other DNA
ggcgcgccagtcctcacccactgataagctagctatgattatgggttattgttgtttagatgtggtacgtaaagagctagaagaaggcgatcttcccgagaatgatgatgatgcttggtttaagctatcgtaccattatgaaaacaattcttggttcttccgacatgtctacaggaaaagttttcattcgactcggaccgatg

SEQ ID NO: 6943 - DNA, 203 bp, Homo sapiens
  source 1..203: mol_type = other DNA
ggcgcgccagtccttccttaccaacggcttttgctgttataggagatttaaagtgtacttcagatactagttatattaatgataaagacaccggtcctcctcctataagtactgatactgttgatgttactaatggtttgggtacttattatgttttagatcgtgtgtatttaaatactacgttgtttcgactcggaccgatg

SEQ ID NO: 6944 - DNA, 203 bp, Homo sapiens
  source 1..203: mol_type = other DNA
ggcgcgccagtcctctgggtaatcatcgcaaagaactatggcatttggatacaggtgttgtttcctgtttatataagcgtaatttcacatatgatgtgaatgctgattatttgtattttcatttttatcaagaaggtggtactttttatgcatattttacagacactggtgttgttactaagtttttgcgactcggaccgatg

SEQ ID NO: 6945 - DNA, 203 bp, Homo sapiens
  source 1..203: mol_type = other DNA
ggcgcgccagtcctagtgattttatgagtgagattaagtgtaaaacacaatctatagcaccacctactggtgtttatgaattaaacggttacactgttcagccaatcgcagatgtttaccgacgtaaacttaatcttcccaattgcaatatagaagcttggcttaatgataagtcggtgccctctccacgactcggaccgatg

SEQ ID NO: 6946 - DNA, 203 bp, Homo sapiens
  source 1..203: mol_type = other DNA
ggcgcgccagtcctcctcgacctgcaggtgttcttactaatcatgatgtagtttatgcacaacactgtttcaaagctcctaaaaatttctgtccgtgtaaattgaatggttcgtgtgtaggtagtggtcctggtaaaaataatggtataggcacttgtcctgcaggtactaattatttaacttgtgatcgactcggaccgatg

SEQ ID NO: 6947 - DNA, 203 bp, Homo sapiens
  source 1..203: mol_type = other DNA
ggcgcgccagtccttgtacaggaggtgccgaaattagggacctcatttgtgtgcaaagttataaaggcatcaaagtgttgcctccactgctctcagaaaatcagatcagtggatacactttggctgccacctctgctagtctatttcctctttggacagcagcagcaggtgtaccattttatttaaatcgactcggaccgatg

SEQ ID NO: 6948 - DNA, 203 bp, Homo sapiens
  source 1..203: mol_type = other DNA
ggcgcgccagtcctgtcttaaatcagagctacatcaatctcaaggacattggtacatatgaatattatgtaaaatggccttggtatgtatggcttttaatctgccttgctggtgtagctatgcttgttttactattcttcatatgctgttgtacaggatgtgggactagttgttttaagaaatgtggtcgactcggaccgatg

SEQ ID NO: 6949 - DNA, 203 bp, Homo sapiens
  source 1..203: mol_type = other DNA
ggcgcgccagtcctcaacccaagcaaactgctacctctcagcaaccatcaggagggaatgttgtaccctactattcttggttctctggaattactcagtttcaaaagggaaaggagtttgagtttgtagaaggacaaggtgtgcctattgcaccaggagtcccagctactgaagctaaggggtactggcgactcggaccgatg

SEQ ID NO: 6950 - DNA, 203 bp, Homo sapiens
  source 1..203: mol_type = other DNA
ggcgcgccagtcctgacattgtcgatcgggacccaagtagcgatgaggctattccgactaggtttccgcctggcacggtactccctcagggttactatattgaaggctcaggaaggtctgctcctaattccagatctacttcgcgcacatccagcagagcctctagtgcaggatcgcgtagtagagcccgactcggaccgatg

SEQ ID NO: 6951 - DNA, 203 bp, Homo sapiens
  source 1..203: mol_type = other DNA
ggcgcgccagtcctaaaccacagcgtcagcgtggtcataagaatggacaaggagaaaatgataatataagtgttgcagtgcccaaaagccgcgtgcagcaaaataagagtagagagttgactgcagaggacatcagccttcttaagaagatggatgagccctatactgaagacacctcagaaatataacgactcggaccgatg

SEQ ID NO: 6952 - DNA, 203 bp, Homo sapiens
  source 1..203: mol_type = other DNA
ggcgcgccagtcctgagaatgaaccttatgtcggcatctggtggtaacccctcgcagaaaagtcgagataaggcactctctatcagaatggatgtcttgctgctataatagatagagaaggttatagcagactatagattaattagttgaaagttttgtgttgtaatgtatagtgttggagaaagtgacgactcggaccgatg

SEQ ID NO: 6953 - DNA, 203 bp, Homo sapiens
  source 1..203: mol_type = other DNA
ggcgcgccagtccttgccattccttctgtagccgttcgcacctatagcgaagccgctgcacaaggttttcaggcatgccgttttgttgcttttggcttacaggattgtgtaaccggtattaatgatgatgattatgtcattgcattgactggtactaatcagctctgtgccaaaattttacctttttccgactcggaccgatg

SEQ ID NO: 6954 - DNA, 203 bp, Homo sapiens
  source 1..203: mol_type = other DNA
ggcgcgccagtccttgatagaccccttaatttgcgaggttggctcattttttctaacagcaattatgttcttcaggactttgatgttgtttttggccatggtgcaggaagtgtggtttttgtggataagtacatgtgtggttttgatggtaaacctgtgttacctaaaaacatgtgggaatttagggacgactcggaccgatg

SEQ ID NO: 6955 - DNA, 203 bp, Homo sapiens
  source 1..203: mol_type = other DNA
ggcgcgccagtccttgtgtctttatggcgtgttacagctgttcattctgatggaatgtttgtggcatcatcttcttatgatgcactcttgcatagaaattcattagaccctttttgctttgatgttaacactttactttctaatcaattacgtctagcttttcttggtgcttctgttacagaagatgtcgactcggaccgatg

SEQ ID NO: 6956 - DNA, 203 bp, Homo sapiens
  source 1..203: mol_type = other DNA
ggcgcgccagtcctatttaaacgacttggtgattatgttcttactgaaaacgctcttgttcgtttgactactgaagttgttcgtggtgttcgtgatgctcgcataaagaaagccatgtttactaaagtagttgtaggtcctacaactgaagttaagttttctgttattgaacttgccactgttaatttcgactcggaccgatg

SEQ ID NO: 6957 - DNA, 203 bp, Homo sapiens
  source 1..203: mol_type = other DNA
ggcgcgccagtcctgcgtcttgttgattgtgcacctgtagtttgccctaaaggtaagattgttgttattgctggacaagcttttttctatagtggtggtttttatcgttttatggttgatcctacaactgtattaaatgatcctgtttttactggtgatttattctacactattaagtttagtggtttcgactcggaccgatg

SEQ ID NO: 6958 - DNA, 203 bp, Homo sapiens
  source 1..203: mol_type = other DNA
ggcgcgccagtccttaagcttgatggttttaaccatcagtttgttactgctagttctgctacagatgccattattgctgttgagctgttgttattggattttaaaactgcagtttttgtgtacacatgtgtggttgatggctgtagtgtcattgttagacgtgatgctacattcgctacacatgtgtgcgactcggaccgatg

SEQ ID NO: 6959 - DNA, 203 bp, Homo sapiens
  source 1..203: mol_type = other DNA
ggcgcgccagtcctactgttgagtattgatgatggccatttatggaatctttttgttgaaaagtttaattttgttacagattggttaaaaactcttaagcttacacttacttctaatggtcttttaggtaattgtgccaaacgttttagacgtgttttggtaaaattgcttgatgtctataatggtttcgactcggaccgatg

SEQ ID NO: 6960 - DNA, 203 bp, Homo sapiens
  source 1..203: mol_type = other DNA
ggcgcgccagtccttcttgaaactgtctgtagtgtcgcatacactgctggtgtttgcatcaaatattatgctgttaatgttccatatgtagttattagtggttttgtaagtcgtgtaattcgtagagaaaggtgtgacatgacttttccttgtgttagttgtgtcacctttttctatgaatttttagacgactcggaccgatg

SEQ ID NO: 6961 - DNA, 203 bp, Homo sapiens
  source 1..203: mol_type = other DNA
ggcgcgccagtccttcatcaattagaatgtattgttgatgactctgttagagaagaggttgatataattgaacaaccttttgaagaagttgaacatgtgctctcaattaagcaacctttttctttttcttttagagatgaattgggtgttcgtgttttagatcaatctgataataattgttggattagcgactcggaccgatg

SEQ ID NO: 6962 - DNA, 203 bp, Homo sapiens
  source 1..203: mol_type = other DNA
ggcgcgccagtccttgtttgttttgttgatgttgattttcatagtgtagaaatagaagctggtgaagttaaaccttttgctgtatataaaaatgttaaattttatttaggtgatatttcacaccttgtaaactgtgtttcttttgactttgttgtcaatgctgctaatgaaaatctcttgcatggaggcgactcggaccgatg

SEQ ID NO: 6963 - DNA, 203 bp, Homo sapiens
  source 1..203: mol_type = other DNA
ggcgcgccagtcctacttgttgaagcttataattctattttatttgaaaatggtattccacttatgcctcttcttagttgtggtatttttggtgtaaggattgaaaattctcttaaagctttgtttagttgtgacattaataaaccattgcaagtttttgtttattcttcaaatgaagaacaagctgtcgactcggaccgatg

SEQ ID NO: 6964 - DNA, 203 bp, Homo sapiens
  source 1..203: mol_type = other DNA
ggcgcgccagtcctaaaggcagcactttttgcttctttggatgtaaagccatatggttaccctaatgattttgttggtggttttagagttcttgggaccaccgacaataattgttgggttaatgcaacttgtataattttacagtatcttaagcctacttttaaatctaagggtttaaatgttctttgcgactcggaccgatg

SEQ ID NO: 6965 - DNA, 203 bp, Homo sapiens
  source 1..203: mol_type = other DNA
ggcgcgccagtcctgcttaatggtattgcttatacaacattttcaggttcttttgataacggtcactatgtagtttatgatgctgctaataatgctgtctatgatggtgctcgtttattttcttcagatttgtctactttagctgttacagctattgttgtagtaggtggttgtgtaacatctaatgtcgactcggaccgatg

SEQ ID NO: 6966 - DNA, 203 bp, Homo sapiens
  source 1..203: mol_type = other DNA
ggcgcgccagtccttccaacaattgttagtgagaaaatttctgttatggataaacttgatactggtgcacaaaaatttttccaatttggtgattttgttatgaataacattgttctgtttttaacttggttgcttagtatgtttagtcttttacgtacttctattatgaagcatgatattaaagttatcgactcggaccgatg

SEQ ID NO: 6967 - DNA, 203 bp, Homo sapiens
  source 1..203: mol_type = other DNA
ggcgcgccagtccttgagtttttagctacatttattgtctgcaaaatcgttttatttgttagacatattattgttggctgtaataatgctgactgtgtagcttgttctaaaagtgctagacttaaacgtgtaccacttcaaactattattaatggtatgcataaatcattctatgttaatgctaatggcgactcggaccgatg

SEQ ID NO: 6968 - DNA, 203 bp, Homo sapiens
  source 1..203: mol_type = other DNA
ggcgcgccagtccttgttaatgatggacgtgttgatgacggttacatttgtggtgatggtcttatagaccttcttgttaatgtactctcaatctttagttcatcttttagcgttgtggctatgtctggacatatgttgtttaattttctttttgcagcatttattacatttttgtgctttttagttaccgactcggaccgatg

SEQ ID NO: 6969 - DNA, 203 bp, Homo sapiens
  source 1..203: mol_type = other DNA
ggcgcgccagtccttgttgagttttgttatttacaccaaattgagttaggtagtggtgctcatgttggttctgattttactggtagtgtttatggtaattttgatgaccaacctagtttgcaagttgagagtgccaaccttatgctatcagataatgttgttgcctttttgtatgctgctttgttgaacgactcggaccgatg

SEQ ID NO: 6970 - DNA, 203 bp, Homo sapiens
  source 1..203: mol_type = other DNA
ggcgcgccagtccttggttgtaggtggtggttgtgttcaactagagttaatgttgatggttttaatgaatgggctatggctaatggttatacaagtgtttctagtgttgagtgctattctattttggcagcaaaaactggtgttagtgttgaacaattgttagcttccattcaacatcttcatgaaggcgactcggaccgatg

SEQ ID NO: 6971 - DNA, 203 bp, Homo sapiens
  source 1..203: mol_type = other DNA
ggcgcgccagtccttaaagaagcacgctctgttaatagaaaatctaaagttattagtgctatgcactctttactttttggaatgttaagacgtttggatatgtctagtgttgaaactgttttgaatttagcacgtgatggtgttgtgccattgtcagttatacctgcaacttcagcttctaaactaaccgactcggaccgatg

SEQ ID NO: 6972 - DNA, 203 bp, Homo sapiens
  source 1..203: mol_type = other DNA
ggcgcgccagtccttattgttagtccagatcttgaatcttattctaagattgtttgtgatggttctgttcattatgctggagttgtttggacacttaatgatgttaaagacaatgatggtagacctgttcatgttaaagagattacaaaggaaaatgttgaaactttgacatggcctcttatccttaacgactcggaccgatg

SEQ ID NO: 6973 - DNA, 203 bp, Homo sapiens
  source 1..203: mol_type = other DNA
ggcgcgccagtcctacaagctggtaaacaaactgaattggctgttaattctggacttttaactgcttgtgctttttctgttgatccagcaactacttacttggaagctgttaaacatggtgcaaaacctgtaagtaattgtattaagatgttatctaatggtgctggtaatggtcaagctataacaaccgactcggaccgatg

SEQ ID NO: 6974 - DNA, 203 bp, Homo sapiens
  source 1..203: mol_type = other DNA
ggcgcgccagtccttagtgtagatgctaacaccaatcaagattcttatggtggagcgtctatttgtttgtattgtcgggcccacgttcctcaccctagtatggatggttactgtaagtttaagggtaaatgtgttcaggttcctattggttgtttggatcctattaggttttgtttagaaaataatgtcgactcggaccgatg

SEQ ID NO: 6975 - DNA, 203 bp, Homo sapiens
  source 1..203: mol_type = other DNA
ggcgcgccagtcctgtgtaatgtttgtggttgttggttgggacacgggtgtgcttgtgaccgtacaactattcaaagtgttgacatttcttatttaaacgagcaaggggttctagtgcagctcgactagaaccctgcaatggcacggacatcgataagtgtgttcgtgcttttgacatttataataaacgactcggaccgatg

SEQ ID NO: 6976 - DNA, 203 bp, Homo sapiens
  source 1..203: mol_type = other DNA
ggcgcgccagtcctaatgtttcattcttgggtaagtgtttgaagatgaactgtgttcgttttaaaaatgctgatcttaaggatggttattttgttataaagaggtgtactaagtcggttatggaacacgagcaatccatgtataacctacttaacttttctggtgctttggctgagcatgatttctttcgactcggaccgatg

SEQ ID NO: 6977 - DNA, 203 bp, Homo sapiens
  source 1..203: mol_type = other DNA
ggcgcgccagtcctacttggaaagatggcagagtcatttatggtaatgttagtagacataatcttactaaatatactatgatggacttggtctatgctatgcgtaactttgatgaacaaaattgtgatgttctaaaagaagtattagttttaactggttgttgtgacaattcttattttgatagtaagcgactcggaccgatg

SEQ ID NO: 6978 - DNA, 203 bp, Homo sapiens
  source 1..203: mol_type = other DNA
ggcgcgccagtcctggttggtatgacccagttgaaaatgaagatatacatagagtttatgcatctcttggcaaaattgtagctagagctatgcttaaatgcgttgctctatgcgatgcgatggttgctaaaggtgttgttggtgttttaacattagataaccaagatcttaatggtaacttttatgatcgactcggaccgatg

SEQ ID NO: 6979 - DNA, 203 bp, Homo sapiens
  source 1..203: mol_type = other DNA
ggcgcgccagtcctgttaaagattttgacttttaccgttataataagcctaccattttagatatttgtcaagctagagttacatataagatagtctctcgttattttgacatttatgaaggtggctgtattaaggcatgtgaagttgttgtaacaaatcttaataagagtgctggttggccattaaatcgactcggaccgatg

SEQ ID NO: 6980 - DNA, 203 bp, Homo sapiens
  source 1..203: mol_type = other DNA
ggcgcgccagtcctagagctttgcctaacatgatacgtatgatttcagccatggtgttgggctctaagcatgttaattgttgtactgcaacagataggttttataggcttggtaatgagttggcacaagttttaacagaagttgtttattctaatggtggtttttattttaagccaggtggtacgactcgactcggaccgatg

SEQ ID NO: 6981 - DNA, 203 bp, Homo sapiens
  source 1..203: mol_type = other DNA
ggcgcgccagtccttcattcattgatgattattatggttatcttaggaaacatttttcaatgatgattctctctgatgacggtgttgtctgttataacaaggattatgctgagttaggttatatagcagacattagtgcttttaaagccactttgtattaccagaataatgtctttatgagtacttctcgactcggaccgatg

SEQ ID NO: 6982 - DNA, 203 bp, Homo sapiens
  source 1..203: mol_type = other DNA
ggcgcgccagtcctcttattggtaaacaaaagataactacaatacagggtcctcctggtagtggtaagtcacattgttccattggacttggattgtactacccaggtgcgcgtattgtttttgttgcttgtgcccatgctgctgttgattccttatgtgcaaaagctatgactgtttatagcattgatcgactcggaccgatg

SEQ ID NO: 6983 - DNA, 203 bp, Homo sapiens
  source 1..203: mol_type = other DNA
ggcgcgccagtcctattaaccagcgtttatcatataaacatattgtttatgttggtgatccacaacaacttcctgcacctagagtaatgattactaaaggtgttatggagcctgttgattataacgttgttactcaacgtatgtgtgctataggccctgatgtttttcttcataaatgttatagatgtcgactcggaccgatg

SEQ ID NO: 6984 - DNA, 203 bp, Homo sapiens
  source 1..203: mol_type = other DNA
ggcgcgccagtcctaaccaccacacattctgtaacattcatagaaacgagcatgatgcctctggtgatgctgttatgacacgttgtttggcagtacatgattgttttgtcaaaaatgttgattggactgtaacgtacccctttattgcaaatgagaaatttatcaatggctgtgggcgtaatgtccagcgactcggaccgatg

SEQ ID NO: 6985 - DNA, 203 bp, Homo sapiens
  source 1..203: mol_type = other DNA
ggcgcgccagtcctggacatgttgttcgtgcagccttgaaattgtataaacctagtgttattcatgacattggtaatcctaaaggtgtacgttgtgctgttactgatgccaaatggtactgttatgacaagcaacctgttaatagtaatgtcaagttgttggattatgattatgcaacccatggtcaacgactcggaccgatg

SEQ ID NO: 6986 - DNA, 203 bp, Homo sapiens
  source 1..203: mol_type = other DNA
ggcgcgccagtccttttgttaaattaaaacctatgccctttttttactttgatgacagtgattgtgatgttgtgcaagaacaagttaattatgtaccccttcgcgctagtagttgtgttactcgttgtaatataggtggtgctgtttgttcaaaacatgcaaatttgtatcaaaaatatgttgaggcacgactcggaccgatg

SEQ ID NO: 6987 - DNA, 203 bp, Homo sapiens
  source 1..203: mol_type = other DNA
ggcgcgccagtcctcttattggtattaattatttaggtgactttattcaaggtccttttatagctggtaacactgttcatgctaattatatattttggcgtaattctactattatgtctttgtcatacaattcagttttagatttaagtaagtttgaatgtaaacataaagccactgttgttgttacacgactcggaccgatg

SEQ ID NO: 6988 - DNA, 203 bp, Homo sapiens
  source 1..203: mol_type = other DNA
ggcgcgccagtcctgtaatgctaatctctctatgttacaattaggtgttcctgacaattcttcaactattgttacgggtttattgccaactcattggttttgtgctaatcagagtacatctgtttactcagccaatggtttcttttatattgatgttggtaatcaccgtagtgcttttgcgctccatacgactcggaccgatg

SEQ ID NO: 6989 - DNA, 203 bp, Homo sapiens
  source 1..203: mol_type = other DNA
ggcgcgccagtcctccacacataatggccgtgtagttaactacactgtttgtgatgattgtaatggttatactgataacatattttctgttcaacaggatggccgcattcctaatggtttcccttttaataattggtttttgttaactaatggttccacactagtggacggggtctctagactttatccgactcggaccgatg

SEQ ID NO: 6990 - DNA, 203 bp, Homo sapiens
  source 1..203: mol_type = other DNA
ggcgcgccagtccttaccacccactgtgcgtgaaattgttgttgctagaactggccagttttatattaatggttttaagtatttcgatttgggtttcatagaagctgtcaattttaatgtcacgactgctagcgccacagatttttggacggttgcatttgctacttttgttgatgttttggttaatgcgactcggaccgatg

SEQ ID NO: 6991 - DNA, 203 bp, Homo sapiens
  source 1..203: mol_type = other DNA
ggcgcgccagtcctctgaaggtaattctattactggtgtaccttatcctgtctctggtattcgtgagtttagtaatttagttttaaataattgtaccaaatataatatttatgattatgttggtactggaattatacgttcttcaaaccagtcacttgctggtggtattacatatgtttctaactctgcgactcggaccgatg

SEQ ID NO: 6992 - DNA, 203 bp, Homo sapiens
  source 1..203: mol_type = other DNA
ggcgcgccagtcctttgactataagtcttgtactaaaggtctttctattgctgaccttgcttgtgctcagtactacaatggcataatggttttgccaggtgttgctgatgctgaacgtatggccatgtacacaggttctcttataggtggcatggtgctcggaggtcttacatcagcagccgccataccgactcggaccgatg

SEQ ID NO: 6993 - DNA, 203 bp, Homo sapiens
  source 1..203: mol_type = other DNA
ggcgcgccagtcctttactttgctttattcaaacctcttactgctagaggtcgtgttgcttgttttgttttaaaactattgacactatttgtctatgtgcctttattggttctttttggtatgtatcttgacagttttataattttttctacgctgttgtttcgattcatacatgttggctattatgccgactcggaccgatg

SEQ ID NO: 6994 - DNA, 203 bp, Homo sapiens
  source 1..203: mol_type = other DNA
ggcgcgccagtccttgacctttatgttgctattagaggttcttgtgaaaagaacctacaacttatgcgtaaggttgacttgtataatggtgctgtcatttacatttttgccgaagagcctgttgttggtatagtctactcttctcaactatacgaagatgttccttcgattaattgatgacaatggtacgactcggaccgatg

SEQ ID NO: 6995 - DNA, 203 bp, Homo sapiens
  source 1..203: mol_type = other DNA
ggcgcgccagtcctgggtcagttgcctaaatatgtaatagttgctacgcctagtaccacaattgtttgtgaccgtgttggtcgctctgttaatgaaacaagccagactggttgggcattctacgtccgtgctaaacatggtgatttttctggtgttgcctctcaggagggtgttttgtcagaaagagacgactcggaccgatg

SEQ ID NO: 6996 - DNA, 203 bp, Homo sapiens
  source 1..203: mol_type = other DNA
ggcgcgccagtcctgaagttgcttcatttaatctaaactaaacaaaatggctagtgtaaattgggccgatgacagagctgctaggaagaaatttcctcctccttcattttacatgcctcttttggttagttctgataaggcaccatatagggtcattcccaggaatcttgtccctattggtaagggtacgactcggaccgatg

SEQ ID NO: 6997 - DNA, 203 bp, Homo sapiens
  source 1..203: mol_type = other DNA
ggcgcgccagtcctaacccagggctgataagccttctcagttgaagaaacctcgttggaagcgtgttcctaccagagaggaaaatgttattcagtgctttggtcctcgtgattttaatcacaatatgggggattcagatcttgttcagaatggtgttgatgccaaaggttttccacagcttgctgaatcgactcggaccgatg

SEQ ID NO: 6998 - DNA, 203 bp, Homo sapiens
  source 1..203: mol_type = other DNA
ggcgcgccagtcctcgtttagcgcatgataagggtttagtcttacacacaatggtaggccagtgatagtaaagtgtaagtaatttgctatcatattaacatgtctagaggaaagtcagaactttttctgtttgtgttgttggagtacttaaagatcgcatacgcgcgccaacaatggaagagccaacacgactcggaccgatg

SEQ ID NO: 6999 - DNA, 203 bp, Homo sapiens
  source 1..203: mol_type = other DNA
ggcgcgccagtcctttcgaagatgaagctcctcttgctagcaaatttattttagacaattatggtctagtcaaagaaatgagatcaaagtttgcaaacaaacctctgaataaagaagtagttgcacacatgttagaaaaacaattcaatccggaaagtagattcttgcctgttttcggagctataaggcgactcggaccgatg

SEQ ID NO: 7000 - DNA, 203 bp, Homo sapiens
  source 1..203: mol_type = other DNA
ggcgcgccagtcctaaggtcttaccctttacttatttcgccccaaaacagggaatgtttgaaggaaggcttttctttagcaacgatagctttgttgagcctggagtaaataacaatgtattttcttggagtaaggctgacagttctaaaatatattgtcatggaatagcgataagggtacctttagttcgactcggaccgatg

SEQ ID NO: 7001 - DNA, 203 bp, Homo sapiens
  source 1..203: mol_type = other DNA
ggcgcgccagtcctctcaatgccaggatgaacagtgatcagtttgcagttaatataactggagacaatagtaaatggaatgaatgccaacaacctgaggcttatttagcacttttggcttacatcaccaaagactcctctgatttaatgaaagacttatgcagtgttgctccagtgcttttctgtaatcgactcggaccgatg

SEQ ID NO: 7002 - DNA, 203 bp, Homo sapiens
  source 1..203: mol_type = other DNA
ggcgcgccagtcctataaaaaccatagaaaataaagatggattattaattgctgatggtgggaaactgatgaacaacattagcacccttcatattcctgaggaagtactgaagtttgaaaaaatggatgaacaatatagaaatagggtattcaaccccaaaaatccctttactaactttgacaaaactcgactcggaccgatg

SEQ ID NO: 7003 - DNA, 203 bp, Homo sapiens
  source 1..203: mol_type = other DNA
ggcgcgccagtcctattgatatatttagagcacatggcccaataagggttgaagaaaatgaagcagtagtttcaactcatagcttcagaactagagcaaacagaaccctattgaatacagatatgagagcaatgatggcagaagagaaaagatatcaaatggtttgcgacatgtttaaaagcgtgtttcgactcggaccgatg

SEQ ID NO: 7004 - DNA, 203 bp, Homo sapiens
  source 1..203: mol_type = other DNA
ggcgcgccagtcctgatagatttgtgctcattgaaggaagaaaaagaggaactgcagtgtctttacaaaatgagctatgtaaaagttatgatcttgaaccactaccttttctttgtgacatttttgacagggaggaaaaacaattcgttgaaattggaataacaagaaaagcagatgatagctattttcgactcggaccgatg

SEQ ID NO: 7005 - DNA, 203 bp, Homo sapiens
  source 1..203: mol_type = other DNA
ggcgcgccagtcctaatattaaattaccaataaaacattatgagcagaataaatttcgacaaatacgtctaccaaagggaccaatggcaccctatacccacaagttcttaatggaagaagcatggatgtttacaaaaattagtgatccagaaagatcaagagctggtgaaattctcattgatttcttccgactcggaccgatg

SEQ ID NO: 7006 - DNA, 203 bp, Homo sapiens
  source 1..203: mol_type = other DNA
ggcgcgccagtcctactgtatttgaagcaggacacacaacagttagaatgaagaaaggagagtcagttattggaagagaagtccctctttatttatactgtaggacaactgccctttccaaaatcaagaatgactggctatcaaaggctagaagatgtttcatcacaactatggacacagtggaaacccgactcggaccgatg

SEQ ID NO: 7007 - DNA, 203 bp, Homo sapiens
  source 1..203: mol_type = other DNA
ggcgcgccagtcctactccagggtgcatgttgatccaaaagcaaaagccatacattggagaagctgatgatcaccatggagatcaagaaatgagggagttgctgtcaggactggactatgaagctagatgcatatcacaatcagggtgggtgaatgaaaccagcccttttacggaagaatacctccttcgactcggaccgatg

SEQ ID NO: 7008 - DNA, 203 bp, Homo sapiens
  source 1..203: mol_type = other DNA
ggcgcgccagtcctccaggttgctgggtaattgacaataacatttgtgatcaaagttgtcaaaactttattttcaagttcaacgaaactgcacctgttccaaccattccccctcttgacacaaaaattgatctgcaatcagatcctttttactggggaagcagcttgggcttagcaataactgctgctcgactcggaccgatg

SEQ ID NO: 7009 - DNA, 203 bp, Homo sapiens
  source 1..203: mol_type = other DNA
ggcgcgccagtcctattttcaagttcaacgaaactgcacctgttccaaccattccccctcttgacacaaaaattgatctgcaatcagatcctttttactggggaagcagcttgggcttagcaataactgctgctatttcattggcagctttggtgatctctgggatcgccatctgcagaactaaatgacgactcggaccgatg

SEQ ID NO: 7010 - DNA, 203 bp, Homo sapiens
  source 1..203: mol_type = other DNA
ggcgcgccagtccttgccttggtgtatgtggttggctgccagacttactctgaaagatgagtttgccaatttctgtgcatatgcaggaagaagagcctttgaagtcttcaatattgcaatggagaaaattggaatttgttcctttcaagggacaataatgaacgatgatgaaattgaatcaatagaggcgactcggaccgatg

SEQ ID NO: 7011 - DNA, 203 bp, Homo sapiens
  source 1..203: mol_type = other DNA
ggcgcgccagtcctgggcagagtttgctcaaagatttgctcttcaggcaaatacttcaagagaaggcgctcaaatcagcaattcagcagtttttgcagtggaaaggaagataaccacagatgtccaaagagttgaagagctactaaataaagttcaagctcatgaagatgaaccattacaaacactttcgactcggaccgatg

SEQ ID NO: 7012 - DNA, 203 bp, Homo sapiens
  source 1..203: mol_type = other DNA
ggcgcgccagtcctgcctctttgggattagggataattactatgttgtatttattagtaaaaatcataattgaacttgtcaatggttttgtgctcggcagatgggagagatggtgtggagatataaagaccacaattatgcctgaaattgactcgatggaaaaagatattgccctttctagggagagacgactcggaccgatg

SEQ ID NO: 7013 - DNA, 203 bp, Homo sapiens
  source 1..203: mol_type = other DNA
ggcgcgccagtcctttcccatcgctttggagcattactcacaatgttttcgctaccatcagccacaatgctcaatcatgtcaaattagctgaccagtcaccagaagctgatatcgaaagggtagagatcgatggctttgaggagggatcattccgcttaatccccaatgcacgttcaggtatgagccgcgactcggaccgatg

SEQ ID NO: 7014 - DNA, 203 bp, Homo sapiens
  source 1..203: mol_type = other DNA
ggcgcgccagtcctgactgcgccagaccaacctgctgcttctattgagaaacgcctgcaaaaatatcgtcagcaaggcaggatcaacccgagatatctcctgcaaccggaggctcgacgaataatccagaatgtaatccggaagggaatggtggtcagacatttcctcacctttgaactgcagcttgccgactcggaccgatg

SEQ ID NO: 7015 - DNA, 203 bp, Homo sapiens
  source 1..203: mol_type = other DNA
ggcgcgccagtcctcctcatggcattataccagacccttggtgagcaggcccgatatttggccctattggagtcaccacatttgatggattttgctgcagcaaactacccactgctatatagctatgctatgggaataggctatgtgttagatgtcaacatgaggaactacgctttctccagatcatacgactcggaccgatg

SEQ ID NO: 7016 - DNA, 203 bp, Homo sapiens
  source 1..203: mol_type = other DNA
ggcgcgccagtcctcaacccgttctcatctgtcactgggacaactcaggtgcccgctgcagcaacaggtgacacactcgagagttacatggcagcggatcgactgaggcagagatatgctgatgcaggcacccatgatgatgagatgccaccattggaagaggaggaagaggacgacacatctgcaggcgactcggaccgatg

SEQ ID NO: 7017 - DNA, 203 bp, Homo sapiens
  source 1..203: mol_type = other DNA
ggcgcgccagtcctaaatctgatgacacggttcatcgaggaacccagagagaatcctatcgcaaccagttcccccatcgattttaagaggggcagggataccggcgggttccatagaagggagtactcaatcggatgggtgggagatgaagtcaaggtcactgagtggtgcaatccatcctgttctcccgactcggaccgatg

SEQ ID NO: 7018 - DNA, 203 bp, Homo sapiens
  source 1..203: mol_type = other DNA
ggcgcgccagtcctaatcaccgctgcagcaaggcgatttgaatgcacttgtcaccagtgtccagtcacttgctctgaatgtgaacgagatacttaatacagtgagaaatttggactctcggatgaatcaactggagacaaaagtagatcgcattctctcatctcagtctctaatccagaccatcaagacgactcggaccgatg

SEQ ID NO: 7019 - DNA, 203 bp, Homo sapiens
  source 1..203: mol_type = other DNA
ggcgcgccagtcctatgacatagttggacttaaagcagggatggctactttagaaggaatgattacaactgtgaaaatcatggacccgggagttcccagtaatgttactgtggaagatgtacgcaagacactaagtaaccatgctgttgttgtgccagaatcattcaatgatagtttcttgactcaatcgactcggaccgatg

SEQ ID NO: 7020 - DNA, 203 bp, Homo sapiens
  source 1..203: mol_type = other DNA
ggcgcgccagtccttcaaccaggcttccagtgaggctcagctaattgacctcaagaaagcaatcatccgcagtgcaatttgatcaagaaacacccaattacactacactggtatgacactgtactaaccctgagggttttagaaaaaacgattaacgataaataagcccgaacactacacactacctgcgactcggaccgatg

SEQ ID NO: 7021 - DNA, 203 bp, Homo sapiens
  source 1..203: mol_type = other DNA
ggcgcgccagtcctaggcagccatgccatccatcagcattcccgcagaccccaccaatccacgtcaatcaataaaagcgttcccaattgtgatcaacagtgatgggggtgagaaaggccgcttggttaaacaactacgcacaacctacttgaatgacctagatactcatgagccactggtgacattcacgactcggaccgatg

SEQ ID NO: 7022 - DNA, 203 bp, Homo sapiens
  source 1..203: mol_type = other DNA
ggcgcgccagtcctttaggaagacatccagcaaagcggaagagatggtctttgaaattgttaagtatccgagaatatttcggggtcatacattaatccagaaaggactagtctgtgtctccgcagaaaaatttgttaagtcaccagggaaaatacaatctggaatggactatctcttcattccgacatcgactcggaccgatg

SEQ ID NO: 7023 - DNA, 203 bp, Homo sapiens
  source 1..203: mol_type = other DNA
ggcgcgccagtcctaaatcatgggtactataattcaatttctggtggtctcctgtctattggcaggagcaggcagccttgatccagcagccctcatgcaaatcggtgtcattccaacaaatgtccggcaacttatgtattatactgaggcctcatcagcattcattgttgtgaagttaatgcctacaacgactcggaccgatg

SEQ ID NO: 7024 - DNA, 203 bp, Homo sapiens
  source 1..203: mol_type = other DNA
ggcgcgccagtccttggccaccatttctgcattcattaacaatcaagaagtcatggcccaattaccaacacgtgttatggtgactggcagcttgatccaagcctatcccgcatcgcaatgcaccattacacccaacactgtgtactgtaggtataatgatgcccaagtactctcagatgatactatggcgactcggaccgatg

SEQ ID NO: 7025 - DNA, 203 bp, Homo sapiens
  source 1..203: mol_type = other DNA
ggcgcgccagtcctcttgcctccaaggtaacttgacaagatgcaccttctctccagtggttgggagctttctcactcgattcgtgctgttcgatggaatagtttatgcaaattgcaggtcgatgttgtgcaagtgcatgcaacctgctgctgtgatcctacagccgagttcatcccctgtaactgtcacgactcggaccgatg

SEQ ID NO: 7026 - DNA, 203 bp, Homo sapiens
  source 1..203: mol_type = other DNA
ggcgcgccagtcctgaatggagaattttgtttatcataaataagcattccaccactcacgatctgatctcagtgagaaaaatcaacctgcaactcttggaacaagataagacagtcatccattagtaatttttaagaaaaaaacgataggaccgaacctagtattgaaagaaccgtctcggtcaatctcgactcggaccgatg

SEQ ID NO: 7027 - DNA, 203 bp, Homo sapiens
  source 1..203: mol_type = other DNA
ggcgcgccagtcctcatcaatcagttctatttttcaattgctgagggtcgcaatctgacacttggcccacttcttaatatgcctagtttcattccaactgccacgacaccagagggctgcaccaggatcccatcattctcgctcactaagacacactggtgttatacacacaatgttatcctgaatggcgactcggaccgatg

SEQ ID NO: 7028 - DNA, 203 bp, Homo sapiens
  source 1..203: mol_type = other DNA
ggcgcgccagtcctttctactcaaccagagagggatgactacttttctgccgctcctccagaacaacgaattattataatgtactataatgatacaatcgtggagcgcataattaatccacccggggtactagatgtatgggcaacattgaacccaggaacaggaagcggggtatattatttaggttgcgactcggaccgatg

SEQ ID NO: 7029 - DNA, 203 bp, Homo sapiens
  source 1..203: mol_type = other DNA
ggcgcgccagtccttcagtctgggatcctggcatgtcctcttcgacaggatctaaccaatgagtgtttagttctgcccttttctaatgatcaggtgcttatgggtgctgaagggagattatacatgtatggtgactcggtgtattactatcaaagaagcaatagttggtggcctatgaccatgctgtacgactcggaccgatg

SEQ ID NO: 7030 - DNA, 203 bp, Homo sapiens
  source 1..203: mol_type = other DNA
ggcgcgccagtccttaccagtacatttggatcagaagcaaccttcactggttcttatctcaacacagcaactcagcgtatcaatccgacgatgtatatcgcgaacaacacacagatcataagctcacagcaatttggatcaagcggtcaagaagcagcatatggccacacaacctgttttagggacaccgactcggaccgatg

SEQ ID NO: 7031 - DNA, 203 bp, Homo sapiens
  source 1..203: mol_type = other DNA
ggcgcgccagtcctaggctctgttatggtatactgtatctatattattgaattgtcctcatctctcttaggacaatttcagattgtcccatttatccgtcaggtgacactatcctaaaggcagaagccttcaggtctgacccagccaatcaaagcattataccagaccatggaatgcataccaaacatcgactcggaccgatg

SEQ ID NO: 7032 - DNA, 203 bp, Homo sapiens
  source 1..203: mol_type = other DNA
ggcgcgccagtccttgaccgcagggatattgatcttaagacagttgtggcagcatggcatgactcagactggaaaagaataagtgatttttggattatgatcaaattccagatgagacaattaattgttaggcaaacagatcataatgattctgatttaatcacgtatatcgaaaatagagaaggcatcgactcggaccgatg

SEQ ID NO: 7033 - DNA, 203 bp, Homo sapiens
  source 1..203: mol_type = other DNA
ggcgcgccagtcctaatcatcataacccctgaactggtagcattatttaacactgagaatcatacactaacatacatgacctttgaaattgtactgatggtttcagatatgtacgaaggtcgtcacaacattttatcactatgcacagttagcacttacctgaatcctctgaagaaaagaataacatacgactcggaccgatg

SEQ ID NO: 7034 - DNA, 203 bp, Homo sapiens
  source 1..203: mol_type = other DNA
ggcgcgccagtcctaactaatagtttcacccaggatgaattaagaactgtgacaactaatttgatatccccattccaagatctgaccccagatcttacggctgaattgctctgtataatgaggctttggggacaccccatgctcactgccagtcaagctgcaggaaaggtacgcgagtctatgtgtgccgactcggaccgatg

SEQ ID NO: 7035 - DNA, 203 bp, Homo sapiens
  source 1..203: mol_type = other DNA
ggcgcgccagtcctattcacacttaagcattggaaggaagtctctcttataaaattcaagaaatgttttgatgcagacgcaggtgaggaactcagtatatttatgaaagataaggcaattagtgccccaaaacaagactggatgagtgtgtttagaagaagcctaatcaaacagcgccatcagcatcacgactcggaccgatg

SEQ ID NO: 7036 - DNA, 203 bp, Homo sapiens
  source 1..203: mol_type = other DNA
ggcgcgccagtcctattaattaaatcaggatgtatggattactggatcctttataacttattagggagaaaaccgggaaacggctcatgggctactttagcagctgacccgtactcaatcaatatagagtatcaataccctccaactacagctcttaagaggcacacccaacaagctctgatggaactcgactcggaccgatg

SEQ ID NO: 7037 - DNA, 203 bp, Homo sapiens
  source 1..203: mol_type = other DNA
ggcgcgccagtccttagatcgataatgaggaaatcactagaaattaagcccttatccaataggaagcttaatgaaatactggattacaacatcaattacctagcttacaatttggcattactcaagaatgctattgaacctccgacttatttgaaggcaatgacacttgaaacatgtagcatcgacatcgactcggaccgatg

SEQ ID NO: 7038 - DNA, 203 bp, Homo sapiens
  source 1..203: mol_type = other DNA
ggcgcgccagtccttggtatcgagataggaggggatccccgtgataatcctcctatccgtgtaccgtacattggctccaggactgatgagaggagggtagcctcaatggcatacatcaggggtgcctcgagtagcttaaaagcagttcttagactggcgggagtgtacatctgggcattcggagataccgactcggaccgatg

SEQ ID NO: 7039 - DNA, 203 bp, Homo sapiens
  source 1..203: mol_type = other DNA
ggcgcgccagtccttctggagaattggatagatgcactggatttgtctcacactagagttaacatcacacttgaacagctgcaatccctcaccccacttccaacctctgccaatctaacccatcggttggatgatggcacaactaccctaaagtttactcctgcgagctcttacaccttttcaagtttcgactcggaccgatg

SEQ ID NO: 7040 - DNA, 203 bp, Homo sapiens
  source 1..203: mol_type = other DNA
ggcgcgccagtccttatgtattgtgggtgggaactactattggaactatcctatcaaatgtattatctgagggtagttgggtggagtaatatagtggattattcttacatgatcttgagaagaatcccgggtgcagcattaaacaatctggcatctacattaagtcatccaaaacttttccgacgagccgactcggaccgatg

SEQ ID NO: 7041 - DNA, 203 bp, Homo sapiens
  source 1..203: mol_type = other DNA
ggcgcgccagtccttatcaacctagatatagttgcccccttaaatgctcctcattttgcatctctggactacatcaagatgagtgtggatgcaatactctggggctgtaaaagagtcatcaatgtgctctccaatggaggggacttagaattagttgtgacatctgaagatagccttattctcagtgacgactcggaccgatg

SEQ ID NO: 7042 - DNA, 203 bp, Homo sapiens
  source 1..203: mol_type = other DNA
ggcgcgccagtcctgttgtcatcaactgcttggtataagggtataagctgctgcaggtaccttgagcgattaaagctaccacaaggtgatcatttatatattgcagaaggtagtggtgccagtatgacaatcatagaatacctattcccaggaagaaagatatattacaattctttatttagtagtggcgactcggaccgatg

SEQ ID NO: 7043 - DNA, 203 bp, Homo sapiens
  source 1..203: mol_type = other DNA
ggcgcgccagtcctattcatcatcaatcgagtcggcccaaggacttgcagtttagtacatgtagatttggaatcaagtgcaagcttaaatcaacaatgcctgtcaaagccgataattaatgctatcatcactgctacaactgttttgtgccctcatggggtgcttattctgaaatatagttggttgcccgactcggaccgatg

SEQ ID NO: 7044 - DNA, 203 bp, Homo sapiens
  source 1..203: mol_type = other DNA
ggcgcgccagtccttgcacggaatctcatcgatatcgagccagtcgcaactttcatagaatttgaacaattgatctgcacaatgttgacaacccacttgaaggaaataattgatataacaaggtctggaacccaggattatgaaagtttattactcactccttacaatttaggtcttcttggtaaaatcgactcggaccgatg

SEQ ID NO: 7045 - DNA, 203 bp, Homo sapiens
  source 1..203: mol_type = other DNA
ggcgcgccagtccttgttgcaaaggtatgtgggtcgtattgctttgccttttcctaacctggctcctcctacaattctaacctgcttgataagtgtgattacctgagtaatagactaatttcgtcctggtaattagcattttctagtaaaaccaatactatctcaagtcctaagagaaggtgagaagacgactcggaccgatg

SEQ ID NO: 7046 - DNA, 203 bp, Homo sapiens
  source 1..203: mol_type = other DNA
ggcgcgccagtccttgaagaggagacaacagaagctaatgctggtcagtttttatcctttgccagtttgtttctacccaaacttgtcgttggggagaaagcgtgtctggaaaaagtacaaaggcagattcaggtccatgcagaacaagggctcattcaatatccaacttcctggcaatcagttggacacgactcggaccgatg

SEQ ID NO: 7047 - DNA, 203 bp, Homo sapiens
  source 1..203: mol_type = other DNA
ggcgcgccagtcctcatgatggtgatcttccgtttgatgagaacaaactttttaatcaagttcctactaatacatcaggggatgcacatggtcgcaggccatgatgcgaatgacacagtaatatctaattctgttgcccaagcaaggttctctggtcttctgattgtaaagactgttctggaccacatcgactcggaccgatg

SEQ ID NO: 7048 - DNA, 203 bp, Homo sapiens
  source 1..203: mol_type = other DNA
ggcgcgccagtcctttatccacaactctcagccattgctttgggtgttgcaactgcccacgggagcacgctggctggtgttaatgtaggggagcaatatcagcaactgcgtgaggctgctactgaagctgaaaagcaactccaacaatatgctgaaacacgtgagttggacaaccttgggcttgatgacgactcggaccgatg

SEQ ID NO: 7049 - DNA, 203 bp, Homo sapiens
  source 1..203: mol_type = other DNA
ggcgcgccagtcctatttcccgggccgatctatgatgaaacccaccccaacccttctgatgataatcctgatgattcacgtgatacaactatcccaggtggtgttgttgacccgtatgatgatgagagtaataattatcctgactacgaggattcggctgaaggcaccacaggagatcttgatctcttcgactcggaccgatg

SEQ ID NO: 7050 - DNA, 203 bp, Homo sapiens
  source 1..203: mol_type = other DNA
ggcgcgccagtcctcaatttggacgacgacgatgacgacagccaaccaggaccaccagacagggggcagagcaaggaaagagcggctcggacacatggcctccaagatccgaccttggacggagcgaaaaaggtgccggagttgaccccaggttcccaccaaccaggcaacctccacatcaccaagcccgactcggaccgatg

SEQ ID NO: 7051 - DNA, 203 bp, Homo sapiens
  source 1..203: mol_type = other DNA
ggcgcgccagtcctgggttcaaacaccaaccaaccacaaggcaatatgtcatctactctccagagtatgacccctatacaggaagaatcagagcccgatgatcagaaagatgatgatgacgagagtctcacatcccttgactctgaaggtgacgaagatgttgagagcgtatcaggggagaacaaccccgactcggaccgatg

SEQ ID NO: 7052 - DNA, 203 bp, Homo sapiens
  source 1..203: mol_type = other DNA
ggcgcgccagtccttccatttgaggcaatcaattattatcacctaatgagtgatgagcccattgcttttagcactgaaagtggcaaggaatatatcttcccagattctcttgaagaagcctacccgccttggttgagtgagaaggaggccttagagaaagaaaatcgttatctggtcattgatggccacgactcggaccgatg

SEQ ID NO: 7053 - DNA, 203 bp, Homo sapiens
  source 1..203: mol_type = other DNA
ggcgcgccagtccttggtgcaggttatctgcaaaattggtaaggataataatatcctagacataattcatgcagaattccaagcaagcttggctgagggagactccccccagtgtgcattaatccagataacaaaacggatccctgctttccaagatgcctctcctccaattgtgcatatcaagtctccgactcggaccgatg

SEQ ID NO: 7054 - DNA, 203 bp, Homo sapiens
  source 1..203: mol_type = other DNA
ggcgcgccagtcctgtcaaggaactctcactgatcaagcctgaatccaagatagaaccagcccaaagggcctccccagagtctcttacaagcttagccaatcaattaacatgcataagcgatccatacttcgcccaatcagtgtccgatgttcaccccttcaagcctccttcctagcaaattgacctacgactcggaccgatg

SEQ ID NO: 7055 - DNA, 203 bp, Homo sapiens
  source 1..203: mol_type = other DNA
ggcgcgccagtcctatctttttaccataatcttgttctcagtaccatttgataagggtacacttgccaatacgcccccatcctaagggtctcgcaatggggggtcttagcctactccaattgcccagggacaaatttcggaaaagctctttctttgtttgggtcatcatcttattccaaaaggcctttcgactcggaccgatg

SEQ ID NO: 7056 - DNA, 203 bp, Homo sapiens
  source 1..203: mol_type = other DNA
ggcgcgccagtccttctggtgttcctcccaaggtggtcagctatgaagcgggagaatgggctgaaaattgctacaatcttgaaataaagaagccggacgggagcgaatgcttacccccaccgccagatggtgtcagaggctttccaaggtgccgctatgttcacaaagcccaaggaaccgggccctgccgactcggaccgatg

SEQ ID NO: 7057 - DNA, 203 bp, Homo sapiens
  source 1..203: mol_type = other DNA
ggcgcgccagtcctcatcgtcgagaattacaaagggaagaatctccgaccgggccaccaggaagtattcggacctggttccaaagaattcccctgggatggttccattgcacataccagaaggggaaacaacattgccgtctcagaattcgacagaaggtcgaagagtaggtgtgaacactcaggagacgactcggaccgatg

SEQ ID NO: 7058 - DNA, 203 bp, Homo sapiens
  source 1..203: mol_type = other DNA
ggcgcgccagtcctccattacagagacagctgcaacaattataggcactaacggcaaccatatgcagatctccaccatcgggataagaccgagctccagccaaatcccgagttcctcaccgaccacggcaccaagccctgaggctcagacccccacaacccacacatcaggtccatcagtgatggccacgactcggaccgatg

SEQ ID NO: 7059 - DNA, 203 bp, Homo sapiens
  source 1..203: mol_type = other DNA
ggcgcgccagtcctccgaggaaccaacaacaccaccgggaagctcccccggcccaacaacagaagcacccactctcaccaccccagaaaatataacaacagcggttaaaactgtcctgccacaggagtccacaagcaacggtctaataacttcaacagtaacagggattcttgggagtcttgggcttccgactcggaccgatg

SEQ ID NO: 7060 - DNA, 203 bp, Homo sapiens
  source 1..203: mol_type = other DNA
ggcgcgccagtcctgaaaacgcagcagaagacaaactaacaccaaagccacgggtaagtgcaatcccaacttacactactggactgcacaagaacaacataatgctgctgggattgcctggatcccgtactttggaccgggtgcggaaggcatatacactgaaggcctgatgcataaccaaaatgcctcgactcggaccgatg

SEQ ID NO: 7061 - DNA, 203 bp, Homo sapiens
  source 1..203: mol_type = other DNA
ggcgcgccagtccttactctttctcaatactatataagttccttcccaagaataatattgatgaagattaagaaaaagtgacattgtgcccacttttgtaatcttcatccacctacacattcatattcaggaatctttgaattaaccctcacacttgcttaggaaagagcctatcctctacaagaatccgactcggaccgatg

SEQ ID NO: 7062 - DNA, 203 bp, Homo sapiens
  source 1..203: mol_type = other DNA
ggcgcgccagtcctacgcttacttgcccccccaagcgttaatgaagggctccctcctgcaccaggggaatatacttggtcagaagatagtacaacttagcctgtagggaggacaagtaaaacaagatgcccttatcctctatagatggtatttttagagagggggacaggataggaataaagataatgcgactcggaccgatg

SEQ ID NO: 7063 - DNA, 203 bp, Homo sapiens
  source 1..203: mol_type = other DNA
ggcgcgccagtccttagtatagtcttaggtatagggtagtcctacacgtactatattatacagtctaaacttgtaaaattaaactacaagaacatgatgaaaattaatgagaaggttccaagattgacttcaatccaaacaccttgctctgccaattttcatctccttaagatatatgattttgttcccgactcggaccgatg

SEQ ID NO: 7064 - DNA, 203 bp, Homo sapiens
  source 1..203: mol_type = other DNA
ggcgcgccagtcctacaagcctaagattccattagagataaccagaatggctaaagccacaggccggtacaacttggtaacaccaaaacgggagctagagcaaggagttgtgtttagcgacctatgcaacttcctagtgactccaactgtgcaaggatggaaggtttactgggctggacttgagtttgcgactcggaccgatg

SEQ ID NO: 7065 - DNA, 203 bp, Homo sapiens
  source 1..203: mol_type = other DNA
ggcgcgccagtcctctggggaggcaatccttgccaccataggactttttcaattcctctattttatgatggctacccaacatacacaatatcctgatgcaagattgtcttccccaattgtcttagaccaatgtgacctagtgacaagagcatgtggactttactctgagtattcgctgaaccctaaaccgactcggaccgatg

SEQ ID NO: 7066 - DNA, 203 bp, Homo sapiens
  source 1..203: mol_type = other DNA
ggcgcgccagtcctatgccacagttcgtggaagtagttttgtcacagacctggaaaaatacaatctggccttcaggtatgaattcacagctcccttcatcaaatattgcaaccaatgctatggggttcgcaatgtctttgattggatgcacttcctaattccgcaatgttacatgcatgttagtgattcgactcggaccgatg

SEQ ID NO: 7067 - DNA, 203 bp, Homo sapiens
  source 1..203: mol_type = other DNA
ggcgcgccagtcctatattttaccatgccgtgttgcagctgcctttcatacatatttctctgttcggatcttacaacatcatcaccttggtttccataagggttcagaccttggacaattggcaatcaataaacctcttgatttcgggaccattgcactatccttagcagttcctcaggtattgggtgcgactcggaccgatg

SEQ ID NO: 7068 - DNA, 203 bp, Homo sapiens
  source 1..203: mol_type = other DNA
ggcgcgccagtcctcaggcgggttaaatgtccctggatcacaggatttaacatctttccttcgtcagattgtcagaaggagtatcacactttcggcaaggaacaagttaatcaacacgttatttcacgcttctgcagatcttgaagacgaattagtatgtaaatggttactttcttcaacgcccgtgacgactcggaccgatg

SEQ ID NO: 7069 - DNA, 203 bp, Homo sapiens
  source 1..203: mol_type = other DNA
ggcgcgccagtcctggtttagttacctagaccattgtgacccagctttaatggaagcaattcaaccaattaagtgtactgttgatattgctcaaattcttagagaatactcctgggctcatatccttgatggtagacagttaataggggcaacactgccatgtatacctgagcagttccaaaccacatcgactcggaccgatg

SEQ ID NO: 7070 - DNA, 203 bp, Homo sapiens
  source 1..203: mol_type = other DNA
ggcgcgccagtcctggttaaaaccttacgagcaatgtgtggaatgttcatccacaaacaattctagtccatatgtatcagttgcattaaaaaggaacgtggttagtgcttggcctgatgcatctagattggggtggacgattggtgatgggattccctacataggctcaagaactgaggacaaaatagcgactcggaccgatg

SEQ ID NO: 7071 - DNA, 203 bp, Homo sapiens
  source 1..203: mol_type = other DNA
ggcgcgccagtcctatgaactgatttatgattcagatccactaagaggaggtctcaactgcaacttatcgattgacagtcctttgatgaagggcccacgtttaaatattattgaggatgacttaatacggttgccacatttatccggctgggaattagcaaaaacagtcttgcaatcaataatctctgcgactcggaccgatg

SEQ ID NO: 7072 - DNA, 203 bp, Homo sapiens
  source 1..203: mol_type = other DNA
ggcgcgccagtcctaaacccaggcaaactgtctccatgtcgtacaatgtgctcttcaacagcaagtacaaagagggtcatattggctaagtcatcttaccaaatacaccacaagtagattgcacaatagttatattgcatttggttttccttcattagagaaggtcctatatcataggtataaccttgcgactcggaccgatg

SEQ ID NO: 7073 - DNA, 203 bp, Homo sapiens
  source 1..203: mol_type = other DNA
ggcgcgccagtcctgtttattgactcttccaatacacagagttggaagcaccgattcaaggtttctaagacgccctatcgattatgttgataatgtaaataatagcttttcctgtctattatgacttaaataatcatatctataacgaccatcacagctaagtcgttgccctagttcatatattaaatcgactcggaccgatg

SEQ ID NO: 7074 - DNA, 203 bp, Homo sapiens
  source 1..203: mol_type = other DNA
ggcgcgccagtcctctagtgggagtgaagagggtagtcatgggcttgttggatggaagaggaccagtgcgattcgtgctggccttgatgacattcttcaagttcaccgcgcttgccccgacgaaggccttgctaggccgttggaagcgcatcaacaagaccacggcaatgaaacacctgactagcttccgactcggaccgatg

SEQ ID NO: 7075 - DNA, 203 bp, Homo sapiens
  source 1..203: mol_type = other DNA
ggcgcgccagtcctaaaaaggaattaggaacaatgatcaacgtggttaacaatcggggcacaaaaaagaagagaggcaacaatggaccaggactagtgatgatcataacactcatgacggttgtttcaatggtttcctctttaaagctttccaacttccaggggaaagtcatgatgaccatcaacgcgcgactcggaccgatg

SEQ ID NO: 7076 - DNA, 203 bp, Homo sapiens
  source 1..203: mol_type = other DNA
ggcgcgccagtcctgggtatgcttttgtagctgtcctcttgggctggatgctgggaagcaacaatggacaaagggtcgttttcgtcgttctcttacttcttgtggcgcctgcttatagcttcaactgccttggtatgagcaacagagacttccttgagggagtctctggtgctacctgggttgacgtgcgactcggaccgatg

SEQ ID NO: 7077 - DNA, 203 bp, Homo sapiens
  source 1..203: mol_type = other DNA
ggcgcgccagtcctgttttggaaggtgacagctgcataaccatcatggccaaggacaagccgaccattgacattaagatgatggaaactgaagccacgaacctggctgaagtgagaagctactgctatctagccactgtctcagatgtttcaactgtctccaactgtccaacaactggggaggcccaccgactcggaccgatg

SEQ ID NO: 7078 - DNA, 203 bp, Homo sapiens
  source 1..203: mol_type = other DNA
ggcgcgccagtcctaccgaggcatactacatcatgtcagtgggcaccaaacacttccttgtccatagagaatggtttaatgacttggccctcccatggacttcaccagctagctcaaattggagaaatagagagatactactagagttcgaagagccccatgccacaaagcaatcagttgtggcgcttcgactcggaccgatg

SEQ ID NO: 7079 - DNA, 203 bp, Homo sapiens
  source 1..203: mol_type = other DNA
ggcgcgccagtcctggttcccaggaaggtgctttgcaccaggccttggcaggagctgttccagtgtctttctcgggcagtgtcaagctcacatctggtcatctcaagtgtcgagtcaagatggaaaagttgacactaaaaggcaccacctacggcatgtgcacggaaaagttttcttttgcaaaaaatcgactcggaccgatg

SEQ ID NO: 7080 - DNA, 203 bp, Homo sapiens
  source 1..203: mol_type = other DNA
ggcgcgccagtcctccggctgacacgggtcacggcactgtggtccttgaactgcagtacacgggatctgacggaccttgcaaaatcccaatttccattgtggcatcactttccgatctcacccccattggtagaatggttacagcaaacccttatgtggcttcatccgaagccaacgcgaaagtgttgcgactcggaccgatg

SEQ ID NO: 7081 - DNA, 203 bp, Homo sapiens
  source 1..203: mol_type = other DNA
ggcgcgccagtcctgtcggagggattttcaattctgtaggaaaggcggtacatcaggtctttggaggagccttcagaactctcttcggtggcatgtcctggatcacccagggtctaatgggagctctgcttctatggatgggggtgaatgcgagagatcgatccatcgcactggtgatgttagccacgcgactcggaccgatg

SEQ ID NO: 7082 - DNA, 203 bp, Homo sapiens
  source 1..203: mol_type = other DNA
ggcgcgccagtcctatcgagcaagcccacgcgaaaggaatatgtggattgaggtccgtctcacgtctggaacacgtgatgtgggagaacatcagagatgaactcaacaccctcctcagagagaatgcagtagatctaagtgtcgtggttgagaagccaaaaggaatgtacaaatcagcaccacagagacgactcggaccgatg

SEQ ID NO: 7083 - DNA, 203 bp, Homo sapiens
  source 1..203: mol_type = other DNA
ggcgcgccagtcctatcatgtccaccagggtttggctgaaagtcagagaacacaacactactgactgcgacagctcaataattgggacggctgttaaaggagacatagctgtgcacagtgacctctcctactggattgaaagccacaagaacacgacatggaggctcgagagggctgtctttggagagcgactcggaccgatg

SEQ ID NO: 7084 - DNA, 203 bp, Homo sapiens
  source 1..203: mol_type = other DNA
ggcgcgccagtcctagacccatgaaacatgatgagacgacgctggtaaaatccagcgtcagtgcccatcggagtgacatgattgatccttttcagttgggccttctggtgatgtttctggccacccaggaggtcctgaggaagaggtggacggccagattgactgttccggctattgtgggagctctacgactcggaccgatg

SEQ ID NO: 7085 - DNA, 203 bp, Homo sapiens
  source 1..203: mol_type = other DNA
ggcgcgccagtcctacgaaccaagagaacatcctgctggctctgggggcagcattctttcagatggcggccaccgatttgaacttttctctcccaggaattctcaatgccactgccacagcttggatgctcctgagggctgccacccagccatccacttcagccatcgtcatgcctttgctttgcctgcgactcggaccgatg

SEQ ID NO: 7086 - DNA, 203 bp, Homo sapiens
  source 1..203: mol_type = other DNA
ggcgcgccagtcctctggctcctggcatgagactgctctacctggacacgtatagaatcactctcatcatcatcggcatctgcagcctgataggggagcgccgtagggcggccgcaaagaagaaaggggcggtactgctagggttagcactaacatcaacagggcagttctctgcatcagttatggcgcgactcggaccgatg

SEQ ID NO: 7087 - DNA, 203 bp, Homo sapiens
  source 1..203: mol_type = other DNA
ggcgcgccagtcctgggacctaccaggctggagtgggcgtcatgtatgaaggagttcttcacaccctgtggcacaccacaagaggggcagctatcagaagtggtgaaggaaggctcactccctactggggtagtgtgaaagaagacaggatcacctatggtgggccatggaagtttgacaggaagtggcgactcggaccgatg

SEQ ID NO: 7088 - DNA, 203 bp, Homo sapiens
  source 1..203: mol_type = other DNA
ggcgcgccagtcctaatggtctcgatgatgttcagctcatcatagtggctcccggaaaggcagccataaacatccaaaccaaaccaggcatcttcaaaacgccacagggggaaataggagcagtcagcctggactatcctgaagggacctcaggctccccaatactggacaagaatggtgacatcgtgcgactcggaccgatg

SEQ ID NO: 7089 - DNA, 203 bp, Homo sapiens
  source 1..203: mol_type = other DNA
ggcgcgccagtcctggcttgtacgggaatggagtcatcttgggcaacggctcgtatgtcagtgccatcgtgcaaggcgaaagagaagaagaacccgttcctgaagcgtacaacgcagacatgttaagaaagaagcagctgacagtgctggacctgcatccaggagcgggaaagaccaggaggatactccgactcggaccgatg

SEQ ID NO: 7090 - DNA, 203 bp, Homo sapiens
  source 1..203: mol_type = other DNA
ggcgcgccagtcctccccagatcatcaaagatgccatccagcgccgccttcgtacagctgtgctggctccaacccgtgtggtggctgcagaaatggctgaggccctcaagggccttcgggtccgatacctgaccccagcggtcaacagagagcatagtggcacagagatagtggatgttatgtgtcatcgactcggaccgatg

SEQ ID NO: 7091 - DNA, 203 bp, Homo sapiens
  source 1..203: mol_type = other DNA
ggcgcgccagtcctgccactctaacccacagactcatgtcacctctaagagctccaaactacaacctctttgtgatggatgaggctcacttcactgacccggcgagcatagcagcacgaggctacattgctacaaaagttgagttgggtgaagcggcagcaatattcatgactgcgactccccctggccgactcggaccgatg

SEQ ID NO: 7092 - DNA, 203 bp, Homo sapiens
  source 1..203: mol_type = other DNA
ggcgcgccagtcctggcgaagggagagtgatcttgagcaacccctcaccaatcactagtgctagtgctgcccagaggagagggagagtaggtagaaatcctagtcagataggtgatgagtaccactatggaggaggcacaagcgaagatgacacgatcgcagctcattggactgaagcaaagatcatgcgactcggaccgatg

SEQ ID NO: 7093 - DNA, 203 bp, Homo sapiens
  source 1..203: mol_type = other DNA
ggcgcgccagtcctaatggtatacagtacaccgacaggaagtggtgttttgatggaccaaggtcaaacatcattctggaagacaacaatgaagtcgaaattgtcacccgcacaggtgaacgcaagatgctgaagccacgctggttggatgccagggtctacgctgaccatcagtcgctcaagtggttccgactcggaccgatg

SEQ ID NO: 7094 - DNA, 203 bp, Homo sapiens
  source 1..203: mol_type = other DNA
ggcgcgccagtcctaaggactttgcggctggtaagcgatcagcagtgggattccttgaagtcctggggagaatgcctgagcacttcgcaggcaagaccagagaggcttttgataccatgtatctggtggcgacagctgagaagggaggaaaagcccaccgcatggcccttgaagagttgccggacgctcgactcggaccgatg

SEQ ID NO: 7095 - DNA, 203 bp, Homo sapiens
  source 1..203: mol_type = other DNA
ggcgcgccagtcctcttgaaaccataacactcattgtggctttggccgtgatgacagcaggagttttcttgctcctcgttcagaggagaggcataggtaagctggggcttggcggtatggtgctaggcctagccactttcttcttgtggatggctgacgtctcaggcaccaagatcgcaggaaccttacgactcggaccgatg

SEQ ID NO: 7096 - DNA, 203 bp, Homo sapiens
  source 1..203: mol_type = other DNA
ggcgcgccagtccttccagcacacgtcaaccacaaagtgctctgccgctaccctccatgaacgctttggcattggatttgcgaccagcaacagcgtgggccttatacggagggagcacagtggttctcacgcccttgatcaaacatcttgtaacatcagaatacatcacaacatctctggcttcaatacgactcggaccgatg

SEQ ID NO: 7097 - DNA, 203 bp, Homo sapiens
  source 1..203: mol_type = other DNA
ggcgcgccagtcctgctgaagctttgagggcggctcaacggagaacagcggccggaatcatgaaaaatgctgtggtagatggtttggtggctacggatgttcctgaactggagagaaccacccccctcatgcaaaagaaggtaggccagattttactgattggagtcagcgcggcggcattgttagtccgactcggaccgatg

SEQ ID NO: 7098 - DNA, 203 bp, Homo sapiens
  source 1..203: mol_type = other DNA
ggcgcgccagtcctaacccgtgtgttacaactgttcgggaagccggcatcctcatatcagcggcactcctgactctctgggacaacggagccattgcagtatggaattccaccaccgcgaccggactttgtcacgtcatccgtggcaattggttggctggagcctctatagcttggactctgataaagcgactcggaccgatg

SEQ ID NO: 7099 - DNA, 203 bp, Homo sapiens
  source 1..203: mol_type = other DNA
ggcgcgccagtcctcctggacatgaggaaccgatgcttatgcaaagctatggctggaaccttgtcactatgaagagcggagtggacgtgtattataaaccatctgagccgtgcgacacgcttttctgtgacattggagaatcatcttctagtgctgaggtggaagaacaacgcaccctgaggattttgcgactcggaccgatg

SEQ ID NO: 7100 - DNA, 203 bp, Homo sapiens
  source 1..203: mol_type = other DNA
ggcgcgccagtcctaggattcaaagattgaaagaggagtatgcagccacatggcaccatgacaaggaccacccatatcggacctggacctaccacggaagttatgaagtgaaaccgaccggttcagcaagctccttggtcaacggagttgtccgcctaatgagcaagccctgggatgcaattctcaaccgactcggaccgatg

SEQ ID NO: 7101 - DNA, 203 bp, Homo sapiens
  source 1..203: mol_type = other DNA
ggcgcgccagtcctgagctgacctacaaacacaaggtggtgaaagttatgcgacctggcacagatgggaagaccgtcatggatgtgatttcccgagaagatcagagaggaagtggacaggttgtgacctatgctctcaacacattcaccaacattgccgtccagcttattagactgatggaagctgaacgactcggaccgatg

SEQ ID NO: 7102 - DNA, 203 bp, Homo sapiens
  source 1..203: mol_type = other DNA
ggcgcgccagtcctgcaacgtgggctgaaaacatctacgcagccattaaccaggtgagagccattattggccaggaaaaatacagggattacatgctttcacttagaagatatgaagaagttaatgtccaggaggacagggttttgtaaataagtgtttagggttttgcaatttaattaaatatgcaacgactcggaccgatg

SEQ ID NO: 7103 - DNA, 203 bp, Homo sapiens
  source 1..203: mol_type = other DNA
ggcgcgccagtcctctgggttaacaaagctgaccgctgatgatgggaaagcccctcagaaccgtttcggagagggaccctgcctattggaagcgtccagcccgtgtcaggccgcaaagcgccacttcgccaaggagtgcagcctgtacggccccaggaggactgggttaccaaagccgaaaggccccccgactcggaccgatg

SEQ ID NO: 7104 - DNA, 203 bp, Homo sapiens
  source 1..203: mol_type = other DNA
ggcgcgccagtcctacggcccaagcgaacagacggtgatgcgaactgttcgtggaaggactagaggttagaggagaccccgtggaacttaggtgcggcccaagccgtttccgaagctgtaggaacggtggaaggactagaggttagaggagaccccgcatcataagcatcaaaaaaacagcatattgacgactcggaccgatg

SEQ ID NO: 7105 - DNA, 203 bp, Homo sapiens
  source 1..203: mol_type = other DNA
ggcgcgccagtcctgtgaagggaccgtgtgttctagacatggtagttgtgtaggtacaagaggacttcatttgaatatcctcgatcccggacctaaattaccttgtggatttccggaggaatttaggaaaccacctccttcgggaggctagtaggagcttacatgactctcggattgggaagtccgagcgactcggaccgatg

SEQ ID NO: 7106 - DNA, 203 bp, Homo sapiens
  source 1..203: mol_type = other DNA
ggcgcgccagtcctcctttaagagaaataagattgcatgtgctgaaaagcaaggtcaagtgcaatccaatcaaactggcaattctccaaatgtaacaccagttaatgccactaatgggtcacaagtaacaactattaattactatggggcacaatatgcacaggcatataatccatccagtcagacaacgactcggaccgatg

SEQ ID NO: 7107 - DNA, 203 bp, Homo sapiens
  source 1..203: mol_type = other DNA
ggcgcgccagtcctggtacataacagcctggctacagacaaaattggttcatccagctggtgttccaaccaccagtcccattgtagtgtatgcttcagctagtaataacttcaccttcaagtgcccaatagatagtgcatacttccagggacttggtgaccaaataacttcacaagtggaagggttgacgactcggaccgatg

SEQ ID NO: 7108 - DNA, 203 bp, Homo sapiens
  source 1..203: mol_type = other DNA
ggcgcgccagtcctcaactagagtcacaaaggcaacattttctgcacaagacactgatgtagagtttttcttctcaaggtatatgcttataggatctgttggaagtcgacaaggaacccaggactttgccaaatttgacatgtcttttgaggccattaagggagctagtagggcaattagaacaaaatcgactcggaccgatg

SEQ ID NO: 7109 - DNA, 203 bp, Homo sapiens
  source 1..203: mol_type = other DNA
ggcgcgccagtcctttcagatgtttacatatatgaggtttgacttggatgtggttctggagccgctagaagagattccttatcaggtgatgtactgccccactgggtcagttgtaccagcaaactctatagataattggaacacaacttgtaatgcagtgattactcaacgacctggtaagaatgtttcgactcggaccgatg

SEQ ID NO: 7110 - DNA, 203 bp, Homo sapiens
  source 1..203: mol_type = other DNA
ggcgcgccagtcctagttcaagtacagagagcaatcagttttggatttggctgagaaaatacttgagtcaaagagagtgctccttgagatgcagaagacagacaataggatttacctcactttggtgaagtatgctgaaaaggccagtaaattcattcagaattcaaggaaaagaccatttgaaccaacgactcggaccgatg

SEQ ID NO: 7111 - DNA, 203 bp, Homo sapiens
  source 1..203: mol_type = other DNA
ggcgcgccagtcctgagagaagaagtttaccactcctgatttactgattggcaagttgactggttacagaagggagaaaattaatacaaatgacatggttgatgcactgtttcaagggccgaggaaagttgtaagtctgaaacctactctcaagttcctggacgatgaagaactcaaaactccagtgacgactcggaccgatg

SEQ ID NO: 7112 - DNA, 203 bp, Homo sapiens
  source 1..203: mol_type = other DNA
ggcgcgccagtcctagctcatgccagagtgcattgaagatctcattagaagtgtgcatgaccaacgcatcattgactggtgcgaagaccagggatacatttttgaaccacacatgcagcactttatagtagagagagagagtaaatggctgaagacagtaataaagactacagtcacttctttggctgcgactcggaccgatg

SEQ ID NO: 7113 - DNA, 203 bp, Homo sapiens
  source 1..203: mol_type = other DNA
ggcgcgccagtcctttttgggagctgtgtgtggattgatctatgcagcttggagactctggccaacatctgagcaaggagcatacactggaaatcagagagctgttttgaaaagacctgagttaagaacagtgcaagtgcaggggcctggaactcatccagatcttcagtatatccaggcattgctcacgactcggaccgatg

SEQ ID NO: 7114 - DNA, 203 bp, Homo sapiens
  source 1..203: mol_type = other DNA
ggcgcgccagtcctctgagagacccgccaggaaaagtgtcaatgtcagatcgacaacttcacttcaaccatcggtttggcatgacattgttccaggtgagaaggaacctgcagttttgagtaagtttgacaagagatgtgaggtggactttgagaaggctctattctccaaatacgagcagaatgtggcgactcggaccgatg

SEQ ID NO: 7115 - DNA, 203 bp, Homo sapiens
  source 1..203: mol_type = other DNA
ggcgcgccagtcctccatcttcaattcaatcattaataacatcattgtgagaactctggtcttggacacctacaaaggtatcgatctcgaccaactccgtattctggcctacggtgatgacctactggtgtcctatccatttccacttgacccagaggcattagcaagggctggaaaggtgtatggtccgactcggaccgatg

SEQ ID NO: 7116 - DNA, 203 bp, Homo sapiens
  source 1..203: mol_type = other DNA
ggcgcgccagtcctttaaaatgacacctgcagacaagagtgaacactttgatgggccaaagaaaatctgggaggtgaccttcctgaagaggggctttaagcctgattctcggtacccatttctcattcatccagtgtacccaatggatcaggtgtacgagtctctcagatggactaggaaaccttctgcgactcggaccgatg

SEQ ID NO: 7117 - DNA, 203 bp, Homo sapiens
  source 1..203: mol_type = other DNA
ggcgcgccagtcctgcaggagggtcaagtgtattggtgtggctagccaaagggaatagcccctcctaatgaggttgttgggcgcggcgtcccaactcaaacaaaacgcgtcggataatttcttaacacataatcactttaatcattagttgttaggattttaatcattagtttagatatagtttgttacgactcggaccgatg

SEQ ID NO: 7118 - DNA, 203 bp, Homo sapiens
  source 1..203: mol_type = other DNA
ggcgcgccagtcctgtgaaacctcgcgtcattctggaggccacaacatccggtgatgcacaaacgcagtatagatctaaaccaaaaattgaagcattcacgtcggcggatgtaataaccattactaaacccaaagtgatggttgaggcagtgtcatctggcgatagtataactcaaaacaaacctaaacgactcggaccgatg

SEQ ID NO: 7119 - DNA, 203 bp, Homo sapiens
  source 1..203: mol_type = other DNA
ggcgcgccagtcctaagtttcacccaattgagattaagcaagaatacaccaaagctgactttccatatgctccaggagacatgtttggtcccataggtaagtgcccccaccagttatttgagcccggtaaaacagatattcgacctagtgtaatttatggtaaggtaaaacctcctattacgaaaccccgactcggaccgatg

SEQ ID NO: 7120 - DNA, 203 bp, Homo sapiens
  source 1..203: mol_type = other DNA
ggcgcgccagtcctattaaaggaaatgatatttcagaatatatttctagtataaatcgacaatcatccccaggttacccatggattttagatcgtaaaccaggctttccaggtaagactcaatggtttgggaacgatgaagattacaaaattgatcctgacgtgatgcaaaaagtacatgaaagaattcgactcggaccgatg

SEQ ID NO: 7121 - DNA, 203 bp, Homo sapiens
  source 1..203: mol_type = other DNA
ggcgcgccagtcctgaaaacgcaaaacaaggaatacggaccccaactttttgggttgacacgctcaaggatgagcgacgacctattgagaaagttgatgcactcaaaacacgcgtcttttcgaacggacccatggattttaatttggctttccgcaaatattttctaggatttatagcgcatttaatgcgactcggaccgatg

SEQ ID NO: 7122 - DNA, 203 bp, Homo sapiens
  source 1..203: mol_type = other DNA
ggcgcgccagtcctgacggctattggcatttacgaaatatggaatactttttataaaacgtttctcttctggttaccagcaacataggaaattgtcgttgaactacatgttgtaaggctttagagaaataagggagtgtcctatttaggatgaggtgctccggtggcagccccaccaaaacctctagccgactcggaccgatg

SEQ ID NO: 7123 - DNA, 203 bp, Homo sapiens
  source 1..203: mol_type = other DNA
ggcgcgccagtcctaccagacaagaactcacagttttccatgatgttgaacaacctcgcgtcgctcttccaattgctccgcaaacgactagctctcttgctaagcttgattctacagcgacaattgtggattttctttctagaactgttgtcctcgatcaattcgagcttgttcaaggtgaatcaaaccgactcggaccgatg

SEQ ID NO: 7124 - DNA, 203 bp, Homo sapiens
  source 1..203: mol_type = other DNA
ggcgcgccagtcctgtggccggaagattttggctaacatattccccatatgaacataaagtagataaggcaagacgccagcaatataatagtagagctggagtgacagcatatcctggaatagaaatggatgttcaaatcaatgattcagcagaaatggttatcccatttgcttcctacaaagaagctcgactcggaccgatg

SEQ ID NO: 7125 - DNA, 203 bp, Homo sapiens
  source 1..203: mol_type = other DNA
ggcgcgccagtcctgtccccggcaagtattattcccatgtaaaagcgatagataatagtgtagctttagctttgagtaatgagaacgagcttctcccacttagcgacatctttccctcagcggtagatgagatggacttggcatatgtgtgtgctaatcctggagtgaaggaagtcattacgcggtcgcgactcggaccgatg

SEQ ID NO: 7126 - DNA, 203 bp, Homo sapiens
  source 1..203: mol_type = other DNA
ggcgcgccagtcctcctaaggcggattggcataattatgttgatctttccgcttacgataaagtggataccgcaaattcttacaaatatattttagatttaacaaatgattcagaaattactattagagtgccatttattagcgataggttagctttaagtacaattggtgctaatagttatggtgagcgactcggaccgatg

SEQ ID NO: 7127 - DNA, 203 bp, Homo sapiens
  source 1..203: mol_type = other DNA
ggcgcgccagtcctttatgtgagactagaaatgccacaatgcagatcaacatttccaatgaagcatcaggaaacagtatcgatattttccaggataataatgcaggtgtgagtccaaatgcagtaatgggtaaaattgcgggtgaacgtctagttaacttgcgaccactactgcgctgcttccgatctcgactcggaccgatg

SEQ ID NO: 7128 - DNA, 203 bp, Homo sapiens
  source 1..203: mol_type = other DNA
ggcgcgccagtcctacgatttgttatgcgcctgcagactatagctactatttgtggtattaaatatgttgcacaacctacagaagatgtagtagatggagatgtagttatacgtgaacctgtacatttattatctgctgatgcaatagttttaaagcttcctagtttgatgaaagttatgactcatatcgactcggaccgatg

SEQ ID NO: 7129 - DNA, 203 bp, Homo sapiens
  source 1..203: mol_type = other DNA
ggcgcgccagtcctttcagtcaagtcttatgatgatttggtttattcaggtgtagtaggttgtaaatctattgttaaagaaactgctcttattactcatgcactttacttagattatgttcaatgtaagtgtggtaatcttgaacaaaatcatattcttggcgttaataattcttggtgtaggcaactcgactcggaccgatg

SEQ ID NO: 7130 - DNA, 203 bp, Homo sapiens
  source 1..203: mol_type = other DNA
ggcgcgccagtcctagtagaagatgatgttattgagaatgtcaaatcttctttatcatcttatgagtattgtcaaccacctaaatctgtagaaaaaatttgtattatagataatatgtacatgggtaagtgtggtgataaatttttccctattgtcatgaatgataaaaatatttgtcttttagatcacgactcggaccgatg

SEQ ID NO: 7131 - DNA, 203 bp, Homo sapiens
  source 1..203: mol_type = other DNA
ggcgcgccagtccttgattttgttgctgttgtttgtgatgctatagagaatgctttaaactcttgtaaagagcatccagtggttggttatcaagttcgtgcatttttaaataaacttaatgagaatgttgtttatttatttgatgaggctggtgatgaagcaatggcctctcgtatgtattgtactttcgactcggaccgatg

SEQ ID NO: 7132 - DNA, 203 bp, Homo sapiens
  source 1..203: mol_type = other DNA
ggcgcgccagtcctcaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaataacgatgaagagattgttaccgactcggaccgatg

SEQ ID NO: 7133 - DNA, 203 bp, Homo sapiens
  source 1..203: mol_type = other DNA
ggcgcgccagtccttggtgacaatgatgaccaaattgttgttactggtgatgatgtagatgatattgaaagtatttatgactttgatacttataaagctcttttagtttttaatgatgtctataatgatgctttgtttgttagttatggttctagtgttgaaacagaaacatattttaaagttaatggcgactcggaccgatg

SEQ ID NO: 7134 - DNA, 203 bp, Homo sapiens
  source 1..203: mol_type = other DNA
ggcgcgccagtccttggacataatatgactctaatagcagcggacttaccttgtacattacatttttcattatttgatgacaatttttgtgctttttgcacccctaaaaaaatttttattgctgcatgtgctgtggatgtaaacgtttgtcattctgtagctgttataggtgatgaacaaatagatggcgactcggaccgatg

SEQ ID NO: 7135 - DNA, 203 bp, Homo sapiens
  source 1..203: mol_type = other DNA
ggcgcgccagtccttattgttaatcctgctaatgggcatatgctccatggtggtggagttgcaaaagctatagctgtagctgcaggtaaaaaattttctaaagaaactgctgctatggttaaatctaaaggtgtttgccaagtaggagattgttatgtttctaccggtggtaaattatgtaaaacaatcgactcggaccgatg

SEQ ID NO: 7136 - DNA, 203 bp, Homo sapiens
  source 1..203: mol_type = other DNA
ggcgcgccagtcctttttgtttcaaattcttctgttatacaagaagttttattgcttcgtcatgatatacaattgaataatgacgttcgtgattatttgttgtctaagatgactagtcttcctaaagattggcgtcttatcaataaatttgatgttattaacggtgttaaaactgttaagtattttgacgactcggaccgatg

SEQ ID NO: 7137 - DNA, 203 bp, Homo sapiens
  source 1..203: mol_type = other DNA
ggcgcgccagtcctcagaccacataggttagttgctcttgttttagctaaaggtcattttaaatttgatgaaccatcagatgctactgattttattcgtgttgttttgaaacaagctgatttatcaggtgcaatttgtgaattagaacttatttgtgattgtggtattaaacaagaaagtcgtgttggcgactcggaccgatg

SEQ ID NO: 7138 - DNA, 203 bp, Homo sapiens
  source 1..203: mol_type = other DNA
ggcgcgccagtccttgttgatgctgttatgcattttggtacattagcaaagactgatctttttaatggttataagattggctgtaattgtgcaggtagaattgtccattgtactaaattgaatgtaccatttttgatttgttctaatactcctctgagtaaggatttacctgatgatgttgttgcagccgactcggaccgatg

SEQ ID NO: 7139 - DNA, 203 bp, Homo sapiens
  source 1..203: mol_type = other DNA
ggcgcgccagtccttaacatgtttatgggtgtaggtgtaggccattatacacatttgaaatgtggttcaccttaccaacattatgatgcttgtagtgttaaaaaatatacaggtgttagtggttgtttaactgactgcttgtatcttaaaaatttaacccagacttttacatctatgttgactaattacgactcggaccgatg

SEQ ID NO: 7140 - DNA, 203 bp, Homo sapiens
  source 1..203: mol_type = other DNA
ggcgcgccagtcctttatcttcctaatattagtgtttttcctatttttgtgggaagaattgttatgtggataaaggctacttttggtttggttacaatttgtgatttttattctaagttaggtgtaggttttacaagtcatttttgtaatggtagttttatatgtgaattgtgtcattctggttttgacgactcggaccgatg

SEQ ID NO: 7141 - DNA, 203 bp, Homo sapiens
  source 1..203: mol_type = other DNA
ggcgcgccagtccttatgttggatacatatgcagctatagattttgttcagtatgaagtagatagacgtgttttatttgattatgttagtttagtcaaattaattgttgaactcgttattggttattcattatacacagtatggttttatccattattttgtcttattggtttacaattatttactaccgactcggaccgatg

SEQ ID NO: 7142 - DNA, 203 bp, Homo sapiens
  source 1..203: mol_type = other DNA
ggcgcgccagtcctgagacatggctttcatgttttacattttttaacttatgcatttgctagtgatagtgttcagtgctatacaccacatattcagatttcttataatgatttttatgctagtggttgtgttttatcatctttgtgtactatgtttaaaagaggtgatggtacaccacatccttattgcgactcggaccgatg

SEQ ID NO: 7143 - DNA, 203 bp, Homo sapiens
  source 1..203: mol_type = other DNA
ggcgcgccagtcctatacgccgaagagggtatatgttttaattttaatagttcctgggttttgaataatgattattatagaagtatgcctggaactttttgtggtagagatctttttgatttgttttatcaattttttagtagtttaattcgtcctatagatttcttttctcttactgctagttctatcgactcggaccgatg

SEQ ID NO: 7144 - DNA, 203 bp, Homo sapiens
  source 1..203: mol_type = other DNA
ggcgcgccagtccttacttatggtagtatgactttgaatggtttatggttagatgacaaagtttattgtcctcgtcatgttatatgttcatcctctaatatgaacgaacctgattattctgccttattgtgtagagttactctaggtgattttactataatgtctggtcggatgagtttaacagttgtcgactcggaccgatg

SEQ ID NO: 7145 - DNA, 203 bp, Homo sapiens
  source 1..203: mol_type = other DNA
ggcgcgccagtccttaaagaaacaatttattggattttgatatctacatttttgtttagttgtataatttctgcatttgttaaatggactatatttatgtatattaatacacatatgattggtgttacattatgtgtactttgttttgttagttttatgatgttactagttaaacataagcatttttacgactcggaccgatg

SEQ ID NO: 7146 - DNA, 203 bp, Homo sapiens
  source 1..203: mol_type = other DNA
ggcgcgccagtccttttgactatgtatataattcctgtactctgtaccttgttttatgtaaattatttagttgtttataaggaaggttttagaggttttacttatgtctggctctcatattttgttcctgctgtgaattttacttatgtttatgaagtattttatggttgtattttatgtgtttttgccgactcggaccgatg

SEQ ID NO: 7147 - DNA, 203 bp, Homo sapiens
  source 1..203: mol_type = other DNA
ggcgcgccagtcctacagttagaaaaagcatgtaatatagctaagtctgtgtatgaacgtgataaagctgtagctcgcaaacttgaacgtatggcagacctagcacttactaacatgtataaagaggctcggattaatgataagaagagtaaagttgtttccgctttgcagacaatgctttttagcatcgactcggaccgatg

SEQ ID NO: 7148 - DNA, 203 bp, Homo sapiens
  source 1..203: mol_type = other DNA
ggcgcgccagtcctggttcgtaaattggataatcaggctttaaattctattctggataatgctgttaaaggttgtgtacctttgagtgctattccagcattggctgctaatactttaactatagtaataccagataaacaagtttttgataaagttgttgataatgtttatgttacatatgctggtagcgactcggaccgatg

SEQ ID NO: 7149 - DNA, 203 bp, Homo sapiens
  source 1..203: mol_type = other DNA
ggcgcgccagtcctggtgtagttatgaacttagatgttgacacacaccgttatcgtttgtctcttaaagatttacttctttatgcagcagatcctgctatgcacgttgcatctgctagtgctctgcttgatttacgaacttgttgttttagtgtagctgccattacaagtggtataaaatttcaaactcgactcggaccgatg

SEQ ID NO: 7150 - DNA, 203 bp, Homo sapiens
  source 1..203: mol_type = other DNA
ggcgcgccagtcctttgagtgatgatggtgttgtctgttataactctgattatgctagtaagggttatatagctaatataagtgtttttcaacaagttttgtactatcagaataatgtctttatgtctgaatctaaatgttgggttgaaaatgatattactaatggtcctcatgaattttgttcccaacgactcggaccgatg

SEQ ID NO: 7151 - DNA, 203 bp, Homo sapiens
  source 1..203: mol_type = other DNA
ggcgcgccagtcctcagagtgtaggtgcatgcgttgtttgttcatcacaaacttctttgcgttgtggcagttgtatacgtaagcctttgttatgttgtaaatgttgttatgaccatgttatggcaactaatcataaatatgttttgagtgtctcaccttacgtttgtaatgcacctaactgtgatgtgcgactcggaccgatg

SEQ ID NO: 7152 - DNA, 203 bp, Homo sapiens
  source 1..203: mol_type = other DNA
ggcgcgccagtcctgaagttgatgattatgttctggcaaatgagtgtattgaacgtttaaagttatttgctgcagaaactcaaaaggcaactgaagaggcttttaaacaaagctatgcttctgctaccattcaagagattgttagtgatagagaagttattttgtgttgggagacaggtaaagttaaacgactcggaccgatg

SEQ ID NO: 7153 - DNA, 203 bp, Homo sapiens
  source 1..203: mol_type = other DNA
ggcgcgccagtcctcttgctataggtctagctgtttattactacacagcacgtgtagtttatactgctgctagtcatgctgctgtagatgcattgtgtgaaaaagcttataagtttttaaatattaacgattgtacacgtattattcctgctaaagttcgtgtagattgttatgataagtttaaaattcgactcggaccgatg

SEQ ID NO: 7154 - DNA, 203 bp, Homo sapiens
  source 1..203: mol_type = other DNA
ggcgcgccagtccttctatgcctgttttgtataagtatttgaatgttccattagagagagtctctttatggaattatggtaaacctattaatttgcctacaggctgtatgatgaatgttgctaagtacactcaattatgtcagtatttgaatactacaacattagctgttcctgttaatatgcgtgttcgactcggaccgatg

SEQ ID NO: 7155 - DNA, 203 bp, Homo sapiens
  source 1..203: mol_type = other DNA
ggcgcgccagtccttaatggtagtaatgatgtatggcttcttaacaaggtaagattttatcgtgccttatattctaatatggccttttttcgttatcttacttttgttgatattccttataatgtttctctttctaagtttaattcttgtaaaagtgatattttatcacttaacaatcctatttttatcgactcggaccgatg

SEQ ID NO: 7156 - DNA, 203 bp, Homo sapiens
  source 1..203: mol_type = other DNA
ggcgcgccagtcctactttgcttcgtttagttcatactgattctttttcttgtaataattttgatgaatctaagatatatggtagttgttttaagagtattgttttagataaatttgccatacccaactccagacgatctgatttgcagttgggcagttctggttttctgcaatcttctaattataaacgactcggaccgatg

SEQ ID NO: 7157 - DNA, 203 bp, Homo sapiens
  source 1..203: mol_type = other DNA
ggcgcgccagtccttgtccttgtgctaaaccttcttttgcttcaagttgcaagagtcataaaccaccttctgcttcctgtcctattggtactaattatcgttcttgtgagagtactactgtactcgaccacactgactggtgtaggtgttcttgtttacctgatcctataactgcttatgaccctaggcgactcggaccgatg

SEQ ID NO: 7158 - DNA, 203 bp, Homo sapiens
  source 1..203: mol_type = other DNA
ggcgcgccagtccttcttgttctcaaaaaaagtctctggttggtgttggtgaacattgtgcagggttcggtgttgatgaagaaaagtgtggtgtattggatggatcatataatgtttcttgtctttgtagtactgatgcctttctaggttggtcttatgacacttgcgtcagtaacaaccgttgtaatcgactcggaccgatg

SEQ ID NO: 7159 - DNA, 203 bp, Homo sapiens
  source 1..203: mol_type = other DNA
ggcgcgccagtcctgtctgttctaattatgcagcttgccatgacttattgtcagagtatggcactttttgtgataatattaatagtattttagatgaagttaatggtttacttgatactactcaattgcatgtagctgatactcttatgcaaggtgtcacacttagctccaatcttaatactaatttgcgactcggaccgatg

SEQ ID NO: 7160 - DNA, 203 bp, Homo sapiens
  source 1..203: mol_type = other DNA
ggcgcgccagtcctcttctttgtgtacaatcctttaatggtattaaagttttgcctcctattttgtctgaatctcaaatttctggttacaccacagccgctactgttgctgctatgtttccaccatggtcagcagcagctggcataccattttctcttaatgtacaatatagaattaatggtttgggtcgactcggaccgatg

SEQ ID NO: 7161 - DNA, 203 bp, Homo sapiens
  source 1..203: mol_type = other DNA
ggcgcgccagtcctgagaaggttaatgagtgtgttaaaagtcaatctcctcgtattaatttttgtggtaatggtaatcatattttgtcattagttcaaaatgctccttatggtttgttgtttatgcattttagttataaacctatttcttttaaaactgttttagtaagtcctggtttgtgtatatcacgactcggaccgatg

SEQ ID NO: 7162 - DNA, 203 bp, Homo sapiens
  source 1..203: mol_type = other DNA
ggcgcgccagtcctgtcaacctattgttggttactgtattgtacctttaaatgtttggtgtcgcaagtttggcaaatttgcttctcactttacattacgtagtcacgatatttcccatagtaataattttggtgttgtaactagttttactacttatggtaatactgtttctgaggctgtgtctagatcgactcggaccgatg

SEQ ID NO: 7163 - DNA, 203 bp, Homo sapiens
  source 1..203: mol_type = other DNA
ggcgcgccagtcctatggccccaaggtctccggctttgaagactttctggaggattgtgccattacaacaggcacaggcagctttgaagcgcatccggaaagtggtgggttcgctgttgcagaatcttcaaaaaagaggaaaacgcagatcggctgtggattggacaggagcggtcacgatggtgattcgactcggaccgatg

SEQ ID NO: 7164 - DNA, 203 bp, Homo sapiens
  source 1..203: mol_type = other DNA
ggcgcgccagtcctcatgccaaattgacggataccaaagtggcggcgaggtgcccaacgactgggccagcaaccctccctgaagagcaccagaagaacatggtgtgcaaaagagatcagagtgataggggatgggggaaccactgcgggctgttcggaaaaggtagcattgttggatgtacgaagtttcgactcggaccgatg

SEQ ID NO: 7165 - DNA, 203 bp, Homo sapiens
  source 1..203: mol_type = other DNA
ggcgcgccagtcctgattgcgaggtcaacaagaaagccactgggagagtgtttgacatcaccaagattgtgtacacggtgaaggtggaaccacacactggcacatatgtggcagcaaatgagacaaacagcgacagaaagtcagttgagttcaccgcacagtcggaaaagaagaccatctccttggggcgactcggaccgatg

SEQ ID NO: 7166 - DNA, 203 bp, Homo sapiens
  source 1..203: mol_type = other DNA
ggcgcgccagtcctagctatggtgaggttggactctcttgcagggtgaattctggcattgacgttgaccaaaccgtggtgctggagttggaaggccaggcactccaccccaaggggtgggctgtgcacaaagactggtttggagacctggcactaccatggaaacaccatgaggcggagatctgggaacgactcggaccgatg

SEQ ID NO: 7167 - DNA, 203 bp, Homo sapiens
  source 1..203: mol_type = other DNA
ggcgcgccagtcctgtcgatgtggcaaatctcataacccctaacccaaccattgagaatgaagggggtgggtacattgagatgcaacttcctcccggggacaacacaatttatatcggcaatcttcaccaagcatggttccagaaagggagctccataggcagagtgtttgaaaagacacgcaaggggcgactcggaccgatg

SEQ ID NO: 7168 - DNA, 203 bp, Homo sapiens
  source 1..203: mol_type = other DNA
ggcgcgccagtcctatccagagactggcagcagttggagagcacgcatgggactttggttccgtgggcggcttctttgggtcaattggaaaggcagtgcacatggtcctggggggactgttcggtgtcttgtttggaggcattgggtttatccccaagatgctgatgggagctgccttgatttggcttcgactcggaccgatg

SEQ ID NO: 7169 - DNA, 203 bp, Homo sapiens
  source 1..203: mol_type = other DNA
ggcgcgccagtcctggaataaacatgaaaaacaccaccttgtctcttagctttctggccacaggtggactcatcctgatgatgacacttggcgttggggcagaccaaggatgttccattgacagtgagagaatggagctcagatgtggagcaggactggccgtttggaaggaaaccgcagagtggtatcgactcggaccgatg

SEQ ID NO: 7170 - DNA, 203 bp, Homo sapiens
  source 1..203: mol_type = other DNA
ggcgcgccagtcctgacggctatgcgttccaccctgagtccccgggagagctggctgcagcgctcgtggaggcagccaagaacaacgtgtgtggaatagtgccccaaaacaggctagaactggcaatgtggagatcgcgcagagatgagatcaatctacacctcgctgaagcagaggccaatctcacacgactcggaccgatg

SEQ ID NO: 7171 - DNA, 203 bp, Homo sapiens
  source 1..203: mol_type = other DNA
ggcgcgccagtcctaagtccagaggcaatgcaaccggtttctatattcaggagctgcatgtcatggacttgcgtaactgcacttggccagatgagtacaccattgacaacaagggggtgatagagtcacacctgtttctcccggtgacgctggctgggccgagaaccatgtacaaccagatcccaggacgactcggaccgatg

SEQ ID NO: 7172 - DNA, 203 bp, Homo sapiens
  source 1..203: mol_type = other DNA
ggcgcgccagtccttatgctgtgcagctgtctgggccgtggaatcaaacacctctgcgcgtgaaacgagaaccatgccctgggacagaggtcaagattgaccctggatgtcctggcagaggagcttctgtgcgtagcaccacggaaagcgggaaggtgattccggagtggtgctgtagaacttgcacacgactcggaccgatg

SEQ ID NO: 7173 - DNA, 203 bp, Homo sapiens
  source 1..203: mol_type = other DNA
ggcgcgccagtccttactgggcggacatcagagaggatgtagtgtgctatgggggtgcctggaacctgccaaccaagtgggagggcgaggtggtacagcttcatgctttccctccgggaagggctcatgagatcaagcaatgtcagcctggcagactcaacctgggtaatgggagggtcatgggagcgcgactcggaccgatg

SEQ ID NO: 7174 - DNA, 203 bp, Homo sapiens
  source 1..203: mol_type = other DNA
ggcgcgccagtcctggatggatgtcaaaaggagagatcacggtgattgacatgcatccaggtgcggggaagactcatagagtcctccctgaactcatcaggcaatgcatagacaggaggcttcgaaccctgattctggccccaacaagggtggttttaagggagatggagcaggctctgaaaggcaagcgactcggaccgatg

SEQ ID NO: 7175 - DNA, 203 bp, Homo sapiens
  source 1..203: mol_type = other DNA
ggcgcgccagtcctatgggggccaactttgatgtcgacagggtgatcgatggcaggaataacatcaagcctgaggaaattgacggagcagtcgaactcattggggtcaggaaagtcaccactgcgtcggctgcccagagaagaggcagggtggggcgcaaggaaggaagaagggaccggtatgtgtaccgactcggaccgatg

SEQ ID NO: 7176 - DNA, 203 bp, Homo sapiens
  source 1..203: mol_type = other DNA
ggcgcgccagtccttctggccagtgtgatgatgatgacagcatgctggtacagtggaaagaagcccaaatgctgttggacaatatcacaacccttaggggaatggcggcagtcttttacggtcctgaacaggaacggatgcccgaggtggctggcttctacaggctcaccgaggagaagaggaagtaccgactcggaccgatg

SEQ ID NO: 7177 - DNA, 203 bp, Homo sapiens
  source 1..203: mol_type = other DNA
ggcgcgccagtcctttccggcatctcttgtcacagaatgatttcacaccctggctggcatggcatgtggctaagaacacagcgggaccgattgaccgaagttggacttgggagggaccggagggcaacgctatagagggccagaatggtgaggtcgtccggttcagaactcctggtggcgctgagaaacgactcggaccgatg

SEQ ID NO: 7178 - DNA, 203 bp, Homo sapiens
  source 1..203: mol_type = other DNA
ggcgcgccagtcctatcttgaaaccaacctggagagacatgcgcatgttccgagaggggcgtgacatccgagagtttgtccagtatgcaagttgccgcaggggagcgtctgaactgctgatgggaatgagtgaagtcccaggtttgatgaggaacagagtgctgggggcttatgacgtgttctacacccgactcggaccgatg

SEQ ID NO: 7179 - DNA, 203 bp, Homo sapiens
  source 1..203: mol_type = other DNA
ggcgcgccagtcctctcatttctttgtgtctcatgtgggctgggggcatgtcttatggacatatggcgggggtttctctcgtcttttatgctttcctgactgtgatacagcccgaacctggcaaacagagaagcgccgatgacaacagattggcgttcacactccttgtcctgggattggtaattggacgactcggaccgatg

SEQ ID NO: 7180 - DNA, 203 bp, Homo sapiens
  source 1..203: mol_type = other DNA
ggcgcgccagtcctacagtggcagccaatgagcttggttggcttgagaggaccaaggctgacttaggccagcttctctggaaacccacggaggaagccgataggggagggtggaccgagtggaccaacattgacattcagccggcacgttcgtggggaacttatgtgcttgtggtgtctctcttttcgcgactcggaccgatg

SEQ ID NO: 7181 - DNA, 203 bp, Homo sapiens
  source 1..203: mol_type = other DNA
ggcgcgccagtcctccatacatgattcatcagatgcagaccagagtccaacgtctggtcaacagtgccgtggtgtcgggtggccagaccatccgtgagataggagggggagcacctttctttggagtgaaggggcacgtcatcacaatggggataagttccctagttggggcaactccactatcactgcgactcggaccgatg

SEQ ID NO: 7182 - DNA, 203 bp, Homo sapiens
  source 1..203: mol_type = other DNA
ggcgcgccagtcctgaaagaaagctcagcctcatgcttgcagtcggcctgggcgccctggctgtgtccctcaacagaactgcgtgggccttggcagaggctggggcgctgatggtggcagctgtgggtcaactggtgtcaaccgaaggcgagttttggtggacaatgccggtggcgtgcggaatggcacgactcggaccgatg

SEQ ID NO: 7183 - DNA, 203 bp, Homo sapiens
  source 1..203: mol_type = other DNA
ggcgcgccagtcctttagaaaccgacaggaccaaggctagggaactcttgagacgtggagagacaaacatggggttggccgtctcacgcggaactgccaagttggcgtggctagaggaaagaggttatgccaccgtcaagggggaggtcgtagacctgggctgtggacgcggtggatggtcatactaccgactcggaccgatg

SEQ ID NO: 7184 - DNA, 203 bp, Homo sapiens
  source 1..203: mol_type = other DNA
ggcgcgccagtcctgccgcttccagacccaccgtattgagtgtgaaggcatacaccatcggagggaaaggacacgaggaaccccgtatggtcaccagcttgggatggaacctcgtgaagttcagaagtggaatggatgtgttttctatggaggcccacagagcagacacggtgatgtgtgacattggacgactcggaccgatg

SEQ ID NO: 7185 - DNA, 203 bp, Homo sapiens
  source 1..203: mol_type = other DNA
ggcgcgccagtcctgagagtgatccggacccagagaaggaaggggagagaagccgcagagtgatccagctcatgagccgctggaagcagcggaacccagacgcctcctgtgtattcaaggtgctggctccttacagacctgatgtcattgaggcactccacagattccagctgctgtggggtggggggcgactcggaccgatg

SEQ ID NO: 7186 - DNA, 203 bp, Homo sapiens
  source 1..203: mol_type = other DNA
ggcgcgccagtcctctggtgagaaaccctttctccagaaactcgacccatgagatgtactacacgacgggggtttgtggaaacatcatcaatgctgtcaatgtgacatcaaaacgactgttgagtaggtatggtgatgctgctggacccgtccttgttcctgaggtagatttgggaactggaactcgtcgactcggaccgatg

SEQ ID NO: 7187 - DNA, 203 bp, Homo sapiens
  source 1..203: mol_type = other DNA
ggcgcgccagtccttgcgtggcactggccagtgacgtggtgaagccaaaggatgtggaagagaggatcaacgccctaaagagacagtactcagacacgtggcatgtggacaaagaacacccatatcggacatggcagtattgggggagttaccgaacagcggccacaggctcggcggcgtccttgatccgactcggaccgatg

SEQ ID NO: 7188 - DNA, 203 bp, Homo sapiens
  source 1..203: mol_type = other DNA
ggcgcgccagtcctacactcacgaacgtgaaggtacagctcatcaggatgatggaaggtgagggcgtcattgggccctctgacgcacaggatcctaggctccgccgagttgaacaatggcttcatgcccacggggcagaaaggttgactcggatgttggtcagtggtgacgactgtgtggtgagaccccgactcggaccgatg

SEQ ID NO: 7189 - DNA, 203 bp, Homo sapiens
  source 1..203: mol_type = other DNA
ggcgcgccagtcctattgatgacaggttcggcacggccctctacttcctgaatgacatggcgaaagtgagaaaggacatcggcgagtgggagccatccatcggtttcgctaggtgggaggaagttccattttgctcccaccacttccatgagcttgccatgaaggatggaagaacgctgatagtgccacgactcggaccgatg

SEQ ID NO: 7190 - DNA, 203 bp, Homo sapiens
  source 1..203: mol_type = other DNA
ggcgcgccagtcctgatatgttgtgcgcgtcattgattggccataccgagagggctgactgggcacggcacatatggactggggtcatgaaggttcgagccatgataggtagggagacgtatgtggactacctgtcgcacatggacaggcatgaggccccatggctccctgtctacgaaagctccatccgactcggaccgatg

SEQ ID NO: 7191 - DNA, 203 bp, Homo sapiens
  source 1..203: mol_type = other DNA
ggcgcgccagtcctgtggaccagtgaaaactttgtgagactgaccatccctcaaggccgagtgggatgcgtatgaaggcccctggagagatccaggaggggggagagaggaaaattggcagcctctctcaggagatttcctccccctataccaaattccccaggaatctggggggcggttcttgttctcgactcggaccgatg

SEQ ID NO: 7192 - DNA, 203 bp, Homo sapiens
  source 1..203: mol_type = other DNA
ggcgcgccagtcctgattttgataatgatgaattgaaacgtttaggaaatttattaaaacaggaagaagaccctcttcatgatcctgactcggaaaatagttatgatgctcctccccctcctcatccgtccctacattcgtcgcgtccctcagataatgatgatttactttcatctacagatgaggctcgactcggaccgatg

SEQ ID NO: 7193 - DNA, 203 bp, Homo sapiens
  source 1..203: mol_type = other DNA
ggcgcgccagtccttcttaacggtcttgtgattgctgatgagaaaattcaaacgcattttccttataattatttaggtttctccttgtatcctcgtacctataacacccaactagtaaagctgcaaactgatcatttgaaaactctaaatgattttcagaaacttttaggagatattaactggatccgcgactcggaccgatg

SEQ ID NO: 7194 - DNA, 203 bp, Homo sapiens
  source 1..203: mol_type = other DNA
ggcgcgccagtcctggagcctccctttatctgtgttccttatgctttagaacaacaggattggctttttcaattttcagataattgggccatagcatttgcgaattaccccggacgaattattcatcattaccctcctgataaattattgcaatttgctagctctcatgcttttatttttccaaaaatcgactcggaccgatg

SEQ ID NO: 7195 - DNA, 203 bp, Homo sapiens
  source 1..203: mol_type = other DNA
ggcgcgccagtcctagttcgccgacaacctattcctaacgctacacttatatttacagacggctcttccaatgggactgcagccttaattattaatcatcaaacttattatacacaaaccagtttctcttctgctcaagttgtggaattatttgcagtccaccaagcattgctaacagtacctacttccgactcggaccgatg

SEQ ID NO: 7196 - DNA, 203 bp, Homo sapiens
  source 1..203: mol_type = other DNA
ggcgcgccagtcctatcttgttctacttgtcctcaattctttgtccttcctcaatatggtgtcaaccctcgaggtttacgccctaatcatctctggcaaacagacgttactcacattcctcaatttgggcgtctgaaatatgttcatgtttcaatcgacaccttttccaactttctcatggcttccctcgactcggaccgatg

SEQ ID NO: 7197 - DNA, 203 bp, Homo sapiens
  source 1..203: mol_type = other DNA
ggcgcgccagtcctttggggagaacgatcctcatgcaaaaaaccacttgtacgatggaaagatccacttaccaatctgtggtatgggcctgaccctgtattaatatggggacgagggcatgtttgtgtttttccacaggatgccgaagcaccgcgctggattccggaaaggctggtacgcgcggcagacgactcggaccgatg

SEQ ID NO: 7198 - DNA, 203 bp, Homo sapiens
  source 1..203: mol_type = other DNA
ggcgcgccagtcctccaccctcaggaagtcttaagagcttttggagctcaaatgtgttttggttttgcaacatggcttaaaaagcaggaaatctgattatgtaagaaaccagtaattatgtaagtaaatgatctcaagttacttaacttgcttatatatactgctgcacaataaagcaaggtatcagccgactcggaccgatg

SEQ ID NO: 7199 - DNA, 203 bp, Homo sapiens
  source 1..203: mol_type = other DNA
ggcgcgccagtcctagagaaacccgtcaagggcgactatatcaggctgatatgagttttgtgaaaaattacctgctacctaagctaccactgaatgattgctattatgcatggactaatatagacaggtttgaagcagctgtactgagcgtgcgcaacagacagctttcaggtcctcaaggtgctattcgactcggaccgatg

SEQ ID NO: 7200 - DNA, 203 bp, Homo sapiens
  source 1..203: mol_type = other DNA
ggcgcgccagtcctgcttggtggtaagtgtgattttatgttttctttgattttcttgtagacttgttcctgacgctgctacaggagcagaagactaacaagcttcatttatttttccaggtaagcaaacatgtctgctgctgatgcttatcgtccaggtggcaagctgcctctagatgagctaatgcacgactcggaccgatg

SEQ ID NO: 7201 - DNA, 203 bp, Homo sapiens
  source 1..203: mol_type = other DNA
ggcgcgccagtcctaagaatgaatagagcaattcctgtgggaccggaaccttcaagtcaagccaaccgcggaggggggccatatcaaactcactttgctataggaataatgtactccaaggctttccaaggcttgcttagatttgctaatgctttacctcctgaattgagccctgtaaaacagcttgtcgactcggaccgatg

SEQ ID NO: 7202 - DNA, 203 bp, Homo sapiens
  source 1..203: mol_type = other DNA
ggcgcgccagtccttaatcagttagaaaattataggcgtaagacatctgataccagggtatggtacagagtgtacttagacatgacaagacttctaatttctgtggctcctccaggagcagcaaacaaactcagacaggcagcagcaggtataactcactcaaaagcccccaatgctgaaagcctgagcgactcggaccgatg

SEQ ID NO: 7203 - DNA, 203 bp, Homo sapiens
  source 1..203: mol_type = other DNA
ggcgcgccagtcctaggcattgtgcggttcgcagctgctgcttttgtacctactgtagaaaatattgatagattttttgaagactcgctaacgaactttgccaaagaagacttagacacctggcaacaactccacgagcagtttatcaaactctttcaccctccagatgtcggagtccaccttgttagcgactcggaccgatg

SEQ ID NO: 7204 - DNA, 203 bp, Homo sapiens
  source 1..203: mol_type = other DNA
ggcgcgccagtccttgctgatgttcaactttctcaggtcctaccgcccgctcctccttcttcggaccaacaaccggcttattccgcaggagagccctcagccaagaaggcgcggattggtacccctgacgagtctgacccggccttgcttctgcagcctcataccaatacaatgtccgtggaaccagccgactcggaccgatg

SEQ ID NO: 7205 - DNA, 203 bp, Homo sapiens
  source 1..203: mol_type = other DNA
ggcgcgccagtcctcaggttagctattatgacaggtgttgataatgatgggactgccatttggaaacgccctgaaggcatggatgttggcagactcccattaaattatgttccagggccagctctaatgatgccaacagacacccaaattagaaacacaactttcagagatcctgtggctattggaaacgactcggaccgatg

SEQ ID NO: 7206 - DNA, 203 bp, Homo sapiens
  source 1..203: mol_type = other DNA
ggcgcgccagtccttcctgctacaagtgacaggtatagtgtagctcctttagtccatcaaccatggtctgtccgtacagaagaatggctagcaaacaaaacagactatgctgttcataattatttaggaggtgttgcatacactagaagaaagcatgaagagtcttatgataaacatgaggaggaccgcgactcggaccgatg

SEQ ID NO: 7207 - DNA, 203 bp, Homo sapiens
  source 1..203: mol_type = other DNA
ggcgcgccagtccttgctgtttggaacccaaatcctttatcatatgattgccaaatatggactaaaattcctaatacagaatgtcatttttttgctcaatatcctcttttgggaggttggggagttcttactcctcctccaatgatttttgtgaagctcaggtcacaaccaggccctcctagtccaggcgactcggaccgatg

SEQ ID NO: 7208 - DNA, 203 bp, Homo sapiens
  source 1..203: mol_type = other DNA
ggcgcgccagtcctccaagaagtacagttctaagacgaaccgcggcacgaaacgtgcgccgcgcgatcaggaggttgggacgggtgcgcaagaaagtactcgtaatgacgttgcttggtatgctcgttatcctcatattttggaggaagctacgcgcctgccttttgcttatcctattgggcagtattcgactcggaccgatg

SEQ ID NO: 7209 - DNA, 203 bp, Homo sapiens
  source 1..203: mol_type = other DNA
ggcgcgccagtcctatgatactggatactctgttgcaagcgctactgagtggtctaagtacgtagatactagcctgaccattcctggtgtgatgtgtgttaactttacacccaccccgggtgaatcttataataagaattcacctatcaatatagctgcacagaatgtctacacgtatgtgcggcacacgactcggaccgatg

SEQ ID NO: 7210 - DNA, 203 bp, Homo sapiens
  source 1..203: mol_type = other DNA
ggcgcgccagtcctctgaagatgttttcgctaaccaggcgcaatgggaatacttcgtcaacatggtggcatacagggctggagcgttcgctgctcctgcaagtatgacttattatgagcgtcacgcgtggatgtccaatggtctgtacgtggatcaagatgtcacacgagctcaaatctacatgttcacgactcggaccgatg

SEQ ID NO: 7211 - DNA, 203 bp, Homo sapiens
  source 1..203: mol_type = other DNA
ggcgcgccagtccttctttaaggcgttcggtgctgatggtctggttaaactgctggctgttgacagcactaccatgacattgcccacatacgatcccctcatcctggctcaaattcatagtgctagggctgtgggcgcacctatcctggaaacttccactcttactggtttcccaggccgtcagtggccgactcggaccgatg

SEQ ID NO: 7212 - DNA, 203 bp, Homo sapiens
  source 1..203: mol_type = other DNA
ggcgcgccagtcctattgctcaggagtcgtttggtccctttgctcagctgaatgattggaccatccttacgggtgaaactctggctcggatgcatgaagtatgtgtcaccagcatgttcgatgttcctcagatgggcttcaacaaataaatgttggcctggggtgtgtgtgcgttaagcacacacctccgactcggaccgatg

SEQ ID NO: 7213 - DNA, 203 bp, Homo sapiens
  source 1..203: mol_type = other DNA
ggcgcgccagtcctgtagtgtggatgtttcctttcgctgttaatattcgtgagctgcaggtctatcaaccactaatccttacgttccaaagattgggattggtgccagcgtgggttagcatggaagctgttgataggcgtatcactaagatgtttgatacaaaaggaccacgtgatgtggtggtctgtcgactcggaccgatg

SEQ ID NO: 7214 - DNA, 203 bp, Homo sapiens
  source 1..203: mol_type = other DNA
ggcgcgccagtcctacagacttctccaagttcgaccagcattttaatccaacgtgccagagtgtagccaaagagctgttggctgatctgcttacaggtcaggaagccgtcgactggttagaacgtgtgttcccaattaaatatgctatacccttagcttataattggggtgaaatcaggtatggtatccgactcggaccgatg

SEQ ID NO: 7215 - DNA, 203 bp, Homo sapiens
  source 1..203: mol_type = other DNA
ggcgcgccagtcctcatggaatgggatcgggttctggcggcactaacgccgatgagacgttggtgcatagggtgctgcaacacgaagcagcgattagccaccataccactcttaacccaaattcgcagtgtctgggtgacgatggcgttttaacttacccaggtatatctgcggaggatgtaatgcaacgactcggaccgatg

SEQ ID NO: 7216 - DNA, 203 bp, Homo sapiens
  source 1..203: mol_type = other DNA
ggcgcgccagtccttcatactcgcgccacggtctcgatatgaacctagagaaacagtatgtgagcaaacaagactgcacatatttacgcaggtggcatcatacagattatcgcgtagacggcatgtgtgtgggagtgtactcaaccatgcgggcgttaggcaggttggctatgcaagagcgctactatcgactcggaccgatg

SEQ ID NO: 7217 - DNA, 203 bp, Homo sapiens
  source 1..203: mol_type = other DNA
ggcgcgccagtcctgacccagacgtatggggtgagaagatggtcaccctacgttatctatccatcattgagaatgtgaagtatcatcctctaaaggaagagttcctggacttttgcatcaaaggggataaaactagacttggactaggaatcccaggctttctggacaacatcgctggtgaggcccagcgactcggaccgatg

SEQ ID NO: 7218 - DNA, 203 bp, Homo sapiens
  source 1..203: mol_type = other DNA
ggcgcgccagtccttatcgacatgatgccagatttccttggctacaccaagtcgttgcagtatgatggtgatctgcgacgtaatgctgctgccggtattgaaaactggtgggttgttcaagcattgaaatcgagacgctgacgatcgagatggtgcagcaaaccattgggactaacagtcccaactgccgactcggaccgatg

SEQ ID NO: 7219 - DNA, 203 bp, Homo sapiens
  source 1..203: mol_type = other DNA
ggcgcgccagtcctgaaaaggggaaatggacaacgaacacagagactggagcaccccaactcaatccgattgatggaccactacctgaggataatgagccgagtgggtatgcacaaacagattgtgtattggaagcaatggctttccttgaagaatcccacccagggatctttgaaaactcgtgtcttcgactcggaccgatg

SEQ ID NO: 7220 - DNA, 203 bp, Homo sapiens
  source 1..203: mol_type = other DNA
ggcgcgccagtcctaacacaatgacaaaagacgcagaaagaggcaaattgaagaggcgggcaattgcaacacccgggatgcaaatcagaggattcgtgtactttgtcgaaacactagcgaggagtatctgtgagaaacttgagcaatctggactccccgtcggagggaatgaaaagaaggctaaattgcgactcggaccgatg

SEQ ID NO: 7221 - DNA, 203 bp, Homo sapiens
  source 1..203: mol_type = other DNA
ggcgcgccagtcctggcacagcctcattgagtcctggaatgatgatgggcatgttcaatatgctgagtacagtcttaggagtttcaatcctgaatcttgggcagaagaggtacaccaaaaccacatactggtgggacggactccaatcctctgatgatttcgctctcatagtgaatgcaccaaatcatcgactcggaccgatg

SEQ ID NO: 7222 - DNA, 203 bp, Homo sapiens
  source 1..203: mol_type = other DNA
ggcgcgccagtcctgagggaatagaagcaggggtggataggttctataggacttgcaaactagttggaatcaatatgaccaagaagaagtcttacataaatcggacaggaacatgtgaattcacaagcttcttctaccgctatgggttcgtagccaacttcagtatggagctgcccagctttggagtgcgactcggaccgatg

SEQ ID NO: 7223 - DNA, 203 bp, Homo sapiens
  source 1..203: mol_type = other DNA
ggcgcgccagtccttcattcgagctgaagaagctgtgggagcagacccgctcaaaggcaggactgttggtttcagatggaggaccaaacccatacaatatccggaatctccacattccggaggctggcttgaagtgggaattgatggatgaagactaccagggcagactgtgtaatcctctgaacccgcgactcggaccgatg

SEQ ID NO: 7224 - DNA, 203 bp, Homo sapiens
  source 1..203: mol_type = other DNA
ggcgcgccagtcctttgctgatggatgcccttaaattaagcatcgaagacccgagtcatgagggggaggggataccgctatatgatgcaatcaaatgcatgaaaacatttttcggctggaaagagcccaacattgtaaaaccacatgaaaaaggcataaaccccaattacctcctggcttggaagcagcgactcggaccgatg

SEQ ID NO: 7225 - DNA, 203 bp, Homo sapiens
  source 1..203: mol_type = other DNA
ggcgcgccagtcctggctccatcgggaaggtgtgcagaaccttactggctaaatctgttttcaacagtctatatgcatctccacaactcgaggggttttcagctgaatcaagaaaattgcttctcattgttcaggcacttagggacaacctggaacctggaaccttcgatcttggggggctatatgaacgactcggaccgatg

SEQ ID NO: 7226 - DNA, 203 bp, Homo sapiens
  source 1..203: mol_type = other DNA
ggcgcgccagtcctgcatatgagagaatgtgcaacatcctcaaagggaaattccaaacagcagcacaaagagcaatgatggatcaggtacgggaaagcagaaatcctgggaatgctgagattgaagatctcatatttctggcacggtctgcactcatcctgagaggatcagtggcccacaagtcctgccgactcggaccgatg

SEQ ID NO: 7227 - DNA, 203 bp, Homo sapiens
  source 1..203: mol_type = other DNA
ggcgcgccagtcctgggcatatggagtaaaagggttttcatttaaatacggcaatggtgtttggatcgggagaaccaaaagcactaattccaggagcggctttgaaatgatttgggatccaaatgggtggactggaacggacagtagcttctcggtgaaacaagatatcgtagcaataactgattggtcgactcggaccgatg

SEQ ID NO: 7228 - DNA, 203 bp, Homo sapiens
  source 1..203: mol_type = other DNA
ggcgcgccagtccttctgggttgagctaatcagagggcggcccaaagagagcacaatttggactagtgggagcagcatatctttttgtggtgtaaatagtgacactgtgggttggtcttggccagacgatgccgagttgccattcaccattgacaagtagtttgttcaaaaaactccttgtttctactcgactcggaccgatg

SEQ ID NO: 7229 - DNA, 203 bp, Homo sapiens
  source 1..203: mol_type = other DNA
ggcgcgccagtcctagaagaaaaaagagaggactatttggagctatagcaggttttatagagggaggatggcagggaatggtagatggttggtatgggtaccaccatagcaatgagcaggggagtggatacgctgcagacaaagaatccactcaaaaggcaatagatggagtcaccaataaggtcaaccgactcggaccgatg

SEQ ID NO: 7230 - DNA, 203 bp, Homo sapiens
  source 1..203: mol_type = other DNA
ggcgcgccagtcctgactcaaatgtcaagaacctttatgacaaggtccgactacagcttagggataatgcaaaggagctgggtaatggttgtttcgagttctatcacaaatgtgataatgaatgtatggaaagtgtaaaaaacggaacgtatgactacccgcagtattcagaagaagcaagactaaaccgactcggaccgatg

SEQ ID NO: 7231 - DNA, 203 bp, Homo sapiens
  source 1..203: mol_type = other DNA
ggcgcgccagtcctattccatggggctaaggaggtcgcactcagctactcaaccggtgcacttgccagttgtatgggtctcatatacaacaggatgggaacggtgaccacagaagtggcttttggcctagtgtgtgccacttgtgagcagattgcagattcacagcatcggtctcacagacagatggccgactcggaccgatg

SEQ ID NO: 7232 - DNA, 203 bp, Homo sapiens
  source 1..203: mol_type = other DNA
ggcgcgccagtcctcttcaaatgcatttatcgtcgccttaaatacggtttgaaaagagggccttctacggaaggggtacctgagtctatgagggaagagtatcggcaggaacagcagagtgctgtggatgttgacgatggtcattttgtcaacatagagctggagtaaaaaactaccttgtttctactcgactcggaccgatg

SEQ ID NO: 7233 - DNA, 203 bp, Homo sapiens
  source 1..203: mol_type = other DNA
ggcgcgccagtcctaaattgaagtcactaatgctactgaactggttcagagttcctcaacaggtggaatatgcgacagtcctcatcagatccttgatggagaaaactgcacactaatagatgctctattgggagaccctcagtgtgatggcttccaaaataagaaatgggacctttttgttgaacgcacgactcggaccgatg

SEQ ID NO: 7234 - DNA, 203 bp, Homo sapiens
  source 1..203: mol_type = other DNA
ggcgcgccagtccttaccagagaaacaaactagaggcatatttggcgcaatcgcgggtttcatagaaaatggttgggagggaatggtagacggttggtacggtttcaggcatcaaaattctgagggaacaggacaagcagcagatctcaaaagcactcaagcagcaatcaaccaaatcaatgggaagccgactcggaccgatg

SEQ ID NO: 7235 - DNA, 203 bp, Homo sapiens
  source 1..203: mol_type = other DNA
ggcgcgccagtccttaactgactcagaaatgaacaaactgtttgaaagaacaaagaagcaactgagggaaaatgctgaggatatgggcaatggttgtttcaaaatataccacaaatgtgacaatgcctgcatagggtcaatcagaaatggaacttatgaccatgatgtatacagagatgaagcattaacgactcggaccgatg

SEQ ID NO: 7236 - DNA, 203 bp, Homo sapiens
  source 1..203: mol_type = other DNA
ggcgcgccagtccttggtggggacatctgggtgacaagagaaccttatgtgtcatgcgaccctgacaagtgttaccaatttgcccttggacagggaacaacactaaacaacgtgcattcaaatgacacagtacatgataggaccccttatcggaccctattgatgaatgaattaggtgttccatttcacgactcggaccgatg

SEQ ID NO: 7237 - DNA, 203 bp, Homo sapiens
  source 1..203: mol_type = other DNA
ggcgcgccagtcctggagtcagaatgcgtttgtatcaatggaacttgtacagtagtaatgactgatgggagtgcttcaggaaaagctgatactaaaatactattcattgaggaggggaaaatcattcatactagcacattgtcaggaagtgctcagcatgtcgaggagtgctcctgctatcctcgatacgactcggaccgatg

SEQ ID NO: 7238 - DNA, 203 bp, Homo sapiens
  source 1..203: mol_type = other DNA
ggcgcgccagtccttgccttgagaattttagagcctatgtggatggattcgaaccgaacggctgcattgagggcaagctttctcaaatgtccaaagaagtgaatgccaaaattgaaccttttctgaagacaacaccaagaccaatcaaacttcctaatggacctccttgttatcagcggtccaaattccgactcggaccgatg

SEQ ID NO: 7239 - DNA, 203 bp, Homo sapiens
  source 1..203: mol_type = other DNA
ggcgcgccagtcctgtattgtcagaattgcaggacattgaaaatgaggagaagatcccaaggactaaaaacatgaagaaaacgagtcaactaaagtgggctcttggtgaaaacatggcaccagagaaagtagactttgacaactgcagagacataagcgatttgaagcaatatgatagtgacgaacctcgactcggaccgatg

SEQ ID NO: 7240 - DNA, 203 bp, Homo sapiens
  source 1..203: mol_type = other DNA
ggcgcgccagtcctgagaaggggaagtggacgacaaatacagaaactggggcaccccaactcaacccaattgatggaccactacctgaggataatgagccaagtggatatgcacaaacagactgtgtcctggaggctatggccttccttgaagaatcccacccaggtatctttgagaactcatgccttcgactcggaccgatg

SEQ ID NO: 7241 - DNA, 203 bp, Homo sapiens
  source 1..203: mol_type = other DNA
ggcgcgccagtcctggcacagcatcattgagccctgggatgatgatgggcatgttcaacatgctaagtacggttttaggagtctcggtactgaatcttgggcaaaagaaatacaccaagacaacatactggtgggatgggctccaatcctccgacgattttgccctcatagtgaatgcaccaaatcatcgactcggaccgatg

SEQ ID NO: 7242 - DNA, 203 bp, Homo sapiens
  source 1..203: mol_type = other DNA
ggcgcgccagtccttaccaaaagtgctgcaacttgttcgagaaatttttccctagtagttcatataggagaccgattggaatttctagcatggtggaggccatggtgtctagggcccggattgatgccagaattgacttcgagtctggacggattaagaaggaagagttctctgagatcatgaagatccgactcggaccgatg

SEQ ID NO: 7243 - DNA, 203 bp, Homo sapiens
  source 1..203: mol_type = other DNA
ggcgcgccagtcctgttgtttttcccaatgaagtgggagccaggatactaacatcagaatcgcaattaacaataactaaagagaaaaaagaagaactccgagattgcaaaatttctcccttgatggttgcatacatgttagagagagaacttgtccgaaaaacaagatttctcccagttgctggcggacgactcggaccgatg

SEQ ID NO: 7244 - DNA, 203 bp, Homo sapiens
  source 1..203: mol_type = other DNA
ggcgcgccagtcctagtgtgatgggaatggttggagtattaccagatatgactccaagcacagagatgtcaatgagaggaataagagtcagcaaaatgggtgtggatgaatactccagtacagagagggtggtggttagcattgatcggtttttgagagttcgagaccaacgcgggaatgtattattgcgactcggaccgatg

SEQ ID NO: 7245 - DNA, 203 bp, Homo sapiens
  source 1..203: mol_type = other DNA
ggcgcgccagtccttccgccgtcttgagagggtttctcattataggtaaggaagacagaagatacggaccagcattaagcatcaatgaactgagtaaccttgcaaaaggggaaaaggctaatgtgctaatcgggcaaggagacgtggtgttggtaatgaaacgaaaacgggactctagcatacttactcgactcggaccgatg

SEQ ID NO: 7246 - DNA, 203 bp, Homo sapiens
  source 1..203: mol_type = other DNA
ggcgcgccagtcctagggatcatgaagacagaaggaacacttgagaactgtgaaaccaaatgccaaactcctttgggagcaataaatacaacactaccttttcacaatgtccacccactgacaataggtgaatgccccaaatatgtaaaatcggagaaattggtcttagcaacaggactaaggaatgtcgactcggaccgatg

SEQ ID NO: 7247 - DNA, 203 bp, Homo sapiens
  source 1..203: mol_type = other DNA
ggcgcgccagtcctcagcatgggggtttatcaaatccttgccatttatgctacagtagcaggttctctgtcactggcaatcatgatggctgggatctctttctggatgtgctccaacgggtctctgcagtgcagaatctgcatatgattgtaagtcattttataattaaaaacacccttgtttcctgacgactcggaccgatg

SEQ ID NO: 7248 - DNA, 203 bp, Homo sapiens
  source 1..203: mol_type = other DNA
ggcgcgccagtccttttcaaatgcatttatcgcttctttaaacacggtctgaaaagagggccttctacggaaggagtacctgagtctatgagggaagaatatcgaaaggaacagcagagtgctgtggatgctgacgatagtcattttgtcagcatagagctggagtaaaaaactaccttgtttctactcgactcggaccgatg

SEQ ID NO: 7249 - DNA, 203 bp, Homo sapiens
  source 1..203: mol_type = other DNA
ggcgcgccagtcctgtacccttgcaaaaggagaaaaggctaatgtactaattgggcaaggagacgtggtgttggtaatgaaacgaaaacgggactctagcatacttactgacagccagacagcgaccaaaagaattcggatggccatcaattaatgttgaatagtttaaaaacgaccttgtttctactcgactcggaccgatg

SEQ ID NO: 7250 - DNA, 203 bp, Homo sapiens
  source 1..203: mol_type = other DNA
ggcgcgccagtcctaacagcttaacaatagagagaatggtgctctctgcttttgacgagagaaggaataaatatctggaagaacatcccagcgcggggaaggatcctaagaaaactggaggacccatatacaagagagtagatggaaagtggatgagggaactcgtcctttatgacaaagaagaaatacgactcggaccgatg

SEQ ID NO: 7251 - DNA, 203 bp, Homo sapiens
  source 1..203: mol_type = other DNA
ggcgcgccagtcctaggcgaatctggcgccaagccaataatggtgatgatgcaacagctgggctgactcacatgatgatctggcattccaatttgaatgatacaacataccagaggacaagagctcttgttcgcaccggaatggatcccaggatgtgctctttgatgcagggttcgactctccctaggcgactcggaccgatg

SEQ ID NO: 7252 - DNA, 203 bp, Homo sapiens
  source 1..203: mol_type = other DNA
ggcgcgccagtcctgctgcacaaagagcaatgatggatcaagtgagagaaagccggaacccaggaaatgctgagatcgaagatctaatctttctggcacggtctgcactcatattgagagggtcagttgctcacaaatcttgtctgcccgcctgtgtgtatggacctgccatagccagtgggtacaaccgactcggaccgatg

SEQ ID NO: 7253 - DNA, 203 bp, Homo sapiens
  source 1..203: mol_type = other DNA
ggcgcgccagtccttgtgtagcatggtccagctcaagttgtcacgatggaaaagcatggttgcatgtttgtgtcactggggatgataaaaatgcaactgctagcttcatttatgacgggaggcttatggacagtattggttcatggtctcaaaatatcctcaggacccaggagtcggaatgcgtttgtcgactcggaccgatg

SEQ ID NO: 7254 - DNA, 203 bp, Homo sapiens
  source 1..203: mol_type = other DNA
ggcgcgccagtcctatcaatgggacttgcacagtagtaatgactgatggaagtgcttcaggaagagccgatactagaatactattcattgaagaggggaaaattgtccatattagcccattgtcaggaagtgctcagcatgtagaggagtgttcctgttatcctcgatatcctgacgtcagatgtatccgactcggaccgatg

SEQ ID NO: 7255 - DNA, 203 bp, Homo sapiens
  source 1..203: mol_type = other DNA
ggcgcgccagtccttctggtattttctctgttgagggcaaaagatgcatcaataggtgcttttatgtggagttgataaggggaaggcaacaggagactagagtatggtggacctcaaacagtattgttgtgttttgtggcacttcaggtacttatggaacaggctcatggcctgatggggcgaacatccgactcggaccgatg

SEQ ID NO: 7256 - DNA, 203 bp, Homo sapiens
  source 1..203: mol_type = other DNA
ggcgcgccagtcctgaagaattggaatgtataatagatgcatttgaaaaaggaaaagatatcaccattgatttagacgctatgaacggtgaagttaaattagatggaaattcatgttcatataattcaactgctgctcttgtttcgactattttgggtacacctattaaaatgtataatgaatctggacgactcggaccgatg

SEQ ID NO: 7257 - DNA, 203 bp, Homo sapiens
  source 1..203: mol_type = other DNA
ggcgcgccagtcctatacctgatttaactgaactggtggatgctgaaaagcaaataaaagaaatggctgcacatttacaactagaggctattacggtacaggttgaatcacaatttttagcaggaattagtgctgctgcagctaatgaagcgtttaaatttataattggctcagttttatctaccagacgactcggaccgatg

SEQ ID NO: 7258 - DNA, 203 bp, Homo sapiens
  source 1..203: mol_type = other DNA
ggcgcgccagtccttcaacaatgttagtggctctatcatctcagcctttcgctacatatcctttagactataaaagatctgtacaaagagcgttacaacttttatcaaatagaacagctcaaatagcagatttaaccagattaatagtatacaattatactacattatctgcttgtatagttatgaatcgactcggaccgatg

SEQ ID NO: 7259 - DNA, 203 bp, Homo sapiens
  source 1..203: mol_type = other DNA
ggcgcgccagtcctgagaagaccggtgactattcagctataacgaatgcattacttcgggatactccaatcatattgaaaggtgcgattccatatgttactaactcatcagtaattgatgttttatctaaagtggacaccacagtgttcgcaagcattgtaaaagatagggacatttcaaagttaaaacgactcggaccgatg

SEQ ID NO: 7260 - DNA, 203 bp, Homo sapiens
  source 1..203: mol_type = other DNA
ggcgcgccagtccttgtcagatgctgtatatgatcagattactgtaacgtatagcgataatgtcaatatggaaatgtataaagaatattctgaacgtatagagaatgaaatatttaccattttaaaagataaaataatacatgaagataaaagattagaagaatacgaattatcagcgttactatcaacgactcggaccgatg

SEQ ID NO: 7261 - DNA, 203 bp, Homo sapiens
  source 1..203: mol_type = other DNA
ggcgcgccagtcctgacgtagaacaagagctatttttatattaccatatcagtattttatcgctcaacattcatttgctgaaataatgcttaactatgcaaaacgtgaaagagagtattcagagttttattctcaagcaaatcaagtattatcgtatggagatgtaactagatatcttgattcaaatacgactcggaccgatg

SEQ ID NO: 7262 - DNA, 203 bp, Homo sapiens
  source 1..203: mol_type = other DNA
ggcgcgccagtcctaattgcatctgtgaagagaatggtaatgtagataagctagagggctaaacatcttctatgcggcctacataccatgtagcatgaatcacgactgggtttagtccatgcttgcataggggcaaatatgcatgatatggatgatccccagaaggatgaaatgtgaactatgtggctcgactcggaccgatg

SEQ ID NO: 7263 - DNA, 203 bp, Homo sapiens
  source 1..203: mol_type = other DNA
ggcgcgccagtcctatgacagcaatggatggagagatacctgatggatattgtgtacattctcctacaacataccgaaaaagtgaatactatttactcattgataaacatatcattaaaagacaaaaaataaaagttactaaatccttaatgtataatgccataaatactatatactcagataatgtacgactcggaccgatg

SEQ ID NO: 7264 - DNA, 203 bp, Homo sapiens
  source 1..203: mol_type = other DNA
ggcgcgccagtcctttaaacgtgacctcggatccatgctagacaccatcaaccggcggccaagcaagaagagaggagggaccagatcgttgctcggattggctgcgctaattggactggcgagttcattgcagttatcaacctatcaggggaaagtgttaatgtcaatcaacaagactgacgctcaaacgactcggaccgatg

SEQ ID NO: 7265 - DNA, 203 bp, Homo sapiens
  source 1..203: mol_type = other DNA
ggcgcgccagtcctgcgccataaacattcctagtgccaacggagcaaacacttgcattgtgagggctctagatgtgggggtcatgtgcaaagatgacatcacatacctgtgcccagtgctttcagcgggaaatgatcccgaggacattgactgttggtgtgacgtcgaagaggtgtgggtgcactacgcgactcggaccgatg

SEQ ID NO: 7266 - DNA, 203 bp, Homo sapiens
  source 1..203: mol_type = other DNA
ggcgcgccagtcctgaagctgtgttacagtgatggcaccagagaaaccaacactggacttcaaggtgatgaagatggaggctaccgagttagccactgtgcgtgagtattgttacgaagcaaccttggacacgctgtcaacagtggcaaggtgccctacaacaggagaggctcacaacaccaaaaggacgactcggaccgatg

SEQ ID NO: 7267 - DNA, 203 bp, Homo sapiens
  source 1..203: mol_type = other DNA
ggcgcgccagtcctgtgacccaacatttgtctgcaaaagagatgttgtggaccgcggatggggtaacggatgtggcctgtttggaaaagggagcattgacacatgcgctaagttcacatgcaaaaacaaggcaacagggaagacgatcttgagagaaaacatcaagtatgaggttgcaatttttgtgccgactcggaccgatg

SEQ ID NO: 7268 - DNA, 203 bp, Homo sapiens
  source 1..203: mol_type = other DNA
ggcgcgccagtcctatgtcttcactgtcaaggagaagtcatggctagtgaacagggactggtttcacgacttgaaccttccatggacgagccctgccacaactgattggcgcaacagagaaacactggtggaatttgaggaaccgcatgccaccaagcaaactgtagtagccctaggatcgcaagaagcgactcggaccgatg

SEQ ID NO: 7269 - DNA, 203 bp, Homo sapiens
  source 1..203: mol_type = other DNA
ggcgcgccagtcctgtgccctgcacacagcattggctggagctattccagccactgttagcagctcaaccctaaccttgcaatcagggcatctgaaatgcagagctaagcttgacaaggtcaaaatcaagggaacgacatatggcatgtgtgattctgccttcaccttcagcaagaacccaactgacacgactcggaccgatg

SEQ ID NO: 7270 - DNA, 203 bp, Homo sapiens
  source 1..203: mol_type = other DNA
ggcgcgccagtcctcagggcacgggacagtgattgtggaactgcagtatactggaagcaacggaccctgccgagttcccatctccgtgactgcaaacctcatggatttgacaccggttggaagactggtcacggtcaatccttttataagcacagggggagcgaacaacaaggtcatgatcgaagttgcgactcggaccgatg

SEQ ID NO: 7271 - DNA, 203 bp, Homo sapiens
  source 1..203: mol_type = other DNA
ggcgcgccagtcctaaccaccctttggcgattcttacatcgtcgtcggaagaggcaccacccagattaactaccactggcacaaagaaggaagcagcattggtaaggctttggcgaccacatggaaaggagcccaacggctagccgtcttaggggacacagcgtgggactttggatctattggaggagcgactcggaccgatg

SEQ ID NO: 7272 - DNA, 203 bp, Homo sapiens
  source 1..203: mol_type = other DNA
ggcgcgccagtcctctcgattgtggctcacaatccgggaggaaaacacaacggaatgcgattcggcaatcatcggcacagctataaaaggagacagagctgttcacagtgacctatcgtattggattgagagcaaaaagaatgagacatggcaactggaacgagccgtcatgggagaagtgaaatcttcgactcggaccgatg

SEQ ID NO: 7273 - DNA, 203 bp, Homo sapiens
  source 1..203: mol_type = other DNA
ggcgcgccagtcctcaggaacaacagtcaccgttactgaacattgtggaaacaggggagcgtcgctgcgcacaaccacagcgagtggcaagctggtcactgattggtgttgcaggagctgttccttgccaccactgcgatacaccacaaaagatggatgctggtatggaatggaaatccggccggtgacgactcggaccgatg

SEQ ID NO: 7274 - DNA, 203 bp, Homo sapiens
  source 1..203: mol_type = other DNA
ggcgcgccagtcctaggaggaggaagcaaagcttgtgaaatctcgagtgacagctggagttgcaggagggatggaaccattccaacttggtctcctggtagcattcatagccacacaagaagtgctgaaacgcagatggactgggaagctgaccctgacctcactagcagtatgtttggcactgttgacgactcggaccgatg

SEQ ID NO: 7275 - DNA, 203 bp, Homo sapiens
  source 1..203: mol_type = other DNA
ggcgcgccagtcctaaaacatcttgatggttattggagcagcttttctccaaatggcggccaatgacttgaagcttgaggtccttccgatactcaacgccatgtccattgcgtggatgctgataagggcaatgaaagaaggtaaagtggcgatgtacgctcttcccatcttgtgtgctttgactccagcgactcggaccgatg

SEQ ID NO: 7276 - DNA, 203 bp, Homo sapiens
  source 1..203: mol_type = other DNA
ggcgcgccagtcctgaatgaggatggctgggcttgatgtcatcagatgtttgttgttgataattgggattgtaacacttctgaatgaaagaagagaaagtgtggccaagaaaaaaggcggctacttgctcgcagcggccctctgccaagctggagtgtgcagtcccttgattatgatgggaggcttaacgactcggaccgatg

SEQ ID NO: 7277 - DNA, 203 bp, Homo sapiens
  source 1..203: mol_type = other DNA
ggcgcgccagtcctgtgcacgattccattggttcattccattcggagtactggggttttggctacttggcaaacactcgaagcgaggaggagcattgtgggacgtgccgtcaccaaaagtgtatccaaagtgtgagacaaaaccaggaatctatcgaatcatgactagaggaattttgggcactttcccgactcggaccgatg

SEQ ID NO: 7278 - DNA, 203 bp, Homo sapiens
  source 1..203: mol_type = other DNA
ggcgcgccagtcctcttttccagattcaaattctcccatactggatgttgaggcccaggttccggataaggcgtggagcaccgggtatgagtggatcaccaacttcacagggaggactgtgtggtttgttcccagtgtgaaaagtgggaacgaaattgccatctgcctacaaaaagcaggaaagcgagcgactcggaccgatg

SEQ ID NO: 7279 - DNA, 203 bp, Homo sapiens
  source 1..203: mol_type = other DNA
ggcgcgccagtccttcatcctcaatggacccatggcaatcacatcagcgagcgcagcacagcgcagaggccgcattggaagaaatccttcgcagattggagatgagtaccattatgggggtgcaaccaatgaggacgaccatgatctggccaactggactgaagcaaagattctccttgacaacatatcgactcggaccgatg

SEQ ID NO: 7280 - DNA, 203 bp, Homo sapiens
  source 1..203: mol_type = other DNA
ggcgcgccagtcctacctcccaaacggactggtggcacaaatgtaccagcccgagcgagataaggttttcaccatggatggggagtttcgattgcgtggagaagaaaggaagaactttgttgagctgatgcgcaacggtgacctcccagtgtggttagcttacaaagtagcctctaatggacacagttcgactcggaccgatg

SEQ ID NO: 7281 - DNA, 203 bp, Homo sapiens
  source 1..203: mol_type = other DNA
ggcgcgccagtcctaccaagaccgctcatggtgttttacaggacaaaccaacaacacaatcctggaagacaacaacgaagttgaagttttcaccaaaactggagacaggaaaattctcaggccaaagtggatggatgcgcgggtctgctgcgactaccaagcgctcaagtcatttaaagagtttgcagcgactcggaccgatg

SEQ ID NO: 7282 - DNA, 203 bp, Homo sapiens
  source 1..203: mol_type = other DNA
ggcgcgccagtcctcagggaagagatcagcgctgggcatgatggaggtcatgggtagaatgccaaatcacttctgggaaaagacagttgccgctgcagacacactgtatctcctaggaaccagtgaggcaaacagtagggcacacaaagaggcactggcagaactgccagattccctggaaacgcttccgactcggaccgatg

SEQ ID NO: 7283 - DNA, 203 bp, Homo sapiens
  source 1..203: mol_type = other DNA
ggcgcgccagtcctgtgtactattaggtttgaccaatggaatgccattcactgctatggatctatcggtgccattattggtgctagggtgttggaatcagatgaccctgccaagtttggccgttgcagtgatgcttttggctatccactatgcattcatgatcccaggctggcaggctgaagcaatgacgactcggaccgatg

SEQ ID NO: 7284 - DNA, 203 bp, Homo sapiens
  source 1..203: mol_type = other DNA
ggcgcgccagtcctccaagggaaagcgtggaggaggaaaaggagccactcttggagagatctggaagtcaagactgaatcagttgacacgagccgaattcatggcatacaggaaagatggaatcgtggaagtagacagagcccccgccaggaaagccaggagagaagggcgtctcacaggtggccacccgactcggaccgatg

SEQ ID NO: 7285 - DNA, 203 bp, Homo sapiens
  source 1..203: mol_type = other DNA
ggcgcgccagtcctcagtgtccagagggtcagcaaaattaagatggataacagaaagaggattcgtcaaacccatgggaaaggttgttgacttaggctgtggacgaggagggtggagctactactgcgcaaccctgaagcatgttcaagaagtgaaaggattcacaaagggcggaccaggccatgaagcgactcggaccgatg

SEQ ID NO: 7286 - DNA, 203 bp, Homo sapiens
  source 1..203: mol_type = other DNA
ggcgcgccagtcctgccataaggtggtgaaagtcatgagaccagggcctgatggtaaaacctacatggatgtcatctccagagaagaccaaaggggcagtggacaggtggtcacatatgccctgaacaccttcaccaacctggccgttcaactgataagatgcatggaggctgaaggggtggtagatgcgactcggaccgatg

SEQ ID NO: 7287 - DNA, 203 bp, Homo sapiens
  source 1..203: mol_type = other DNA
ggcgcgccagtcctaggatgacattacgagagtgagacttggacggttggccaaagcggtcgagtggctgaggaagaatggacctgaacgattgagcagaatggcagtgagtggggacgactgtgttgtgaaaccaattgatgacagatttgccactgcactccactttctcaacaacatgtcaaagacgactcggaccgatg

SEQ ID NO: 7288 - DNA, 203 bp, Homo sapiens
  source 1..203: mol_type = other DNA
ggcgcgccagtccttcagaaaggacattcaggagtggaaaccttcaacaggctggcacaactggcaagaggtgcccttctgctcacaccacttcaatgaactaatgctgaaggatgggcggaccatcgtggtgccatgtaggagccaggatgagctgattggcagagccagaatctcaccaggagcagcgactcggaccgatg

SEQ ID NO: 7289 - DNA, 203 bp, Homo sapiens
  source 1..203: mol_type = other DNA
ggcgcgccagtcctctatggcatcttcacaacctcttaagatgaaatttagcgagtatctagaccagcgcatgcaggacagggcaggtgggaaggtacagtggaaagaccataagaaagtgtgggaaaggttaaaattaaggtggacacaagaaggttatttggcagggggagcaccaaccagggttccgactcggaccgatg

SEQ ID NO: 7290 - DNA, 203 bp, Homo sapiens
  source 1..203: mol_type = other DNA
ggcgcgccagtcctagctgagcacaatggaaggagaattaagagagggaaagcagagagcgaaggacagcgaagtggatttgaataggcagcacgtatttaggaaggaagggactaagcagagagaaaaagcagaagaggagctgagaataggcacttgggctatcgaggagaccagaagatttataacgactcggaccgatg

SEQ ID NO: 7291 - DNA, 203 bp, Homo sapiens
  source 1..203: mol_type = other DNA
ggcgcgccagtccttgctaagaactccagcagtgatggggatagccacggacatgaaggagggtggggtccctactatctcaccagccaccccagccgaaaaccaaacccccacccagcgcctctatccagacctgccagaagattccagacccccaccctactccccatcagcctcaccatcacctacgactcggaccgatg

SEQ ID NO: 7292 - DNA, 203 bp, Homo sapiens
  source 1..203: mol_type = other DNA
ggcgcgccagtcctctgtacaagcacctgtattgacagtaagagggggcgtgataaagggagaagtgcacctggtagaaggaacaatagatgtggagaactcggagccgccccaacgctctatggacactgacgatttggggcccgccggagggcggtctaccagaggtcctgactcattggaagaagcgactcggaccgatg

SEQ ID NO: 7293 - DNA, 203 bp, Homo sapiens
  source 1..203: mol_type = other DNA
ggcgcgccagtcctaacaactaccaagtctgcatggaggtgcctcagcgtggctcctacagttgcaaaccctgacctcagggttcagattaggacttggggacatgagagcactgttggctagggcaacagaccacgtgactatgaatgtcataatgaaaacagctggactagatcacctgccaggaccgactcggaccgatg

SEQ ID NO: 7294 - DNA, 203 bp, Homo sapiens
  source 1..203: mol_type = other DNA
ggcgcgccagtcctcacagccaccgtatcaacctccaccacctcccctttcgccacagtacccccaggcttatccggggtatggctatcctcccaggggaccaccacaggcaggaggacattggggatcacgttacatgaataatggtgcctgttacaattgtggacagccggggcatcaagcaagaacgactcggaccgatg

SEQ ID NO: 7295 - DNA, 203 bp, Homo sapiens
  source 1..203: mol_type = other DNA
ggcgcgccagtcctatactccctgggaatgaagatgcccaccaccacctgaggctgaggtccaacgttactctgtatataccgaacccacagtttcatgtcaaatagagggggtgaaccatcgatttctagtggatactggttgcacctactcagccattaagacaatgcaacccttatcaatggattcgactcggaccgatg

SEQ ID NO: 7296 - DNA, 203 bp, Homo sapiens
  source 1..203: mol_type = other DNA
ggcgcgccagtcctcagaagatggggtggaagtctccatcaactctccgaaatctgggagggtgcttctcctaccttcacttccggtcccaccgctgtcgttaacgcaagaagtctactggctaaaatgcacccagactggcccgtccaccccagccatacagtttcaatttaacacctggagaagaccgactcggaccgatg

SEQ ID NO: 7297 - DNA, 203 bp, Homo sapiens
  source 1..203: mol_type = other DNA
ggcgcgccagtcctttatctacgcactccacccatataagacacccctacccgaggttcactgcaccatgaacgttacggatgatgaagataacccatataccgaggactgggatgaaaacatgtcacaccaaactcccagtatccgttgtctgtctattgtatgtggacccgagggtgtggcagcaccgactcggaccgatg

SEQ ID NO: 7298 - DNA, 203 bp, Homo sapiens
  source 1..203: mol_type = other DNA
ggcgcgccagtcctctgtcatcctaccttcacatctcaaaccatggtaccagctggcccctgactcatcaccccacgttactcttgccgtaggaaatgggttcgaagcaagaagcctgggtcctatgatacgacgtgcatctaaacttgattgggtgcccacagcaactcctggaataatgaaggcatcgactcggaccgatg

SEQ ID NO: 7299 - DNA, 203 bp, Homo sapiens
  source 1..203: mol_type = other DNA
ggcgcgccagtcctgactagcagtcccaccggtcagagtgcagcttacccaccaaggccaacttcctgtttaccgatctcaatatcgtttgaagtatgaacagattgaagggatcaggcccaccgtggaaggactgctgggagctgactgcatctatgctaccagctcaccatggaacactcccataccgactcggaccgatg

SEQ ID NO: 7300 - DNA, 203 bp, Homo sapiens
  source 1..203: mol_type = other DNA
ggcgcgccagtccttccctgtccccaaagctgatgggaagacgtaccgaatggttcaagacttccgagctgtcaatgatgtcaccacaggggtggacctcccggtaccagatcctcacgtttctttgagcaatctttcacccaaacaccaatacttcaccgtggtggaccttgccaatgcctttttcacgactcggaccgatg

SEQ ID NO: 7301 - DNA, 203 bp, Homo sapiens
  source 1..203: mol_type = other DNA
ggcgcgccagtccttgtccacagctcaccgtaactcaattttacaccaccccaggcccaccacagtctccggactgctctcattccttggactgactggctacagccgtactcacattcctgattacacctgcagaaccgaaccattgagagaaattgtcaggcaggctggggctaggaatcttcatgcgactcggaccgatg

SEQ ID NO: 7302 - DNA, 203 bp, Homo sapiens
  source 1..203: mol_type = other DNA
ggcgcgccagtccttctcagcggtggcactcccgaaaaaggtggccatcatgaaatgtaaaggccaccaggtattgaactccagaatcagcaagggaaatgatgcagctgaccaagccgcgaagaaggcaggaggatactcacctggacagatggtactcagagtggacccacccagtacggaattgacgactcggaccgatg

SEQ ID NO: 7303 - DNA, 203 bp, Homo sapiens
  source 1..203: mol_type = other DNA
ggcgcgccagtcctcagggacaaaattgacgtgggtggaagccctgcccctggcactgatggccatgaggtcctcaccaggtgcagggacacatctatcaccccatgagataatgacaggccgagtgatgcctgggccgccaagagagggaggtcatatgcccgctcttgatgtccaccagataggaacgactcggaccgatg

SEQ ID NO: 7304 - DNA, 203 bp, Homo sapiens
  source 1..203: mol_type = other DNA
ggcgcgccagtcctcgtacgaagtgaaggaagttacttcacactcagtccaggtcaaaggtaaatcaggcgcaccttggcaccacctgacacattgtacaccagcaccagcacctgacagaacgctgacagaagtcagaagcgacttgatcgcctccaatttggctataaattctgagagccccgacacgactcggaccgatg

SEQ ID NO: 7305 - DNA, 203 bp, Homo sapiens
  source 1..203: mol_type = other DNA
ggcgcgccagtcctgtccagactggtctgattggtctaaagggaatcttgttggaggatggaggaaggtcctaactttatctactactccaacggggttgaaatttgttattcgaccgaaagaaagcctaggctgtagtcagtttgtactggctccatatgtgtctaactcattagattggagtttgccgactcggaccgatg

SEQ ID NO: 7306 - DNA, 203 bp, Homo sapiens
  source 1..203: mol_type = other DNA
ggcgcgccagtcctcggcctccgatggtagtttgacacatgccctagatggccttaggactctgaatggtaaaatgaagtcacactccggtattgactcctcttcctgggacaattggatggatgtgtttgggaaatacaaaactttgatttcctccatcctagtctcaatttctgtcttttctgctgcgactcggaccgatg

SEQ ID NO: 7307 - DNA, 203 bp, Homo sapiens
  source 1..203: mol_type = other DNA
ggcgcgccagtcctataatgcactttggactgaaatttcatggcaagacctcctcctcaaggtagtctcacacaaattggaatatttgtcattgtctcaggttcttggaaacaggattttgcgtcgcaaattcaacattcgctctcacatgttgagaatgttgctatcggcgatacgcatggacctggcgactcggaccgatg

SEQ ID NO: 7308 - DNA, 203 bp, Homo sapiens
  source 1..203: mol_type = other DNA
ggcgcgccagtcctaaagagaattgaaacttgaaggaaaagtgcaacagcgaattgatcaagtcaaagcagagaatgcagaagattggagagagtatgacagaggtggacctgtcccttcacgagacagagatacctactgccagattcttttggagaacgaactggaacgactcatgcaatccacctcgactcggaccgatg

SEQ ID NO: 7309 - DNA, 203 bp, Homo sapiens
  source 1..203: mol_type = other DNA
ggcgcgccagtcctttggcttgcgtattcttcagacttctggtttaggagagtatcgcgctgttgtctcacaacagtatgccattttgcgacggcttcacgaccgtcttggactgagaggactgaatgccaaaggacagcgaatggcacccatcataattcagttgtatggagagacaggacaaggaacgactcggaccgatg

SEQ ID NO: 7310 - DNA, 203 bp, Homo sapiens
  source 1..203: mol_type = other DNA
ggcgcgccagtcctaacatcaagattttgctcaggttccaaaccctgagctatttgaaatcattcgagcaggaaacactttcccctatcctttgcatatggctgacattgctgacaaaaacacaacaacttttcagtcacgcattgtcattttgacgaccaaccaaaagaagccaaaagtggaatcctcgactcggaccgatg

SEQ ID NO: 7311 - DNA, 203 bp, Homo sapiens
  source 1..203: mol_type = other DNA
ggcgcgccagtcctaacacaaagttgtgttgaaggctcttggcgttgttgctatggctgttggggtgtataagattggtagtgcacttgctggacttgtttcaaaaagagacactcaacctaaagtgtctgcaagtgcgcaatcaccttatgctccccgacctgtggcgctgcgtcagtcagcctatccgactcggaccgatg

SEQ ID NO: 7312 - DNA, 203 bp, Homo sapiens
  source 1..203: mol_type = other DNA
ggcgcgccagtcctatccgacaacacgggcaacaaaaaccaccatcaacaaaattgtgaaagcgacaggacaagcagcggataatagcgcgcgtgacatcatcacaagcgttatgaaccgaggcatgtactccttgagcgtcgattctcgcgttctagggagtgcaacgttcttaactggaaaaatttcgactcggaccgatg

SEQ ID NO: 7313 - DNA, 203 bp, Homo sapiens
  source 1..203: mol_type = other DNA
ggcgcgccagtcctcgtgtgtttcagcatctggtgtccaacgagtaacgcctggggcaggaccacctgtctatggtgaatacgaaattggagacactcaatatagaacctacacgcgtgactattggagatatgccctcaacactacctacggggactgtggaggactaatcttcttgaacaacaaaacgactcggaccgatg

SEQ ID NO: 7314 - DNA, 203 bp, Homo sapiens
  source 1..203: mol_type = other DNA
ggcgcgccagtccttgagtcaccgtaagattcttggaatgcacgttatgggactttcgcaactagattctggctttgccctctcggtttaccgagaggatgtacaagcttacgttcgactagtacgacaggacgatccttcactggtgacaccctgtgcagagcccatcataacgacagcagtccagtcgactcggaccgatg

SEQ ID NO: 7315 - DNA, 203 bp, Homo sapiens
  source 1..203: mol_type = other DNA
ggcgcgccagtcctgtttgccatttgctggagacttccaccccttgggaaaaagtccgttccctagcacaaatcctggaaagagtaagattgaaaagtcagaactccatcctgacaattgtgctgtggcatggagggaacccgtttctcatcccgcactgttgaaacccatcacagtgaggcctgaggcgactcggaccgatg

SEQ ID NO: 7316 - DNA, 203 bp, Homo sapiens
  source 1..203: mol_type = other DNA
ggcgcgccagtcctacggtattcccttcccaagtggcacgacattcgacccccttcattaccgactggaaaagtgtggacagcgtgcaaaatgtctagaccaacagcttttggacattgtgcgtcgttcatacaccaccgaacttcgacaaattttgcagactcacaagcaccctgagtacaagtcagcgactcggaccgatg

SEQ ID NO: 7317 - DNA, 203 bp, Homo sapiens
  source 1..203: mol_type = other DNA
ggcgcgccagtcctgaattgttttgaatgatctcgccggtgatcttccagaccatcaacgagaacatgatgatattcgttctgtgctgttcctcgaccttgtacattccacccaccttgctcgggatgtcctctattcatggacacattcactcccaagtggtcattttctcacagcaattgtaaattcgactcggaccgatg

SEQ ID NO: 7318 - DNA, 203 bp, Homo sapiens
  source 1..203: mol_type = other DNA
ggcgcgccagtcctctttgtacgtaaatctgatcttcagatatcttcttgcaaaatcttcaaaattgacttcacacatccaaattgaccagctgtgtcgtcggatgaaacttgtttcatacggcgatgaccacattgtctctatcccttctggatacgagaaaattttcaaccaatccactcttccaacgactcggaccgatg

SEQ ID NO: 7319 - DNA, 203 bp, Homo sapiens
  source 1..203: mol_type = other DNA
ggcgcgccagtccttttggcgctcaaaatccctcaacccgcgctctatcacagagagtagcgtagagtgggcttgccatgagctagccctccacgatgagtcaacatttcaggagtggacgaaaaagattgggttagtctgcaaagatgcaattaattttgtgcctaatctgtctgcgcaacgcgtggcgactcggaccgatg

SEQ ID NO: 7320 - DNA, 203 bp, Homo sapiens
  source 1..203: mol_type = other DNA
ggcgcgccagtcctgcgcgaaatcacccacttcacagaggatgaccgcgtactcaccgacgcagtgacagaaattacttcattacccctctctttactacagtatggagacgagccacgagaacatagtgtaatatcctttcttcaaagaccggagaaaatcgctacagtgacgtggactacggctcacgactcggaccgatg

SEQ ID NO: 7321 - DNA, 203 bp, Homo sapiens
  source 1..203: mol_type = other DNA
ggcgcgccagtcctaacaaagacgactaacttggtatccttgccaattccatcgtctgtgttgacgactatgtacagagagaagctgagaggctttggcctgcttcgcgcagacattgtctttaagctgcaattcaactcacagcccttccaagctgggagattgattgcgacatacattccagttcccgactcggaccgatg

SEQ ID NO: 7322 - DNA, 203 bp, Homo sapiens
  source 1..203: mol_type = other DNA
ggcgcgccagtccttgcctatcttttacaaagaacgcgtatggctcgagcaagtctcacaagactgacctcgttacctaacgtgattattgacattagtaagcagactgaatgtaatatcacattaccctacgtaagctcgtttacccactatgatttaacaagtggcggaggagattggggcttgttcgactcggaccgatg

SEQ ID NO: 7323 - DNA, 203 bp, Homo sapiens
  source 1..203: mol_type = other DNA
ggcgcgccagtcctcgacctttgggtctatagtcccctcagtagtgcgtcttctcagacaatcaacatctcaatacgagcctacctcgacaatgtacgcttgggtgcgcccacgcaacaatcgttagtcacagcggaaaagatgctaaaagcaaacgtacagacacgggatttatcccggggtacatccgactcggaccgatg

SEQ ID NO: 7324 - DNA, 203 bp, Homo sapiens
  source 1..203: mol_type = other DNA
ggcgcgccagtccttagttgtggctcgatctcagcgcgcgcccaaggaggaaagcagacagccggctcgggcgatggatccttcggatctctcctgaataagggcacaaaaagtgtcactatgcaggagcgatccgcagggactatctcccgagttggacatagtatacgtgagggccttgtcaggggcgactcggaccgatg

SEQ ID NO: 7325 - DNA, 203 bp, Homo sapiens
  source 1..203: mol_type = other DNA
ggcgcgccagtccttgactatcatagcgtaaggttaaagatcgtctacgatccaatggcgcagtccgctgctgccgtgacgtatgatgcatccgaatactgctactcaatagttgtagatttccgtgacaagactgacatatatgtgcgtttaccattcatttccgcaacaccttggaaattggtacccgactcggaccgatg

SEQ ID NO: 7326 - DNA, 203 bp, Homo sapiens
  source 1..203: mol_type = other DNA
ggcgcgccagtcctgattgtcgacattcgaacagggcctccctatgccaacaacacagtctcagattgcgctttggtggatgttgtaggagcattgtttgcctttagagcgggcgggtttcgatggaaagcctgggactccggttctgagctcatatcagcctatctcgttccttttggaccatacaacgactcggaccgatg

SEQ ID NO: 7327 - DNA, 203 bp, Homo sapiens
  source 1..203: mol_type = other DNA
ggcgcgccagtcctctcttccctttggtatgtatcctagatacagtcactattggggggcagcccttagctaacttagatttaaggcagattagtttatagtcaaattaggcagagcgaagcaactttcttgaggtaagtggtcatccactgtcacttcgagggggcttgccgacactctagataagtcgactcggaccgatg

SEQ ID NO: 7328 - DNA, 203 bp, Homo sapiens
  source 1..203: mol_type = other DNA
ggcgcgccagtcctagaactcagagagtcgttggaagacgggaaggaagcccgacgactgagcagtccaccccaggcgtgattctggtcgcccggtggatcaagcatggaagccgtcataaaggagctgagctgactctgctggtggcctcgcgtaccactgtggccaggcggtagctgggacgtgcacgactcggaccgatg

SEQ ID NO: 7329 - DNA, 203 bp, Homo sapiens
  source 1..203: mol_type = other DNA
ggcgcgccagtcctgcccaccaccatggggagcagcaagagcaagcccaaggaccccagccagcgccggcgcagcctggagccacccgacagcacccaccacgggggattcccagcctcgcagacccccaacaagacagcagcccccgacacgcaccgcacccccagccgctcctttgggaccgtggccgactcggaccgatg

SEQ ID NO: 7330 - DNA, 203 bp, Homo sapiens
  source 1..203: mol_type = other DNA
ggcgcgccagtcctcttcttggtccgggagagcgagacgacaaaaggtgcctattgcctctccgtttctgactttgacaacgccaaggggctcaatgtgaagcactacaagatccgcaagctggacagcggcggcttctacatcacctcacgcacacagttcagcagcctgcagcagctggtggcctacgactcggaccgatg

SEQ ID NO: 7331 - DNA, 203 bp, Homo sapiens
  source 1..203: mol_type = other DNA
ggcgcgccagtcctcggcaccaccagagtggccataaagactctgaagcccggcaccatgtcctcggaggccttcctgcaggaagcccaagtgatgaagaagctccggcatgagaagctggttcagctgtacgcagtggtgtcggaagagcccatctacatcgtcactgagtacatgagcaaggggagcgactcggaccgatg

SEQ ID NO: 7332 - DNA, 203 bp, Homo sapiens
  source 1..203: mol_type = other DNA
ggcgcgccagtcctcttcacctcgacagagcccccagtaccagcctggagagaacctataggcctggagctcctcctggcaccagaggcctcgctgtggggcacaggggcctggctccgtgcagaggggccacgttttggggagcagccccagagcaggatgtggcatggtgaggtgtcgggtgctcccgactcggaccgatg

SEQ ID NO: 7333 - DNA, 203 bp, Homo sapiens
  source 1..203: mol_type = other DNA
ggcgcgccagtcctcctggtgcagaggaaaaggaggtatatgggttaatcaatcaaaggaaattaatgagacagagccgttcagctttactgcgaactgtacagctagtaatttgggtaatgtcagcggatgttgtggaaaaacgaccacgattctcccatcaggggcgtggatcgacagcacacaagcgactcggaccgatg

SEQ ID NO: 7334 - DNA, 203 bp, Homo sapiens
  source 1..203: mol_type = other DNA
ggcgcgccagtcctaaagcggggtctcggttgtaacgcgcttaggaagtcccctcgaggtatggcagatatgctcttgcacgggtcaggtataatgtgcagtttgactgaggggaccatgatgtgtataggcgtcaagcggggcttcggttgtacgcggataggaatcccctcaggacaattctgcttcgactcggaccgatg

SEQ ID NO: 7335 - DNA, 203 bp, Homo sapiens
  source 1..203: mol_type = other DNA
ggcgcgccagtcctggaatatgatggcgtcttccctgttttgcccttagactattcaggttgcctctgtggattagggctggaggcagcacggatagtctgatggccaaataaggcaggcaagacagctatttgtaactgcgaaatacgcttttgcatagggagggggaaatgtagtcttatgcaatacgactcggaccgatg

SEQ ID NO: 7336 - DNA, 203 bp, Homo sapiens
  source 1..203: mol_type = other DNA
ggcgcgccagtcctgaaagcgggtgcatgcatggccattttccagcacaggttcagctggtatggcatgcatgcatcgactgcttgggggtgtccctgacccccttaattcaacgtctagcccacgatacgggcaccctacccaatttgtatccctttacctcccatggattgacttgtatggacttgcgactcggaccgatg

SEQ ID NO: 7337 - DNA, 203 bp, Homo sapiens
  source 1..203: mol_type = other DNA
ggcgcgccagtcctgatctaaattggattatcctttacttgtggtggttagccaaccatgctctggtgtaatgattccatgtgttcatctggctaagtaccgacctaggaggtggtgctgaaatattgcaagccactagcgtcgttatgcttagcctctggatacatgggattaattgcattctgtaccgactcggaccgatg

SEQ ID NO: 7338 - DNA, 203 bp, Homo sapiens
  source 1..203: mol_type = other DNA
ggcgcgccagtcctaagcaatttcaggcctaggggcagtggaaagtgtggcatccactaattcagccattgccactgccaatgcaacaactacacagacaataccagacccaacggagggttccactgatgatttctactcctgttcttatgaagtaggagctcaaggggataacatttctagattggcgactcggaccgatg

SEQ ID NO: 7339 - DNA, 203 bp, Homo sapiens
  source 1..203: mol_type = other DNA
ggcgcgccagtcctgaaagagaaaaccacgcaggaggcccattcacaaacccaagaatccaccacaggagccaagagtcatcattcaaccaggacctggggcagcaaacctttcaaactctagtgttatagcaatggctgaaagcacagcacttgccaatgaagggacagctgttgactattccacagcgactcggaccgatg

SEQ ID NO: 7340 - DNA, 203 bp, Homo sapiens
  source 1..203: mol_type = other DNA
ggcgcgccagtccttggacctccaagttccagacagaggacatgcctctctcattcggttctttgcctatttttctggagagatcattctcactattgttaacaatggcactacaccagcaatggtagcacattcctactctatggatgatctcagttcagaatatgctgttacagcaatgggaggtgcgactcggaccgatg

SEQ ID NO: 7341 - DNA, 203 bp, Homo sapiens
  source 1..203: mol_type = other DNA
ggcgcgccagtcctaactgtcaccacgttcagttacaatggttcatcaggttgagacaattgacgttgaggggaagaaggtgacgatagtggattcacctgaaacaccaaattatgatggccccatttctgcctttttttacttgattgaggcaggcaggttcacagctgaagacaaggagtacatcccgactcggaccgatg

SEQ ID NO: 7342 - DNA, 203 bp, Homo sapiens
  source 1..203: mol_type = other DNA
ggcgcgccagtcctaaatgatgagaaaacgctttccaggctttgagaaatccactattttgattttgaaccgagcagatgaattgaaaactgatgatgatataagaaattgggttaagacatctggagagttggactctctagtgagagcctgtggggggcgtatagctaaatttcaccggcacaaaacgactcggaccgatg

SEQ ID NO: 7343 - DNA, 203 bp, Homo sapiens
  source 1..203: mol_type = other DNA
ggcgcgccagtccttaaacagggctaagttattagagaaagcagccacccttcctgagtttgtctctcatttgccaagacttgtctacaaggatagaaaaatgtaccgccattatggtgtgcagtgtggttccacagtcttccacatggactcagagaacatccttgagtcagcattaaatggtgaagcgactcggaccgatg

SEQ ID NO: 7344 - DNA, 203 bp, Homo sapiens
  source 1..203: mol_type = other DNA
ggcgcgccagtcctgccctggtgttgggaagagttttttatcaaattacattgttaaagaaatagccaaattaaagcattggaagagttatgccaacccaactggaagtaagcatatggatgggtatgtgtcacaggagattcatgtttttgatgattttggtcaaaatcgggaagaagaggactattcgactcggaccgatg

SEQ ID NO: 7345 - DNA, 203 bp, Homo sapiens
  source 1..203: mol_type = other DNA
ggcgcgccagtcctctttaatctgtaatcttatttctagtgttccatttattactccaaaagcaagtgtagaggctaagggcacccaatacagaggacgccttgttgtcgtcacaaccaatagacgggattttacttcctgtaagttgactgacccagatgcactggaaaggcgctttcctattcgcccgactcggaccgatg

SEQ ID NO: 7346 - DNA, 203 bp, Homo sapiens
  source 1..203: mol_type = other DNA
ggcgcgccagtcctttaatatccggccattgcaaaagtataatcacaagggccgtttggatgtggcaacagccatgagagatggaagcttgcagggaggaacttgctgggaaagggatataggccaattaggtcttgaatgttggaatcccataaatggccaaatcttaattgatgaaattatgagtgcgactcggaccgatg

SEQ ID NO: 7347 - DNA, 203 bp, Homo sapiens
  source 1..203: mol_type = other DNA
ggcgcgccagtcctaaacactccctaaagattttaaggtagctgttaagaaacacattgaaaaactagaaactgaattggaagatcagagcgggcgggtgaattttagacatatttgtaacagactcgtcaatgtgagtaatgaggatgaagtagccactggtttagccattggtgggaaaaatgtttcgactcggaccgatg

SEQ ID NO: 7348 - DNA, 203 bp, Homo sapiens
  source 1..203: mol_type = other DNA
ggcgcgccagtcctactatcgcggcaatggctggttggtttggaaagatcaggaccagtatatggtgcaagatgtgacaaagattaggccttttggttccacaacaactgcatcaggcacgacatcatgtcaaacatacatatataattgcaagactgggcctggttcctgtggtggtgtgcttgtagcgactcggaccgatg

SEQ ID NO: 7349 - DNA, 203 bp, Homo sapiens
  source 1..203: mol_type = other DNA
ggcgcgccagtcctgagtattgggatgccatgatactatctcatatgagtcagctgtgagtagtgatgttatacctatgaactgggacacttcacctggcattaagtataagggggagactaaacgacaactggtgctgaagtcctcattcagacaggatgttctgaagcaactacagagtccatccacgactcggaccgatg

SEQ ID NO: 7350 - DNA, 203 bp, Homo sapiens
  source 1..203: mol_type = other DNA
ggcgcgccagtcctttggaattaatcctttttgtgagtgggacaatttgttggcaaacctccaaccttataatttgtgtcttgacttttctggattcgatggctctctgagtgcccaaattcttgaagaagcagttgatgtattgtcttattttcacaatgacccagccttagtgaaaagaattcatgcgactcggaccgatg

SEQ ID NO: 7351 - DNA, 203 bp, Homo sapiens
  source 1..203: mol_type = other DNA
ggcgcgccagtcctcaccaactatctattcaactcattatgtaactgatgagatatggcaggtagaaggagggatgtgttcaggatctccatgtaccactgtggtcaattctattgtgaatcagcttgcatgttacaccattttagctgtcttgggctatgacatcaaccaatgttatgtcgttagttcgactcggaccgatg

SEQ ID NO: 7352 - DNA, 203 bp, Homo sapiens
  source 1..203: mol_type = other DNA
ggcgcgccagtcctggacccgcaaaattattggtgtccttgacaaagaagtcttggaagggaagatacagtggtgcaagggaccagaagcattcaaacagcaacttgactctttcttgctggaagcagctctgcatggagaagaatactaccatgaggtgacatctaagcttaaggcccggtgccccgcgactcggaccgatg

SEQ ID NO: 7353 - DNA, 203 bp, Homo sapiens
  source 1..203: mol_type = other DNA
ggcgcgccagtcctgaaggaggagaaaaagaagaaggagaagaggggtgtgcggagcacatctcagccggtctccggcggtgcgcagcaccgccgcggaggcggaacaggtcctagggccggaggtctactaggacgtttgggagctggctggggatcgattctccaggaggacattgtgcacgcactcgactcggaccgatg

SEQ ID NO: 7354 - DNA, 203 bp, Homo sapiens
  source 1..203: mol_type = other DNA
ggcgcgccagtcctcatgcacttagtgctggtgctacactctgttttcatcgcaattgatcgacgcttgcgctcactgacacggcgcgtgactgctcttgaggctaaacgctctgcgaagaacgctgtacggatcgcattcatgctcaccggcgtgatgatggtgctgggcgccgtcgtcattgatatcgactcggaccgatg

SEQ ID NO: 7355 - DNA, 203 bp, Homo sapiens
  source 1..203: mol_type = other DNA
ggcgcgccagtccttgagtttcgcaccggagcagccgagatatatggcggccaatggatgcgtgaattgctcgctgattgtcacgtgaacgcgtcattctcgactgacgtgtgtcctggaggatctcagctgaacatgggtgagatcaatggtaaagaacgtgtttgctcaacccagccctacaatcgcgactcggaccgatg

SEQ ID NO: 7356 - DNA, 203 bp, Homo sapiens
  source 1..203: mol_type = other DNA
ggcgcgccagtccttttggaacggattgtggtctggggagacgccagggctaatgaagttttggtgaaaaacattttggaaccccagctcgtctgggataatgccattgccacgcaggacggttttcgtgatgttggctattcttgtcagatcatgcttgacaaactggttagcggtagttttaaggacgactcggaccgatg

SEQ ID NO: 7357 - DNA, 203 bp, Homo sapiens
  source 1..203: mol_type = other DNA
ggcgcgccagtcctctgcccggggatcaagtcttcagtcttcgtccaaagcggtttcggatacgacggagtggtgatgacaagcttgtccaaagcaactaatgagagctgctctgtggggctgacgtgccacggatgctacctccttgcgacgaagatggtgttcggacctggaacttcgaccgcaagcgactcggaccgatg

SEQ ID NO: 7358 - DNA, 203 bp, Homo sapiens
  source 1..203: mol_type = other DNA
ggcgcgccagtcctcggatcaggagggttcgtctggaaaagcttgtcacaatggccgacccgggaacattcagttgaactcgatgaccaacacttgatcacggctcttgttacggaacagttgaagaagacgaacaaggtgtgtatcatttgtgaggacgtcttgcaatgcgccgccgctcgtagtgccgactcggaccgatg

SEQ ID NO: 7359 - DNA, 203 bp, Homo sapiens
  source 1..203: mol_type = other DNA
ggcgcgccagtcctcaagcccgtggcaaaaccaacagattactgccccacgtacctggccggatcgtttgtgaaaaatgacataggcgcgtacaccgatgggatgatgtggatgaaaagcaggaaggtgaacggaacgtggacattggtcgacctggaactgacgcagagccatcaatgcatttggcccgactcggaccgatg

SEQ ID NO: 7360 - DNA, 203 bp, Homo sapiens
  source 1..203: mol_type = other DNA
ggcgcgccagtcctagaggtgaccattgacgctgacggcgaagacatggacgagatgacatcaatgttcgggacaatgaaggcagtcgtaccgccagtggaagggtcctatccggatttccggctcagcccatctgtggagggagtttctcccctactggtgggcgcgcttttgcacctgctgaccatcgactcggaccgatg

SEQ ID NO: 7361 - DNA, 203 bp, Homo sapiens
  source 1..203: mol_type = other DNA
ggcgcgccagtcctgttcaatctgaaatcacagttcgtacctgtggactcgatggtactgctgaactatgttgtgacgcatcctgcagttgcgacggccatggtaacaggaggtgccctggtgatctattccattcgcgtgtacaagagctggggatgctctccgaacttgtggaggagtggacttcgcgactcggaccgatg

SEQ ID NO: 7362 - DNA, 203 bp, Homo sapiens
  source 1..203: mol_type = other DNA
ggcgcgccagtcctcgcttcgaggcgctcattagtggctggaatgtgcttggcggggttgtacgtgctctcaacgtgtctcgagttgtatcagatgccgacgacggcatcggtggtgttcctaggaggactactgatcgggatagtgaccaggatggctcctccagcgcacttggagttggttccggtcgactcggaccgatg

SEQ ID NO: 7363 - DNA, 203 bp, Homo sapiens
  source 1..203: mol_type = other DNA
ggcgcgccagtcctggctggaatgggagtgccgttggattgcgaggaagagcccacaacacttccgtctggattagaaggaacttagggaccggatggagtggaattcacgaacttgacggacaacagtagagtgtcaacggggttgctggtttacgtcggctgcatgggaatcatggccatcaataccgactcggaccgatg

SEQ ID NO: 7364 - DNA, 203 bp, Homo sapiens
  source 1..203: mol_type = other DNA
ggcgcgccagtcctctacgtcggggtcatcctgatgtgtgcttgttggtggacaaacgcgcccgagtggctacctctctacgtggctggagtatcggtctttcgatccaatgaggtgaatgatgtcctcatcacccctccagagtatgagcaggaagcacagctaagcaacgacttcgggcacctgcccgactcggaccgatg

SEQ ID NO: 7365 - DNA, 203 bp, Homo sapiens
  source 1..203: mol_type = other DNA
ggcgcgccagtcctttgccacgcgacactaacgcagtatctgatggagaaaggcattgacagcattcgattctccaccatcataatggacgaatgtcacttcctggaccccctgtccatcgcctgtcgtggggtcatggattactacaatggaaaaggggttgccgtggtgtacatgagtgcgactcccgactcggaccgatg

SEQ ID NO: 7366 - DNA, 203 bp, Homo sapiens
  source 1..203: mol_type = other DNA
ggcgcgccagtcctactgacccgcgaatcgtttgacgttgcgatcggaaaggcccgcaagcaggagacacagttcatcgtgtcgacagacatcagcgaaatgggagcaaatctcggtgtgcagacggtcattgacacgcgtgtggcagtgaagcctgtcattagcgaaggttccgtcatgctggagaacgactcggaccgatg

SEQ ID NO: 7367 - DNA, 203 bp, Homo sapiens
  source 1..203: mol_type = other DNA
ggcgcgccagtcctggaaatcgagaacttccagccacagggcagatacctcttggcgcctgaaagtcgaccccggttcatcaacttcatcaagaaggatgttccagtctggcttgcgtggcactgggcgaatgcgtttgaacacaagcactcagtgctgtttcaaggacagaatgcgacgagcttgaacgactcggaccgatg

SEQ ID NO: 7368 - DNA, 203 bp, Homo sapiens
  source 1..203: mol_type = other DNA
ggcgcgccagtcctcacgaacctagagcggcttggtacatcctaccgctcggcgattgagattctccatgaaatctctaacgttgatgatccaatggtttcaaacgtggtgatgggaaagtcgctacaagcttgggcggctgtcatcattgggatggtcactgggattgtgctactcgtcatgtttgtcgactcggaccgatg

SEQ ID NO: 7369 - DNA, 203 bp, Homo sapiens
  source 1..203: mol_type = other DNA
ggcgcgccagtcctagtggtttgtcggatcgtgaagtggctgttcggtggaaagacaactgcacaacaaagccccccgtactcaagcttcccaacgttacaaacagcaggattttgtcaattcggctcaatggtgatggctatcggaccactatgtgcggtggttgctggcattcctcccgctttcgtcgactcggaccgatg

SEQ ID NO: 7370 - DNA, 203 bp, Homo sapiens
  source 1..203: mol_type = other DNA
ggcgcgccagtcctttttgttgcggtgttgggattgttcgtgataatgtgctgtagcgctaataacgtgcaccgggcttacactactgacaccgtcacgctcgttgtcatcggtgtttgcgtgtgtgtcatgggagttgttgcgtgggaaatggatctacttcccaacatccgacgggatctaggttacgactcggaccgatg

SEQ ID NO: 7371 - DNA, 203 bp, Homo sapiens
  source 1..203: mol_type = other DNA
ggcgcgccagtcctgcgcaagttgttttcgaacgaagaacagtccgcaacggtaatcggaggcatccagctcgctttgatttcctgggagacgatggtgccaatcgcttttgctgggttcttcgcaactacgttcgtgacgaagatctatgggtgcatggtaggaggaatctacctggttttagctcacgactcggaccgatg

SEQ ID NO: 7372 - DNA, 203 bp, Homo sapiens
  source 1..203: mol_type = other DNA
ggcgcgccagtcctcgtggcgcatcagtctcgcatggcgctacggtcgctggtgaagacagacgcttgcggactgggatacagatggaaggaaatgcttaacgcgcttgacaaaaatgcgtttgacaagtaccgatcccgaggagtgaacgagacagacaagggtgatttcgtctcgcggggcggtttcgactcggaccgatg

SEQ ID NO: 7373 - DNA, 203 bp, Homo sapiens
  source 1..203: mol_type = other DNA
ggcgcgccagtcctgaaaggacacaacctagccgtgctaaaagccggtgttgacgtgtacgcgactgagccgcgagactgcaacacgattgtgtgtgacataggcgagagtgacccccggcctgaggtggagaagacaagaacgctgaaagtgctgacgatgctcgagaaatggttagtccacaatcccgactcggaccgatg

SEQ ID NO: 7374 - DNA, 203 bp, Homo sapiens
  source 1..203: mol_type = other DNA
ggcgcgccagtcctttatcacgtcttaggggctctaattgggcgcctcaagcgtaatgacccggtgcagcaggatgctcctccaaagctcgagatgggcactcgaagtgacccccgggcaaaagtgaagctgcaggaccagacaatcgttgcaggtcgcgtgaagaggttgcgagaggaaaacgccagcgactcggaccgatg

SEQ ID NO: 7375 - DNA, 203 bp, Homo sapiens
  source 1..203: mol_type = other DNA
ggcgcgccagtcctcacatggttcgtggaccgtgaacacccttaccaatcgttcaactaccacgggtcatttgtcactgacgacatctctcccggagggcagactgtcaacccgatgatgcgccgaataatgtggccgtgggatttcctctcccgtgtgacgacgttcatgatgacagatgtgtcaaccgactcggaccgatg

SEQ ID NO: 7376 - DNA, 203 bp, Homo sapiens
  source 1..203: mol_type = other DNA
ggcgcgccagtcctgatgatcgatgggtggttaggttcccatctggaagagattttgagtggaatggtcgtggccggggatgatgtggttgtggcaaccaacaatgaaaacttccacaccagtctaaggtacatcaccgccgcgtcaaaaacgcgcaagaacttgcaaccaaccgagccttccccgagcgactcggaccgatg

SEQ ID NO: 7377 - DNA, 203 bp, Homo sapiens
  source 1..203: mol_type = other DNA
ggcgcgccagtcctgtacacaaactgggaacatgttgaattctgttcccatcactaccatcctctcgtgctgcaagacggtcgtgagatcattgctccgtgtcgtgaccaacacgagatcattggccgagcacggatccagaaaggggggatcgtggacatgtcagctgccgggtgcttagcaaaggccgactcggaccgatg

SEQ ID NO: 7378 - DNA, 203 bp, Homo sapiens
  source 1..203: mol_type = other DNA
ggcgcgccagtcctcgtgtggattgtcaacaacccatggatggcagtgaaagacccagtgaagacatggtcagagataccatacctcccgaagacgaaggacataaattgtggaagtttgattggtgagcgggacagggcagcgtggtcgaagaatatcgtggccacagttagcacaactcgacgaatcgactcggaccgatg

SEQ ID NO: 7379 - DNA, 203 bp, Homo sapiens
  source 1..203: mol_type = other DNA
ggcgcgccagtcctcatcgagcaagaagctggaagtcagaagttcacggaagggttgcggatacttgggcgataccgagctccaaccgacgacgtgttctggtgagaatcacgcgaatcgtagagaaccacatctctagaaaaggttaacgttgcgaagcaacgggaaccccgtaaggaaggacaaggcgactcggaccgatg

SEQ ID NO: 7380 - DNA, 203 bp, Homo sapiens
  source 1..203: mol_type = other DNA
ggcgcgccagtcctcaagctttgagcattgacaacgctccggccccagtcccccaggttatgggagaataaccccgacgtgctggaagggcacgaatcaccgcaaggtgagggcgcacaggatagaatccaggtgactgacgccacctcccgaaatgtgtatagtaacagagcatgcctgcagcagcacgactcggaccgatg

SEQ ID NO: 7381 - DNA, 203 bp, Homo sapiens
  source 1..203: mol_type = other DNA
ggcgcgccagtcctgcgtgtacgtgacatacgggaagtgcaaggccgacggggccccgcgacgctcgagaaggtcagtcgagatcacgagccacataacggaagggttgaacacccgccaggaaacgtgggccattgaccgttatggaaaactccagctagaaaaagtggaaagatgggtaatacgcacgactcggaccgatg

SEQ ID NO: 7382 - DNA, 203 bp, Homo sapiens
  source 1..203: mol_type = other DNA
ggcgcgccagtccttcatcaaactccaactacatacctctgagagggattccacttcagctgactggaagagaagcatagagttcaacatgctttccggacaacaggtggttgtgttcactggatatggaactgtgacactcagttgcaacctgaaaaccaccatggacttgggcaattattacattgcgactcggaccgatg

SEQ ID NO: 7383 - DNA, 203 bp, Homo sapiens
  source 1..203: mol_type = other DNA
ggcgcgccagtcctccatcctgggctctgataggtttcttgttaacaaaaactgggccactgacctgccactgccttggacgccggcttctgctgatgcttggcgtgaaaaacactacctggtacacttcgaggagccacatgcaacctcagtggcagtgacaactctgggggaccaggaaggggctgcgactcggaccgatg

SEQ ID NO: 7384 - DNA, 203 bp, Homo sapiens
  source 1..203: mol_type = other DNA
ggcgcgccagtcctgtcacataattattggtaatggagaggacaggctcacacaccgatggcaccagcctgggagcaccataggcaaggcgtttagagtgacaatgaggggcatggaaagaatgaccatcattggagatgacgcctgggactttggttccactggcggaatcttcaataccataggcacgactcggaccgatg

SEQ ID NO: 7385 - DNA, 203 bp, Homo sapiens
  source 1..203: mol_type = other DNA
ggcgcgccagtcctaggccattcacactgtgtttggaggtgcgttctcggcaatattcggaggggttaattggattgtgaaaatcctcataggcaccatctttttgtggctgggagtgaacgccagaaatggcacgttgacccttgtgctgctcataactggtggtgttttggtctttcttggaacagcgactcggaccgatg

SEQ ID NO: 7386 - DNA, 203 bp, Homo sapiens
  source 1..203: mol_type = other DNA
ggcgcgccagtcctgagtgggggctgagactggctgcgccgtgtctttagagcagaaggagctgaaatgcggtgatggcgtgttcatcttccgcgacacgaatgactttttgtcaaaataccgtctgtgtccattgtcaccccaggagcttgctagcataatacaggcaacgagtgagcgtggggcctcgactcggaccgatg

SEQ ID NO: 7387 - DNA, 203 bp, Homo sapiens
  source 1..203: mol_type = other DNA
ggcgcgccagtccttggttgccttgtccatatcccaagtggtactgtctgacaaaatcggattcctagactggatggacgctgttgggctagtggctgccgtggtgcaggccttgattgagttgaaatcagaaaattgggcaatgctcggactactagctctgaaccccatggggtcgaagttggttgcgactcggaccgatg

SEQ ID NO: 7388 - DNA, 203 bp, Homo sapiens
  source 1..203: mol_type = other DNA
ggcgcgccagtcctcaaagacaaccatcgtcacgctcctaggacttgcagggctcgcaattttgcaaaagcgggacacgagtgcaagaaggacatatcccaagttgataggggcagcaatggttctgttggggttcacccgtgggtggatcctaggattgctcacaatgctgagccagcagagcttgacgactcggaccgatg

SEQ ID NO: 7389 - DNA, 203 bp, Homo sapiens
  source 1..203: mol_type = other DNA
ggcgcgccagtccttgcagataatcgcatgtgtccctcgccaaaaagtcaagaacgtgacaacaacgcctggagtgttcgccctgaaaacgggagaagaaattggagcggtatcactggattaccctgcaggaacctcaggttctcccatcatcaacaagaaaggtgatatcattggcttatatggaacgactcggaccgatg

SEQ ID NO: 7390 - DNA, 203 bp, Homo sapiens
  source 1..203: mol_type = other DNA
ggcgcgccagtcctatggaatcctgactgagaataaggactttgtgtctgccatcgctcaggctgactcatgtgacctgcgtaccccagaagttgatgttgagtttagaaaaggagagatcaaggtgctggatctgcaccccggagcggggaagacccggaaggttctgccagagttgttacggaaatcgactcggaccgatg

SEQ ID NO: 7391 - DNA, 203 bp, Homo sapiens
  source 1..203: mol_type = other DNA
ggcgcgccagtcctgccttgagcggcggctgcggaccttagtgctggctccgaccaaggtggtgctgacagagatgtatgaagcactcaaggacatgcctatccggtatcatacaagtgctgcaatcgagacaaagaaatcaggagctctcattgacatcatgtgccatgctacgctggcaaatcggtcgactcggaccgatg

SEQ ID NO: 7392 - DNA, 203 bp, Homo sapiens
  source 1..203: mol_type = other DNA
ggcgcgccagtcctggtcgatgacaacaatactggaaagggttgtgcaggtgccagggctcatgaaggacaacttgcaagaggcctgggacacataccacaccctgctgagagcagatgaaaattctagtagacacagaatggcgctggataacatccccgaacccatgctcagtactatgtgtgtggcgactcggaccgatg

SEQ ID NO: 7393 - DNA, 203 bp, Homo sapiens
  source 1..203: mol_type = other DNA
ggcgcgccagtcctcgtcagtcgcgtccatgaccatgggaatttttctgtacatgctcgctccaaagggaacgtcacgaaagacgctcgcctttgtgacaatggttgccgcttcagtgggactatgggatggagatgtctcagttgtcaagattgctagcatgatgctggttttcttcatactgtgtgcgactcggaccgatg

SEQ ID NO: 7394 - DNA, 203 bp, Homo sapiens
  source 1..203: mol_type = other DNA
ggcgcgccagtccttcattctaattccagacgcaggactgcagagatcaacgcaggataactacttggcatattttgtgattgtgctcctgatgcttgtggggctcgttgcagccaatgagaatggatacctcgaaaaaaccaaagcggatattttcggtcacaagcaaatgaggacaatgccagtgacgactcggaccgatg

SEQ ID NO: 7395 - DNA, 203 bp, Homo sapiens
  source 1..203: mol_type = other DNA
ggcgcgccagtcctacggctcatggatgtcttttgacctgcgaccaggtagtgcatgggcagtttatgcctttgtggtggggatattctctccgctttatcatcatgcagagagcatcaactatggagccatttccttgcaaggcatcacccagagcgcagcagctttcttccaaatggacaaaggctcgactcggaccgatg

SEQ ID NO: 7396 - DNA, 203 bp, Homo sapiens
  source 1..203: mol_type = other DNA
ggcgcgccagtccttcacctcttccctgcctcagttggtgaacggcgttccctcgccggtttggaacacgcaagtggcggtaggtgtggctgggcttcttagaggaaactacttggctctcatcagcactggccatgctctatggagtgtgcgaggcaatcgccgaggtggtggaggaacatccacaacgactcggaccgatg

SEQ ID NO: 7397 - DNA, 203 bp, Homo sapiens
  source 1..203: mol_type = other DNA
ggcgcgccagtcctctttgggagagctttggaaaaaacagctcaacaagatgactaaaaaacagtttgagtcctacaagaaatcagggatcattgaagtggatcgcacggcagcgcaagatgccataaggagaaacatcctagacggatccgctgtgtcaaggggcagtgcaaagatgaggtggatggcgactcggaccgatg

SEQ ID NO: 7398 - DNA, 203 bp, Homo sapiens
  source 1..203: mol_type = other DNA
ggcgcgccagtcctggagccgagccatatggtacatgtggctgggggcacgcttcctggagtttgaagccctaggtttcttgaatgaggaccactggattgccagacgccactctagagcaggagtggaaggcattggactgcagtacctagggtatgtgctggaagaactggaggggaagaaaggagcgactcggaccgatg

SEQ ID NO: 7399 - DNA, 203 bp, Homo sapiens
  source 1..203: mol_type = other DNA
ggcgcgccagtcctatgcaaacatgtggaaactgttttatttccaccgaagggacctgaggctcatggcaaacgccatcagttcagctgtccccgttgactgggtcccgacaggaagaacgacatggtccttgcatggaaaaggtgaatggatgacgtctgaggacatgttggaagtctggaatagggcgactcggaccgatg

SEQ ID NO: 7400 - DNA, 203 bp, Homo sapiens
  source 1..203: mol_type = other DNA
ggcgcgccagtccttgaagaaactgcgaaacatagtgacaaacttgatgaagggattgtccggacgcaggaaaagaagaagcccaccagcctcaatcattttgctactgctccccctaatggcatactcagctagtgtgacacgtcagcatggagctggattgttattgaatgtgacctttgctgatgcgactcggaccgatg

SEQ ID NO: 7401 - DNA, 203 bp, Homo sapiens
  source 1..203: mol_type = other DNA
ggcgcgccagtccttcggaaagacctttgaggtacaagggggtaactgttcagtcaataccttggaagccggaaaatggtgtgatgactatgtggaatacgcttgtgtcactctgactgagggtgaggaacctgatgacctagactgttggtgctatggggtggacaatgtgagagtgacatatgggacgactcggaccgatg

SEQ ID NO: 7402 - DNA, 203 bp, Homo sapiens
  source 1..203: mol_type = other DNA
ggcgcgccagtccttagctctggcatatttcattggaacatcagtagtccagaaagtagtcatcgccatactgctgctaggaattggaccagcttattccacacattgccttggtatccccaaaagagacttcatacggggacttgatggaaacacatgggtctcagttgtgttggagcaaggaggctcgactcggaccgatg

SEQ ID NO: 7403 - DNA, 203 bp, Homo sapiens
  source 1..203: mol_type = other DNA
ggcgcgccagtcctgtgtgaccctgattgcagacaacaaaccatcagttgacgtgtggctcagttcaattgtggtcgacacgccaacacttgtccggaaaatctgctatgaaagttcagtcacaggttcaaaagctgaaggagcttgtcctactatgggtgatgcgcacttgactgaggaaggaaatgcgactcggaccgatg

SEQ ID NO: 7404 - DNA, 203 bp, Homo sapiens
  source 1..203: mol_type = other DNA
ggcgcgccagtcctaagaatgggaatgcaaaagatccttctctgacagaggttggggcaacggctgtggtctttttggtaaaggcagcatagttgcttgcgcaaagttctcatgcaccaaagagatggaagtgtaccaaattgactctacaaaaatagaatacactatcagtgctcaagttcattctgcgactcggaccgatg

SEQ ID NO: 7405 - DNA, 203 bp, Homo sapiens
  source 1..203: mol_type = other DNA
ggcgcgccagtcctgagccaaaaaagaggattgggttaaccacaccaaactcatcaagtttgttcccacaacaggaacatccacagtgacttttacaggttatggtaactttggccttgaatgtcatgttcaaatgatggtagatcttggtaactcttacctagtcaaagtgggtacagacgcatggccgactcggaccgatg

SEQ ID NO: 7406 - DNA, 203 bp, Homo sapiens
  source 1..203: mol_type = other DNA
ggcgcgccagtcctaggtgacaaatggagctccatgcaggattccagtcatagcatcagattcgatggctggcactgaaaatcgtggcagcgtcatcacaactaatccaatagctgcattgaacaatgatgaagtgctggttgagatcagtcccccttttggggaaagctacatcatagttggttcagcgactcggaccgatg

SEQ ID NO: 7407 - DNA, 203 bp, Homo sapiens
  source 1..203: mol_type = other DNA
ggcgcgccagtcctgttcactcaattggaaacagcgtgaggtgaaatgtggagatggaatgtttgtcttcaaagacacagatgattggttcacgaaataccagtatattccagaagatcccaagacaatggccgggttaattgcccaggcccacgaggaaggactatgtggactcaactcagttggagcgactcggaccgatg

SEQ ID NO: 7408 - DNA, 203 bp, Homo sapiens
  source 1..203: mol_type = other DNA
ggcgcgccagtcctaaaacatcatttttagtccatccagaaagaacggcacctttataattgacggaaagagcaaatcagaatgtcctttcaataagagggtctggaactcaatcaaagtggaagaatttggcacaggaatctatcaaacaagagtgtttatgcgccctgactatgattactccaagtcgactcggaccgatg

SEQ ID NO: 7409 - DNA, 203 bp, Homo sapiens
  source 1..203: mol_type = other DNA
ggcgcgccagtcctgagtgatagaatctgacatgttcatgccacgcagtctagccgggcccgttagccgccacaatcacatacccggatacaaagtgcagtctagtggtccatggcacaacactccattggaagtaaaaagagaagaatgccctggaactcacgtcactgtggaagaaacatgtgatgcgactcggaccgatg

SEQ ID NO: 7410 - DNA, 203 bp, Homo sapiens
  source 1..203: mol_type = other DNA
ggcgcgccagtccttggcctccaagggcgatgttgatcctttctctttgggactcctcatgctttttctttgtagtgacatgttcctgatgaagaggttttcgatgcgtgctctcattgctgggagcatcatcatgctgggagccatgacattaggaagcttgacatatcttgacctcttacgctatgcgactcggaccgatg

SEQ ID NO: 7411 - DNA, 203 bp, Homo sapiens
  source 1..203: mol_type = other DNA
ggcgcgccagtccttggtcacggttgggatgtacatggctgaagccaatagtggaggagatgtgacacacctggctctcatagcggtttttcgggtgcgggctggctttgttagcgtgctggccctaaaacaaatgtggagccctagagagagatttgtcgcagcttgtggaatagttatggttcagacgactcggaccgatg

SEQ ID NO: 7412 - DNA, 203 bp, Homo sapiens
  source 1..203: mol_type = other DNA
ggcgcgccagtccttagcactgggagacatcatgaatactaatctcatggagtggctgaatgcagctggcatgtcaatactcgtcatcaagtcaatagtcgatccgagaaagtgcaatgtggtgctccctttactctgtcttctcacaccacttacgacgacagaaattcaaagggctgtgatgctatcgactcggaccgatg

SEQ ID NO: 7413 - DNA, 203 bp, Homo sapiens
  source 1..203: mol_type = other DNA
ggcgcgccagtccttctgttctgtggtcatttccgtgaccgtactgcaaaccgacagcgtctcaacaagaaagtctatccctcttatagccttgaccatttgttcattctttaaatggacaagccctttccttggcctggtgtgttacttagcttttacacgcattccccagcgctcatggccattggcgactcggaccgatg

SEQ ID NO: 7414 - DNA, 203 bp, Homo sapiens
  source 1..203: mol_type = other DNA
ggcgcgccagtcctcccttgtgttggcccccacccgggtagtcctcagtgaaatgaaggaagccatgcctaaaatgagcatcaaattccacacccaagcattttcaaacactgctacaggaaaagaaatcattgatgcaatgtgtcatgctacgttaacccatagaatgttggagcctactcgggtgacgactcggaccgatg

SEQ ID NO: 7415 - DNA, 203 bp, Homo sapiens
  source 1..203: mol_type = other DNA
ggcgcgccagtcctctaactgggaagtagttatcatggatgaagcccactttatggacccagctagcattgccgcaagaggatgggcagcacatagatcaagagcgagggaatgtgccaccatcttcatgtctgctacacctcctggaaccagcaatgaattccctgagtccaatggaaccatagaggcgactcggaccgatg

SEQ ID NO: 7416 - DNA, 203 bp, Homo sapiens
  source 1..203: mol_type = other DNA
ggcgcgccagtcctcctcaggcattgtcatgttctttttggcacccaaagggctcagccgcatgtcgatggcaatgatgaccatgttggtgtctgcttacttgatgtctttgggaggtatgaacccagtgcaggtgtcctgtgtaatgctggtattcttcatattcatggtggtgttgatacctgaaccgactcggaccgatg

SEQ ID NO: 7417 - DNA, 203 bp, Homo sapiens
  source 1..203: mol_type = other DNA
ggcgcgccagtcctcagggacacagcgatcaacatatgacaaccagctcatctatctgcttgttggagtgatgagtgtcatcctcatggtcacagccaatgagatgggtatgctggaaaaaaccaagagagacatctttggcacaaccgtcgtggaagagggaaagaagtggacctttccagaactagcgactcggaccgatg

SEQ ID NO: 7418 - DNA, 203 bp, Homo sapiens
  source 1..203: mol_type = other DNA
ggcgcgccagtccttgtctgtcgtcatactcttgctgagtgcttggaatggaataacactgcttcccctgtttgcaggaatgggagctgcagccctgcactggggatttatcctaccaggactgcgtgcccaagctgccaaggccgctcaaaaaagagtgtaccatggagtggcgaagaatcctgtggcgactcggaccgatg

SEQ ID NO: 7419 - DNA, 203 bp, Homo sapiens
  source 1..203: mol_type = other DNA
ggcgcgccagtccttgttggaaggaaatacaaatgcatactggaatgggccgattgctgtagcattcactgggctgatgagaggcaattattatgcgaccattggcttgatgtacaatggatggctagcaaaacagaccaggagaggaagggctgcaggagttactcttggtgaagtgtggaaaaggccgactcggaccgatg

SEQ ID NO: 7420 - DNA, 203 bp, Homo sapiens
  source 1..203: mol_type = other DNA
ggcgcgccagtccttgtcaggaagagtaattgacctggggtgtggacgaggtggctggagctattattcggctgcgcaaaaagaagtcatgagcgtcaaaggttacacgctgggaatcaatggacatgaaaaacccgtgcacatgcaaaccctaggctggaacattatcaaattcaaggataaatctgcgactcggaccgatg

SEQ ID NO: 7421 - DNA, 203 bp, Homo sapiens
  source 1..203: mol_type = other DNA
ggcgcgccagtcctatgtcttcaccatgccagctgaaccatgtgagacacttctttgtgacataggggaatcatcatcaaattttcttattgaaaaagatagaactctcaaagtcctggaaaattttgaaaggtggaaacacgtcaatactgagaacttctgtgttaaagtcttgtgcccttaccatccgactcggaccgatg

SEQ ID NO: 7422 - DNA, 203 bp, Homo sapiens
  source 1..203: mol_type = other DNA
ggcgcgccagtcctattacttgggtagctacttgtgtaaagccactggcagttcttcatccatgctgaatggcattgttaaaatgctatccatgccttgggacaagtttgaatccgtgacattactggctatgactgatacaaccccctttggacaacagcgcgtcttcaaagagaaggttgacacaacgactcggaccgatg

SEQ ID NO: 7423 - DNA, 203 bp, Homo sapiens
  source 1..203: mol_type = other DNA
ggcgcgccagtcctgagccccttctccaccacctggcaccagagccatcatgagagttgtcaactcctggctgtttaaacacctggctagagagatgcgacctaggatctgcacaaaagaagagttcatttccaaggtcaggagtcatgctgcaattggtgcatacttggaagaacatgaaaattggacgactcggaccgatg

SEQ ID NO: 7424 - DNA, 203 bp, Homo sapiens
  source 1..203: mol_type = other DNA
ggcgcgccagtcctgaagcgctagcgaagctgtccaagacccacggttttggaagcttgtggatgaagaacggaaactccacctacaaggcaaatgcaggacctgtgtttacaacatgatgggcaagagagagaaaaaacctgctgagttcggaaaagccaaaggaagtagagccatctggtacatgtcgactcggaccgatg

SEQ ID NO: 7425 - DNA, 203 bp, Homo sapiens
  source 1..203: mol_type = other DNA
ggcgcgccagtcctggtatacaaaccaaaacagacaggaccggacctgcctgatgtcagcccgtcataatgacgccatggctaagctgtgaggccatgctggctgggatagccgcgaccacccgcgtaatggggttcctggattgctcgatccggggtaaaaaatttttagggagcctccgcctgctgcgactcggaccgatg

SEQ ID NO: 7426 - DNA, 203 bp, Homo sapiens
  source 1..203: mol_type = other DNA
ggcgcgccagtccttgtggaccaaaattgatttctttatattacatcaagatatcaattgtaccggttttacattaactatagtagataaggatgaaagaacaaaggacctcgagtattttgaccttaattgtgagtattatgagaatttgtatgatgcattaatggattctgagttttctaaaacttcgactcggaccgatg

SEQ ID NO: 7427 - DNA, 203 bp, Homo sapiens
  source 1..203: mol_type = other DNA
ggcgcgccagtcctggtttacattgttgctaaaatatattgattatgctccaattagtacgaacagtcgaggaatgccccgcccggagaccatctgtgtttcaaaacattggtggtatgagttatataggattggattcttgaataagttgtaccgatgtggagactgggatagtattttacttctcccgactcggaccgatg

SEQ ID NO: 7428 - DNA, 203 bp, Homo sapiens
  source 1..203: mol_type = other DNA
ggcgcgccagtcctatgcaaagtgtgaagcgaaattctttggatcaataagtgttattgatgtctgcatagatatcattagtgctttgttgcaagtgagcttcgctaaacctggactcaagttagcttctattgcagtagaagtgttcagacttattaagaaatatgtctcaggaattaagattaacacgactcggaccgatg

SEQ ID NO: 7429 - DNA, 203 bp, Homo sapiens
  source 1..203: mol_type = other DNA
ggcgcgccagtcctgacgcagagttgatctgtgtgctgaagtacgtaataaggttgagtttacgaaggaaggatattcaaagactaaaggatgcatggtaagacgcttggataaggatttagttaagaagaagactggagacatatgttcaacagaatgttatttagtagacttggttaatcccgagacgactcggaccgatg

SEQ ID NO: 7430 - DNA, 203 bp, Homo sapiens
  source 1..203: mol_type = other DNA
ggcgcgccagtcctctggagagaaataccaaactgatttagaatatgaagattttttagatatgtgtttggagaaaactcaggagtgtagagataattctgctaagttgaacgaatttctgatgaactatgctgaaagtcgatcaaaacgacccgaacaaaaacacgataagtgccctgaattggaatcgactcggaccgatg

SEQ ID NO: 7431 - DNA, 203 bp, Homo sapiens
  source 1..203: mol_type = other DNA
ggcgcgccagtcctttggtaagcatgtttccatggtctcttatggagatgacaatgtcataaacttcagtgatgaagtatgtgaatggtataacatggaaactattgctaaagcatttgaaacccttggattcacctatactgatgagcttaagggcgtaaatggcgaagtaccaaaatggcgatcaacgactcggaccgatg

SEQ ID NO: 7432 - DNA, 203 bp, Homo sapiens
  source 1..203: mol_type = other DNA
ggcgcgccagtccttgcctggcgattcacaacaagaaagcaatactcccaacgtacacaatacggaactcgcttcgtccactagtgaaaactcggttgagacccaagaaatcacaacctttcatgatgtggaaactccaaataggatcgatacccccatggctcaggatacttcatcggctaggaacacgactcggaccgatg

SEQ ID NO: 7433 - DNA, 203 bp, Homo sapiens
  source 1..203: mol_type = other DNA
ggcgcgccagtcctaggctggcggaaaagctcaaaagcttgccaattttaagtacctgcgatgtgatgttcaggtgaagttagtacttaatgcgaatccctttgtagcaggaagaatgtatctagcatatagtccttacgatgataaagttgacacggcccgtagtgttttacaaacatcgcgagctgcgactcggaccgatg

SEQ ID NO: 7434 - DNA, 203 bp, Homo sapiens
  source 1..203: mol_type = other DNA
ggcgcgccagtcctaagttcagaaaaataatccttctgggtataaatatattatgcatgtcttgactggctatgaacctgaagtaaagaatgtaacaatgcaagtgaacgctccaaaaacgaaaacaagtcaaaaatctacctcagaaaatcccaaagttggaccaatatctgaagtggcttctggagcgactcggaccgatg

SEQ ID NO: 7435 - DNA, 203 bp, Homo sapiens
  source 1..203: mol_type = other DNA
ggcgcgccagtcctccagagcaggaaacgatgactttacctttggttggatgataggtccaccccagctacaaggcgaatcacgctccgtagccccctagatgtgcactgggagacagacaaatctccctatgtatggctatagtctaaatttttcacaaaatttcagtttagaccgaaaaccgacaccgactcggaccgatg

SEQ ID NO: 7436 - DNA, 203 bp, Homo sapiens
  source 1..203: mol_type = other DNA
ggcgcgccagtcctatgtggtgctggagcatggaggctgcgtcacagtacgggttgaagggaaacccacactagactttgaattggtacaaacaaaggccacgggactagcggctgtgagggcttattgttaccaggcaaaggtcagtgatatccaaatctcagcggcatgtccagcggtacagctgacgactcggaccgatg

SEQ ID NO: 7437 - DNA, 203 bp, Homo sapiens
  source 1..203: mol_type = other DNA
ggcgcgccagtcctggaccatgcttgaggtggaacccccttacggagacagctacatcgtcattggggtcggagacggaaggctcaagcagcattggttcaagaaagggagtgtaattggaggagctttcagcaccaccatgaaaggggcgaaacgcctagcagttttgggagacgcggcatgggactcgactcggaccgatg

SEQ ID NO: 7438 - DNA, 203 bp, Homo sapiens
  source 1..203: mol_type = other DNA
ggcgcgccagtccttggaaatcaggcctgtgagtgagagagaagaaaccctgataaggtcaaaagtctccgctggagacgggaatgagatagacaccttctcactaggactactggttgcaatgttggtgacacaggaaggcctgaggaaacgctgggctactcgccatatcatggtggcttcactgacgactcggaccgatg

SEQ ID NO: 7439 - DNA, 203 bp, Homo sapiens
  source 1..203: mol_type = other DNA
ggcgcgccagtcctggcgctggacgccacgagagtcaatgctactggccatatcggcttgtttcttacacctcgtgttttcagagctaagtactgacatcacaacgctggctcataatttttccctagccttgctgatactacgagccatcatccaaacagacgtcagctctgtgacacttccagtgtcgactcggaccgatg

SEQ ID NO: 7440 - DNA, 203 bp, Homo sapiens
  source 1..203: mol_type = other DNA
ggcgcgccagtccttgtctatgatggctccttcattccagctctcagtcctaggaactttcagaatggcagtggcagtttatgttatcgtcaatctgatgatgtcaaaacggaatgatgccgtaaagaaagcggcccccagcgtggtggcagcagctctgggacaattcggaatggtgaatgcaacggcgactcggaccgatg

SEQ ID NO: 7441 - DNA, 203 bp, Homo sapiens
  source 1..203: mol_type = other DNA
ggcgcgccagtcctgactctttggaaaaactcaggtaggagtcggagtgatgcatgaaggggtgtttcacaccatgtggcacgtcactagaggggccgctttgaaaagcggagaaggaagattagacccttactggggagacgtgaagaaggacctgatttcatatggagggccatggaagttggaagcgactcggaccgatg

SEQ ID NO: 7442 - DNA, 203 bp, Homo sapiens
  source 1..203: mol_type = other DNA
ggcgcgccagtcctcgcctggcagcgacaatccctttccagcttccaacgcccccataacagacacagaagctcagattcctgacaaggcctggagcacaggcttcgattggatcacagaatatggaggaaagacagtctggttcgttcctagtgtccgcatgggaaacgagattgccgcttgcttgacgactcggaccgatg

SEQ ID NO: 7443 - DNA, 203 bp, Homo sapiens
  source 1..203: mol_type = other DNA
ggcgcgccagtcctgcatgctccttgataacatccatatgcaaaatggtctcatagctcaattgtatggccctgaacaagacaaatgtttcgccactgatggagaatttaaattgagagagaaggaaagagccactttcctggagttcctgaaggcggacttgccagtgtggctgtcatttaaggcagcgactcggaccgatg

SEQ ID NO: 7444 - DNA, 203 bp, Homo sapiens
  source 1..203: mol_type = other DNA
ggcgcgccagtcctctagttctggggttcagtaccatgacaggaaatggtgctttgatggaccagacaacaatttggtcttggaagacaatgttccagttgagatctggacgaagtcaggggaaaggaagaagctaaaacccagatggagtgacgccaggacgtattgtgaccatggtgctctcaccgcgactcggaccgatg

SEQ ID NO: 7445 - DNA, 203 bp, Homo sapiens
  source 1..203: mol_type = other DNA
ggcgcgccagtcctctttcaaagagtttgctgggggaagaaggagtgtgacgacaggccttctagaaggagttgggagactgccagaacatcttggccaacgcctgaaagaatccattgacaccctgtacttagctttcacagctgaagttggctcgcgcccccatcgagaggctatgcaagaaatgccgactcggaccgatg

SEQ ID NO: 7446 - DNA, 203 bp, Homo sapiens
  source 1..203: mol_type = other DNA
ggcgcgccagtcctgagtctttcacaagaccgagaggaaatccacagaattcacactcctgactcctccggatttaaggccagccacggcatggagcatatatgccattggaaccaccctcatcactccactgatccaccacatgattactactcactatgcaaacttctctttgatggccatggcaacgactcggaccgatg

SEQ ID NO: 7447 - DNA, 203 bp, Homo sapiens
  source 1..203: mol_type = other DNA
ggcgcgccagtcctatcaagcaggcagtctcttcggcatgcagacaggagctccattctcaaaaatggactgggcagtgccggccattgtggtcggatgctggcaacaactaactcctgccacactgatgacggctttggtcttgctagctgtccactatatctacatgattccgggatggcaggctgcgactcggaccgatg

SEQ ID NO: 7448 - DNA, 203 bp, Homo sapiens
  source 1..203: mol_type = other DNA
ggcgcgccagtcctaagaccttcaaagttggagtgagtgcgccaccctatcagccgctgcagccgccacgctttgggaaggatccccaggaaagatttggaatgcgtcaacggcttgttcactggtgaacatcttcagaggccacacgctagcagccgtacctttcatgttcaccatactgcggaacacgactcggaccgatg

SEQ ID NO: 7449 - DNA, 203 bp, Homo sapiens
  source 1..203: mol_type = other DNA
ggcgcgccagtcctctggaaatacagggaaaagaggaggtgttgagggggaaactctaggggagaaatggaaacaccttctcaatgccatggacaagtatgagttctccaggtacaaggtaaatggcatctttgaggtggatcgtgaaccagcccgtatggccctggccaacggtcttgtgacgagtgcgactcggaccgatg

SEQ ID NO: 7450 - DNA, 203 bp, Homo sapiens
  source 1..203: mol_type = other DNA
ggcgcgccagtccttggagccgtggcttaagaacaaacctgaattctgcataaaagtgttgtgcccgtacagaccaaaagtcattgagcgcctaagcgccttgcagagaacctatggagggggactcgtaagggtcccgctttcaaggaacagcacacatgaaatgtactggacttctgggacggcagcgactcggaccgatg

SEQ ID NO: 7451 - DNA, 203 bp, Homo sapiens
  source 1..203: mol_type = other DNA
ggcgcgccagtcctaggcaaaggtgaacaaccatgcagcaatgggttccatctttgaggaggagcatcaatggcagacggccaaggaagcagtggaagatccagggttctgggctctggttgacagagagagagaagctcatttggctggacggtgtgaaacctgtgtctacaacatgatgggaaaaccgactcggaccgatg

SEQ ID NO: 7452 - DNA, 203 bp, Homo sapiens
  source 1..203: mol_type = other DNA
ggcgcgccagtcctgttacgtcttgagagacatatccagaaggcctggaggaaagatgtacgctgatgacacagccggctgggatacccgcataacagaaaaagacttggacaatgaggcaaaaattatagaccagatggaaggtgaacacaagcagttggccaaggccatcatggaactcacgtacacgactcggaccgatg

SEQ ID NO: 7453 - DNA, 203 bp, Homo sapiens
  source 1..203: mol_type = other DNA
ggcgcgccagtcctggcacaaagtggtgaaagtcatgcgcccaggccctgggggaaaaacatacatggacatcatttcccgggaggaccagagaggtagtgggcaagtggtcacatatgctttgaacaccttcacaaatatgattgtgcaactcactcgatgtgcagaggcagaaggtgtcctgatcccgactcggaccgatg

SEQ ID NO: 7454 - DNA, 203 bp, Homo sapiens
  source 1..203: mol_type = other DNA
ggcgcgccagtcctcgtcaatgagagaaaggaaattgacgccagcggagcatagagctcttctcctatggttggatactgaaggagtgaaaagactgaaaaagatggccatcagtggagatgattgtgtggtgaagggagaggatgaaagattcgccactgcactgtacttcctcaatgccatggcaacgactcggaccgatg

SEQ ID NO: 7455 - DNA, 203 bp, Homo sapiens
  source 1..203: mol_type = other DNA
ggcgcgccagtcctccgcatggaccgtcagagaatcggctgggctggccaaagcttatgcgcaaatgtggaagttgatgtacttccacagacgcgacttacggctcatggccaatgcaatctgctcggccgtccccaaagactgggtccccacgggcagaaccacgtggtcaatacatggaaaaggagcgactcggaccgatg

SEQ ID NO: 7456 - DNA, 203 bp, Homo sapiens
  source 1..203: mol_type = other DNA
ggcgcgccagtcctcaccggataaaggtagacggtgctgcctgcaacctttctgcggaaggaataaccgcagtcaataaaaccaaaaagagggagttgagaaccctttgggccgcccaggcctgggattgaaccgttgatcccaggcgaagggactagaggttagaggagacccagcctttctcaccacgactcggaccgatg

SEQ ID NO: 7457 - DNA, 203 bp, Homo sapiens
  source 1..203: mol_type = other DNA
ggcgcgccagtcctacccaaggcccaaccttgctgaacctttaggcaggtaaaaggactagaggttagaggagaccccttggcaaaacagttaacgcaccaaaagaaacagcatattgacacctgggatagaccggagaatttgctgcctcgcaacacctcccacccggcacagaacgccgacatggtcgactcggaccgatg

SEQ ID NO: 7458 - DNA, 203 bp, Homo sapiens
  source 1..203: mol_type = other DNA
ggcgcgccagtcctcctcagtgaaaggaaccaacatgtgcacgatcagggctttggacgtaggctacacttgcgcttatgacacaacttacgagtgccctcacctggaagtgaccatggatccggaagacatagattgttggtgcacacttgaatctgtttatgttaactacggactctgcaagcaaacgactcggaccgatg

SEQ ID NO: 7459 - DNA, 203 bp, Homo sapiens
  source 1..203: mol_type = other DNA
ggcgcgccagtcctttatggccaaggacaaaccaacactagacatcaagttgataagaatggaagccaaggacctggccacggttcgtagttactgctaccaggccactgtcaccgactcgtcaactgaggccagatgccctaccatgggtgaagcccacaactccaaatctcttgacgccagctacgcgactcggaccgatg

SEQ ID NO: 7460 - DNA, 203 bp, Homo sapiens
  source 1..203: mol_type = other DNA
ggcgcgccagtcctacaacaaacattggcttgtcaaccgtgactggttccatgatctggatctaccctggactggacccgccactgagtcgtggaagaaccgtgagagcctcatcgagtttgaggagccccatgctactcgacaaacagtagttgctttgggtaaccaagagggcgctctgcatacggcgactcggaccgatg

SEQ ID NO: 7461 - DNA, 203 bp, Homo sapiens
  source 1..203: mol_type = other DNA
ggcgcgccagtccttcaatgtgcatgctgacaccggttgtgctattgacatggcacgtcgtgagctgaaatgtggaagtggtatcttcatccacaacgatgttgagacatggaggaacaattacaaataccacccactcacgccacgcggctttgccaaggtcattcagatgtcaaaggataaaggtgcgactcggaccgatg

SEQ ID NO: 7462 - DNA, 203 bp, Homo sapiens
  source 1..203: mol_type = other DNA
ggcgcgccagtcctgctttggatggaagaattggggaaagagctttatcttttcaaccgaaacagccaactccacattcattgtcgatggaccagaaagtaaagagtgcccaacatcagaccgggcttggaactccctagaattggaggatttcgggttcggaatcatctcaaccaagattttcctaacgactcggaccgatg

SEQ ID NO: 7463 - DNA, 203 bp, Homo sapiens
  source 1..203: mol_type = other DNA
ggcgcgccagtcctaggtcaacgagcaacggggaaactcatgcgactcagcggtgattggaacagccgtcaagggcaatgaagctgtccatagtgacttgggattctggatccagagcacaaagaatgaatcctggcaactggagagagcagtccttggggaggtcaagtcgtgcacatggccggaaacgactcggaccgatg

SEQ ID NO: 7464 - DNA, 203 bp, Homo sapiens
  source 1..203: mol_type = other DNA
ggcgcgccagtcctgccacacattgtggggcgacggagttgaggagagtgacttgattattccaatcacgctggccggaccaaaaagccaccacaacatgcgcccagggtacaagactcaaaccaaagggccctggcatgaggagacacctctcgtcatcgagtttgctgaatgtccagggaccacagcgactcggaccgatg

SEQ ID NO: 7465 - DNA, 203 bp, Homo sapiens
  source 1..203: mol_type = other DNA
ggcgcgccagtccttgacccaggaagagagttgtggcggtagaggaccatcaattaggacaacaacagcaagtggaaggaccatacgcaattggtgttgcaagaactgcacccttcctccactccgatttatggccggggaaaactgctggtatggcgtggaagtcagacccaagcgcgagaatgaggcgactcggaccgatg

SEQ ID NO: 7466 - DNA, 203 bp, Homo sapiens
  source 1..203: mol_type = other DNA
ggcgcgccagtcctaaaccctaatcaagtcaaaagtctcagcggggaatggccagaccattgagcccttccaactcgggatcctaatggcatttgtgttcacccaagaagtcctgaggaggaggtggacggcgaacctagcgttgcccacctcagccttgctaatggcttgtttcatctttggcggctcgactcggaccgatg

SEQ ID NO: 7467 - DNA, 203 bp, Homo sapiens
  source 1..203: mol_type = other DNA
ggcgcgccagtcctgtttgggaaaacggggatggcctgccagtgaagtactaacagccgtgggcatgactttcgctcttgcggggagtgttgccagactggacggagggactatggccatcccattggccaccatggccatactggctgttgcctatgtcctctcaggaaaatccactgacatgtggtcgactcggaccgatg

SEQ ID NO: 7468 - DNA, 203 bp, Homo sapiens
  source 1..203: mol_type = other DNA
ggcgcgccagtccttgaaagcccgcctccgaacggtcatactggttcccaccagagtcgtcgccgctgaaatggcagaggcacttcgtggtctccccatcaggtatcaaacatcagccgtcaaggcagaacactctgggaatgagatagtggatgccatgcgccacgcaacactgacacagcgcctgccgactcggaccgatg

SEQ ID NO: 7469 - DNA, 203 bp, Homo sapiens
  source 1..203: mol_type = other DNA
ggcgcgccagtccttaacaccagcaaaagtgccgaactacaacgtgtttgtgatggatgaagcccacttcactgacccagcaagtatagcggcaagggggtacatttcaaccaaggtggaacttggggaggctgcggccatcttcatgactgcaacaccgccgggaacgactgacccctttccagactcgactcggaccgatg

SEQ ID NO: 7470 - DNA, 203 bp, Homo sapiens
  source 1..203: mol_type = other DNA
ggcgcgccagtcctataggaagagctacgactctgagtaccagaagtgcaaaggcaatgactgggacttcgtcataacaactgacatttccgaaatgggggccaattttggcgctcatagggtcattgacagtaggaagtgcgtgaaaccagtcattctggacggagatgacagagtcctcatgaatgcgactcggaccgatg

SEQ ID NO: 7471 - DNA, 203 bp, Homo sapiens
  source 1..203: mol_type = other DNA
ggcgcgccagtccttgatgtgtgtggcatcactgggaatgttcactctgatggttcaccggaggggtctgggcaagactggactgggaaccctagtgctcgcgacggtcacggtcctcctatggatctcagatgtgccagccccaaagatagctggagttctcctaattgcattcctgctgatgatcgcgactcggaccgatg

SEQ ID NO: 7472 - DNA, 203 bp, Homo sapiens
  source 1..203: mol_type = other DNA
ggcgcgccagtccttcctcatcccagaacccgaaaagcaaaggagccagacagataaccatttggcaatctttctcgtgtgcgttcttctgttgattggggccgtttccgccaacgaaatggggtggcttgagacaaccaaaaaagacatcggaaagctgttccgctcaagtggagacacacaagagccgactcggaccgatg

SEQ ID NO: 7473 - DNA, 203 bp, Homo sapiens
  source 1..203: mol_type = other DNA
ggcgcgccagtcctagtcgacctggcaatcttgggcacccgaggtgagagcagccactgcatgggcaggttatgctgggctcacagtgttcttaacaccacttttccggcatctcatcaccacccagtatgtgagcttttccctgaccgcaattacagcccaggcctcggctttgtttggtctgagcgcgactcggaccgatg

SEQ ID NO: 7474 - DNA, 203 bp, Homo sapiens
  source 1..203: mol_type = other DNA
ggcgcgccagtcctggcacatcgaccttgaacatccgtaccggacatggcactaccacggaagctacgaggttcagcccactggatcagccaactcaatggtcaatggcgtggtgcgcctgttgtctaagccatgggacgcaattaccagcgtggtaaccatggcaatgactgacacgaccccctttgcgactcggaccgatg

SEQ ID NO: 7475 - DNA, 203 bp, Homo sapiens
  source 1..203: mol_type = other DNA
ggcgcgccagtcctgccaacaaagggtgtttaaagagaaggtggatacacgggccccagacccagcggtgggagttgctcaggcactggacatcacaacaggctggctatggaccttcctggctagaagcaagaaacccaggatgtgcacgcgtgaggagtttatcgcgaaggtcaatagcaacgcggcgactcggaccgatg

SEQ ID NO: 7476 - DNA, 203 bp, Homo sapiens
  source 1..203: mol_type = other DNA
ggcgcgccagtcctcattgggcgcggtgtttgatgagcagaaccagtggtcaacggctagagaagcagtggaagacccagccttctggaacctagttgatgaggagcgcaaagcccacctggcaggacgctgtgaaacatgcatctacaacatgatgggaaagcgagagaaaaaactaggagagttcgcgactcggaccgatg

SEQ ID NO: 7477 - DNA, 203 bp, Homo sapiens
  source 1..203: mol_type = other DNA
ggcgcgccagtcctacctggagggtggaaacatgtttgctgatgacactgcaggctgggataccagaatcacgagggctgatcttgaaaacgaagccaaagtgatgaacatgatggatggagaacataaacaactcgccaaggctataatcgaattgacctacaggcataaagtagtcaaggtcatgccgactcggaccgatg

SEQ ID NO: 7478 - DNA, 203 bp, Homo sapiens
  source 1..203: mol_type = other DNA
ggcgcgccagtcctggcctgcgcggggagggaagacagtcatggacatcatctccagggaggaccagagagggagtggccaagtagtcacctatgcacttaacaccttcaccaacctggcggctcaactagtgagatgcatggagggggaggaactgttgacggagagtgacgtgcacggcttgagcccgactcggaccgatg

SEQ ID NO: 7479 - DNA, 203 bp, Homo sapiens
  source 1..203: mol_type = other DNA
ggcgcgccagtcctcgaagaagaagcaagcagtccggaactggttgatccaaaatggaagagagaggctttcgcgcatggctgtcagtggagatgactgcgtggtgaaacccattgatgaccgattcgcgagcgcccttcatttcctcaatggcatggcaaagatcaggaaagatacccaggaatggacgactcggaccgatg

SEQ ID NO: 7480 - DNA, 203 bp, Homo sapiens
  source 1..203: mol_type = other DNA
ggcgcgccagtcctaaatccgcaacttgatcggggatgagaagtatgtggactgcatggtgtcccagcacaggttcgaaacaccttcgcccgtgctgttcaccggcgccatctaaacccaaaagaccaaaaaaggacaattgtgtcaggccatggaaacatgccacccaaagcttgtagagggtgcagcgactcggaccgatg

SEQ ID NO: 7481 - DNA, 203 bp, Homo sapiens
  source 1..203: mol_type = other DNA
ggcgcgccagtcctcctgcgccaagccccaggaggactgggttaccaaagccgttaggcccccacggcccatttcaggagacagcgcgactcctggaggaaggactagaggttagaggagacccgtggaacatcgctgaggcccaaaccagcccgaagctgtaggactggtggaaggactagaggttacgactcggaccgatg

SEQ ID NO: 7482 - DNA, 203 bp, Homo sapiens
  source 1..203: mol_type = other DNA
ggcgcgccagtccttggcttccatgaccgacttcgtgcaccttcccaaaaagaagagtggggtttccataattgggaggatgctggttttttcattcacagcagcggtcagagtcaccctagaaaacggcatgtctttgatgaaaattcaaaaggctgacgttggaaaggtcatcaccatacgcactgcgactcggaccgatg

SEQ ID NO: 7483 - DNA, 203 bp, Homo sapiens
  source 1..203: mol_type = other DNA
ggcgcgccagtcctaccgaggtgaaaacaggtgcatagtgcaagcaatggatgtgggcgaggattgtgaggacacgatgaagtatctctgcccagccatcgaaaacccttcagaacctgatgacattgactgttggtgtgacaaggcagacgccatggtgacctacgggagatgttcaaaaactcgaccgactcggaccgatg

SEQ ID NO: 7484 - DNA, 203 bp, Homo sapiens
  source 1..203: mol_type = other DNA
ggcgcgccagtcctccccagacaagcccacaatagatttggaactaacatcaacgatagccaaatcgatggcagtgactagaacttactgtgtgcaagctcaagtttcggaactgtccgtggaaactagatgtccaaccatgggcgaagcgcacaattccaagtcaagcgacgctgcctacgtgtgcacgactcggaccgatg

SEQ ID NO: 7485 - DNA, 203 bp, Homo sapiens
  source 1..203: mol_type = other DNA
ggcgcgccagtcctagaaaggattcagtgacagaggctggggaaatggatgtgggctctttgggaaaggtagcatggagacatgtgcaaagttttcatgtcagaccaaagcggaagggaggattattcaacgggagaacttggaatataccatccacatgaacgtccacgcctcacaggagaccggcccgactcggaccgatg

SEQ ID NO: 7486 - DNA, 203 bp, Homo sapiens
  source 1..203: mol_type = other DNA
ggcgcgccagtcctacagctggcttgtcaatagagactggtttcacgatgtaaaccttccatggataggaggagcagaaggtcattggaaaaacagagagtccttggtggagttcggaaaaacccatgccaccaagcgagaagtgctagccctaggttcacaagaagggacattgcaagtggctctagcgactcggaccgatg

SEQ ID NO: 7487 - DNA, 203 bp, Homo sapiens
  source 1..203: mol_type = other DNA
ggcgcgccagtcctcgggcgccatgatagcgaaatttggttcaaatgtggcaactataaatagtggacatctaaagtgcaggctgaaattggacaaactcaaaataaaaggcaccacgtaccacatgtgtaagggctcgtttgctttcacaaaaacgccttctgacacaggccacggcacggtgctgccgactcggaccgatg

SEQ ID NO: 7488 - DNA, 203 bp, Homo sapiens
  source 1..203: mol_type = other DNA
ggcgcgccagtccttagaattgacttattctggatcagatgggccatgcagggtgcccatatcaatgtctgtgagcctgagcaacatagagcccgttggtaggatggtaactgtaaaccccatagtgctatcctcttccccccagaaaacaatcatgatcgaagtggaaccaccatttggagactcctcgactcggaccgatg

SEQ ID NO: 7489 - DNA, 203 bp, Homo sapiens
  source 1..203: mol_type = other DNA
ggcgcgccagtccttcatcatcgctggaacaggcgaaccaagggcgcactaccactggaggaaatcaggaagcagcattggggcagcgtttgctaccaccatcaagggagccaggcgacttgccgtgatcggtgatgacgcatgggacttcggctctgtgggaggaatattaaactcagttgggaaagcgactcggaccgatg

SEQ ID NO: 7490 - DNA, 203 bp, Homo sapiens
  source 1..203: mol_type = other DNA
ggcgcgccagtcctgagtcagatcagttggcaggttggaacatgaaatgtggagagccaatgctagggagataaacgccatccttcttgagaatgaaaagaacctgagtgttgtcgtcttggaaagtgaatactacagaaaggccaagaacctgatgcccataggcgacgaaatgccatttggatggacgactcggaccgatg

SEQ ID NO: 7491 - DNA, 203 bp, Homo sapiens
  source 1..203: mol_type = other DNA
ggcgcgccagtcctaatacactgaggactgtgatcagaaagtgattggagccgcggtcaaaggagaattagccgctcatagtgatctaggctattggattgagagcaggtcaaaaaacggtagctgggaacttgaacgtgcttatctactagaatcaaaatcatgcagctggcccgcgacccacacaccgactcggaccgatg

SEQ ID NO: 7492 - DNA, 203 bp, Homo sapiens
  source 1..203: mol_type = other DNA
ggcgcgccagtccttttggaatggaggagtggaggaatcagagttgataatacccaagagtagagcaggcccagtgtcacaccacaacaccagaaaaggctaccataaccaaattaaaggaccatggcaccttaccccattggagatcaggtttgaaagttgcccaggaacgaccgttgtgactaccgcgactcggaccgatg

SEQ ID NO: 7493 - DNA, 203 bp, Homo sapiens
  source 1..203: mol_type = other DNA
ggcgcgccagtcctctctccatgaggccatggctgcagttggcattctatgtgccctctttggagccctggcggaaactgaggttgacttggctggaccgttggccgcggctgggctcatcgtcatggcttatgttatctcaggcagaagcaatgatctgagtatcaaaaaagttgaggatgtgaaatcgactcggaccgatg

SEQ ID NO: 7494 - DNA, 203 bp, Homo sapiens
  source 1..203: mol_type = other DNA
ggcgcgccagtcctggagtgatgaagcagaagtcactggagagagtgtcagctaccacgtgagcctagatgttcgaggagacccaacattaacggaggactcaggacctggactggaaaaggtgctgctgaaggttggattaatggcaattagcgggatttaccccgtggccattcccttcgccttggcgactcggaccgatg

SEQ ID NO: 7495 - DNA, 203 bp, Homo sapiens
  source 1..203: mol_type = other DNA
ggcgcgccagtcctgagcttggttctttctagaaaagaggtgcaagcgcgcgggagctctttgggacatcccttccccgcgggaagcaaagccagccaaggttgaggacggagtctaccgcatcttttctaggaagctgtttggcgaaagccaaattggagcaggcgttatggtaaagggcactttcccgactcggaccgatg

SEQ ID NO: 7496 - DNA, 203 bp, Homo sapiens
  source 1..203: mol_type = other DNA
ggcgcgccagtcctaagtaaggcacattcaaacgaaacctggaatcttcaaaaccagtgagggagaaatcggggctctcgaccttgactgcatggctggaacttctgggtctccaatcgtgaacaagaacggggaagtggttggactgtatggaaatggtgttctcattaaaggggatcgctacgtgacgactcggaccgatg

SEQ ID NO: 7497 - DNA, 203 bp, Homo sapiens
  source 1..203: mol_type = other DNA
ggcgcgccagtccttcttggcccctacccgtgtggtggcttcagaaatgtatgaagccttaagaggagagcctattagatacatgactccagcggtgcagagtgagagaactggaaatgaaatagtcgatttcatgtgtcactcgactttcaccatgaaactgttccaaggagtcagagttcccaattcgactcggaccgatg

SEQ ID NO: 7498 - DNA, 203 bp, Homo sapiens
  source 1..203: mol_type = other DNA
ggcgcgccagtcctcacaaagaagaggaaggattggtagaaaccctgaaaagcttggagacatctatgcttacagtggaaatgtgagctcagacaacgaaggacacgtgagctggacagaagctagaatgttgttggacaacgtccatgttcaaggaggagtggtggcccaactgtatacgcctgaaacgactcggaccgatg

SEQ ID NO: 7499 - DNA, 203 bp, Homo sapiens
  source 1..203: mol_type = other DNA
ggcgcgccagtccttgttattggaaaacaaccaggaaatagaagtgtggactaggcaaggacaaaggagagtgttgaaaccacggtggttagacggtagaattacttctgaccacttgaacttgaaaagctttaaggaatttgcatccgggaaaaggtcagccttgagcatccttgacttgattgcggcgactcggaccgatg

SEQ ID NO: 7500 - DNA, 203 bp, Homo sapiens
  source 1..203: mol_type = other DNA
ggcgcgccagtccttagttctggttagaggaaaaggaccagggaagttggcgtttgggatggtttccatcggcgtgatgacctggctgttgtggtctgcaggagtcgacccagggaagatcgcagctgccgttatcctggtctttctgctgctcgtggtgctgattcctgaacctgaaaagcagaggtcgactcggaccgatg

SEQ ID NO: 7501 - DNA, 203 bp, Homo sapiens
  source 1..203: mol_type = other DNA
ggcgcgccagtcctctgtgcaggacaaccagttagctatgctcatgttactcatagcgaccatcctaggaggggtggcagcaaatgaaatgggatggctggaaaaaacaaaagcagatctgtcatgggttgtgagagggaggagctcgaccaccaccccggtggttgaattggacatgaaacctgccacgactcggaccgatg

SEQ ID NO: 7502 - DNA, 203 bp, Homo sapiens
  source 1..203: mol_type = other DNA
ggcgcgccagtcctctgcttggacactgtacgcgttggcaacaacgcttctcactcccctttttcagcatttgattgtcactaaatatgccaatatttctttgatggctattgcttcacaagctggaaccctctttagcatggacagtggtatccccttctcctccattgagttgagtgtgcctttgccgactcggaccgatg

SEQ ID NO: 7503 - DNA, 203 bp, Homo sapiens
  source 1..203: mol_type = other DNA
ggcgcgccagtccttcgcccttgggtgctggacccagataacaccctgtagtcttattctcgcatgcgtgctcttgtcaacgcactatgcgattttgctccccggcatgcaggcacaggcagctcgagatgcccagagaaggacagcagccggcataatgaagaacgcagtggttgatggcatcgtggcgactcggaccgatg

SEQ ID NO: 7504 - DNA, 203 bp, Homo sapiens
  source 1..203: mol_type = other DNA
ggcgcgccagtcctagatgaataccttggaattccaccgatacagacggagccacatcatggaagttgaccgagagccagcgagagctgccctcaagtcaggggactttactagaggagctgccgtatcaagagggagtgccaaattaaggtggatgcatgagcgaggatacatccgactgcatgatacgactcggaccgatg

SEQ ID NO: 7505 - DNA, 203 bp, Homo sapiens
  source 1..203: mol_type = other DNA
ggcgcgccagtcctatggcagttatgtcgtgaagccttcaggaagcgcctcctcccaggtgaacggcgtggtcaagctgttgtcgaaaccatgggatgtgagctcagaagtcacgggaatgtccatgaccgacacaaccccctttggccaacagagagtgttcaaggaaaaagttgacaccaaggcgccgactcggaccgatg

SEQ ID NO: 7506 - DNA, 203 bp, Homo sapiens
  source 1..203: mol_type = other DNA
ggcgcgccagtcctacacccgaatcaccgagtgtgacttgaggaatgaagcgcacatcatggaatacatggaaaatgaacatcgaaagctagcgcgtgccatctttgaacttacctacaaacacaaagttgtgaaagtgatgagaccaggaaaaggagtaccccttatggacatcatttcacgagaagcgactcggaccgatg

SEQ ID NO: 7507 - DNA, 203 bp, Homo sapiens
  source 1..203: mol_type = other DNA
ggcgcgccagtcctaccacttccacagacttcaaatgaaagatggtagagagctagtggtaccatgtcgttctcaagatgagctaattggaagggccagggtgacgcagggtcctggagacctcatgagctcagcatgtctggccaaggcctatgcccagatgtggcagctgctgtatttccacagaacgactcggaccgatg

SEQ ID NO: 7508 - DNA, 203 bp, Homo sapiens
  source 1..203: mol_type = other DNA
ggcgcgccagtcctggagccaagcccggaggggatccggcccccgacttccggaggttgccacaccttgtaaatatgtacatacagagtcagatccgaaaggccaccagtttggtgcagaactggtgctatctgtgaacactcccaggaggactgggtaaacaaagccattagggaccatcacggccccgactcggaccgatg

SEQ ID NO: 7509 - DNA, 203 bp, Homo sapiens
  source 1..203: mol_type = other DNA
ggcgcgccagtcctgagggggagaagaacgcgaactcccccaaaggactagaggttagaggagacccgtgattagggagatgagggagcccatctcagggaaagctgtaaccctgggggaaggactagaggttagaggagaccctcccacaaagaagcgcaaacacaaaacagcatattgacacctggcgactcggaccgatg

SEQ ID NO: 7510 - DNA, 203 bp, Homo sapiens
  source 1..203: mol_type = other DNA
ggcgcgccagtcctgcgagcagacgtgttcggggggctcaccgcccggtaatcctgggagacgtcccaggatcaggggaggaccagggacgcctggtggacccctcggcagaggatcattgtgttctgatcccaccgccgcgtctagagaggcgcgctctgccatctgactctttctcttgcctctaccgactcggaccgatg

SEQ ID NO: 7511 - DNA, 203 bp, Homo sapiens
  source 1..203: mol_type = other DNA
ggcgcgccagtcctgacctcgcccagagtcccccaccatgggtgccgccctccgccaagatcgctgttgtctctagtccagagaacactcaaggaccatctgcggggaggccatccgctcctccccgaccccccatctacccggcaacagacgacttgctccttctctctgagcccccgccctatccgcgactcggaccgatg

SEQ ID NO: 7512 - DNA, 203 bp, Homo sapiens
  source 1..203: mol_type = other DNA
ggcgcgccagtcctgcggccctgccacctcctctggcccctccggcggtgggaccggcgccgggccaggcgcccgatagttccgatcctgagggaccagccgcggggaccaggagtcgccgtgcccgcagtccggcagacgactcgggtcctgactccactgtgattttgcccctccgagccataggacgactcggaccgatg

SEQ ID NO: 7513 - DNA, 203 bp, Homo sapiens
  source 1..203: mol_type = other DNA
ggcgcgccagtcctgcgtactgtaaagagaagggtcactgggacgaggagatcgccccggcgtgtactgggaggtagacttcacagaagtgaagcctggccggtatggaaacaggtatctgctggtattcatagatactttttccggatgggtagaagcttttcctaccaaaactgaaacggccctgacgactcggaccgatg

SEQ ID NO: 7514 - DNA, 203 bp, Homo sapiens
  source 1..203: mol_type = other DNA
ggcgcgccagtccttgggtcccgatgataattttctccctgtcttatttactcatttaaaggctttagaagttgtgaggacccagatctgggaccagatcaaggaggtgtacaagcccggtaccgtggcaatcccccacccgttccaggtcggggaccaagtgcttgtcagacgccatcgacccggcacgactcggaccgatg

SEQ ID NO: 7515 - DNA, 203 bp, Homo sapiens
  source 1..203: mol_type = other DNA
ggcgcgccagtcctgctgagctggacctgaacatgacccgctcccattctggtggcgagctggagagcttggctcgtgggaaaaggagcctgggttccctgagcgttgccgagccagccatgattgccgagtgcaagacacgaaccgaggtgttcgagatctcccggcgcctcatcgaccgcaccaatcgactcggaccgatg

SEQ ID NO: 7516 - DNA, 203 bp, Homo sapiens
  source 1..203: mol_type = other DNA
ggcgcgccagtcctaagacggcactgaaggagaccctcggagcctaagggcatcggcaggagaatatgggcagcgggtctcctgccagcggcctccagcatcttgcccagcagctcaagaagagaaaaaaggactgaactccaccaccatcttcttcccttaactccaaaaacttgaaataagagtgtcgactcggaccgatg

SEQ ID NO: 7517 - DNA, 203 bp, Homo sapiens
  source 1..203: mol_type = other DNA
ggcgcgccagtcctgaaagagactgatagggtcgctgtttgaaaaaaactggctccttcctctgcacctggcctgggccacacccaagtgctgtggactggcccgaggggccctgcacgtggccctgagcacctctcagcgtagcctgcctagtccctagacccctagccagctccaaggggaggcaccgactcggaccgatg

SEQ ID NO: 7518 - DNA, 203 bp, Homo sapiens
  source 1..203: mol_type = other DNA
ggcgcgccagtcctctccaagcaggccaggctacctcgggggtctagagcgccagaagaaccaaaactggtatgaagggtggttcaatagctccccttggttcactaccctactatcaaccatcgccgggcccctattactcctccttctgttgctcattctcgggccctgcatcatcaataggttagcgactcggaccgatg

SEQ ID NO: 7519 - DNA, 203 bp, Homo sapiens
  source 1..203: mol_type = other DNA
ggcgcgccagtcctgcaaggcacggaaattaccctggtaaaaagcccaaagcataggggaagtacagctaaaggtcaagtcgagaaaaacaaggagaacagggccaaacaggatatctgtggtcatgcctgggccggcccagggccaaagacagatggttcccagaaatagatgagtcaacagcagttcgactcggaccgatg

SEQ ID NO: 7520 - DNA, 203 bp, Homo sapiens
  source 1..203: mol_type = other DNA
ggcgcgccagtccttctagggtgcccctcaactgtttcaagaactcccacatgaccggagctcacccctggccttatttgaactgaccaattaccttgcttctcgcttctgtacccgcgctttttgctataaaatgagctcagaaactccactccgcgcgccagtcctccgagagactgagtcgcccgcgactcggaccgatg

SEQ ID NO: 7521 - DNA, 203 bp, Homo sapiens
  source 1..203: mol_type = other DNA
ggcgcgccagtccttataaaatgagctcagaaactccactccgcgcgccagtcctccgagagactgagtcgcccgggtacctgtgtgttcaataaaacctcttgctatttgcatccgaagccgtggtctcgttgttccttgggagggtctctcctaactgattgactgcccacctcgggggtctctcacgactcggaccgatg

SEQ ID NO: 7522 - DNA, 203 bp, Homo sapiens
  source 1..203: mol_type = other DNA
ggcgcgccagtccttttcaaagggggccctggggtctttgtcgcggagatgcgctagcatcttcgcggtaaagaacaccccaggggtaacccctttgaacgcgggactgcgatagtgccaccccacgtctttcccactcctaacccgactcccacctcgggtccaatgaaaggaccaaataattcatccgactcggaccgatg

SEQ ID NO: 7523 - DNA, 203 bp, Homo sapiens
  source 1..203: mol_type = other DNA
ggcgcgccagtccttggaatatgacagggttattttctttatcttatttctactttcacgggttctatccgtgaaaagggtacgtgttgccccttccttcttcggagaattcacacggcggtctttccgtctctcgacaagtgtgaatgcaacatgccggaaacggtgaagaaaacagttttctgcggcgactcggaccgatg

SEQ ID NO: 7524 - DNA, 203 bp, Homo sapiens
  source 1..203: mol_type = other DNA
ggcgcgccagtcctaagtctagagtgcgcatcgaaacagctgtagcgacctcacagtagcagcggactcccctcttggcgacaagagcctctgcggccaaaagccccgtggataagatccactgctgtgagcggtgcaaccccagcaccctgattcgatgaacgttctttacggaaccagaggatggtcgactcggaccgatg

SEQ ID NO: 7525 - DNA, 203 bp, Homo sapiens
  source 1..203: mol_type = other DNA
ggcgcgccagtccttaccattgattcaagatgtgttgatggaaccacaaggcaactccaactcctcggacaaaaacaattctcagtcgtcaggtaatgaaggtgtcattattaacaattattactcaaaccaatatcaaaattcaattgacctttccgctaatgctaacggcgttggcaaagaaaacacgactcggaccgatg

SEQ ID NO: 7526 - DNA, 203 bp, Homo sapiens
  source 1..203: mol_type = other DNA
ggcgcgccagtcctaagtaccatacgtgaacatttgcccaacatcatcctggacacagcatgcaaattggaccattgtggtggctgttctttcccctttgcagtacgctgcaggctcagccacggaagtggacattactctgtccatacaacctgtgaaaccagtattcaatggcttaagacactcagcgactcggaccgatg

SEQ ID NO: 7527 - DNA, 203 bp, Homo sapiens
  source 1..203: mol_type = other DNA
ggcgcgccagtcctttgtctttacgggtagtgctatgacaaaaggaaaattcttgatatcgtacacaccacctggtgcagggaaaccaacgactagagaccaagccatgcaagccacctatgctatttgggatctaggattgaattctagttacaacttcactgtccctttcatttcccccacacattcgactcggaccgatg

SEQ ID NO: 7528 - DNA, 203 bp, Homo sapiens
  source 1..203: mol_type = other DNA
ggcgcgccagtcctataactctttttctttggaatctgcttcaggagttatgaacaatattctcttgacaccattgcctagtgacagactcaaggaaaacgagtttggtttagatgagcaacatagatggttaagctttcaatcagcaactagctcaacccccccttatagaactaaacaagactggacgactcggaccgatg

SEQ ID NO: 7529 - DNA, 203 bp, Homo sapiens
  source 1..203: mol_type = other DNA
ggcgcgccagtcctcacacatgtggctggttggagctggttctacgaatcaaatttcgtttgttctgccttatacttctccactatctgtcctacctgctgtttggtttaacggattctctgacttttctaacacctcacgctttggtgttgctccaacatctgacttcggaagattgtttgtacaggcgactcggaccgatg

SEQ ID NO: 7530 - DNA, 203 bp, Homo sapiens
  source 1..203: mol_type = other DNA
ggcgcgccagtccttttacgcaatgcactcggctggtggtggcggtatggctgctgctacgataatcactcaggaaatggttgaagctgctgagaaggccttagattgtctaactcctcaaggtgcaatagttgaaattggtattgatacggttgtgcacgttccgcgaaaaaccaaactacgcaggacgactcggaccgatg

SEQ ID NO: 7531 - DNA, 203 bp, Homo sapiens
  source 1..203: mol_type = other DNA
ggcgcgccagtcctcagtagcgcacccctgcttccaaccaaagtttgaacctgccgtcctttcacgttacgaccctaggactacaaaagacgtagaccaggtcgctttctctaagcacacaactaatttggaagagcttccatctgttttctccatggttgcaaaagaatatgctaatagagtgtttacgactcggaccgatg

SEQ ID NO: 7532 - DNA, 203 bp, Homo sapiens
  source 1..203: mol_type = other DNA
ggcgcgccagtcctgatcggatcgcaacgtgttacccaggaatccacttgggtgtacgcggccgttctgacgttggaattctgtagatgaaagttagctaggagcttttaattggaaatgagaacaaaaaaaaaaaaaaaaaaaaaaaaaaaaaaaaaaaaaaaaaaaaaaaaaaaaaaaaaaaaaaacgactcggaccgatg

SEQ ID NO: 7533 - DNA, 203 bp, Homo sapiens
  source 1..203: mol_type = other DNA
ggcgcgccagtcctggtgttccagactagttcctgaggtaccaagttgtgaggggctatgggaaaacccctttgatccacactgcctgatagggtcgcggctggtcgagtcccatacactataataccagttgactttcatgcaatggacactctaactaaaaacattgaagatgaaactgtcaagatcgactcggaccgatg

SEQ ID NO: 7534 - DNA, 203 bp, Homo sapiens
  source 1..203: mol_type = other DNA
ggcgcgccagtcctacaatgtcctcggcccttcaacgaccagggtaagaagaaaccacggcggaggccaatccataaaccaaagagccctcctcaggaatctcgcatcatcatccagcctgggccaggagctgcaaatctatccaattccagtgtggtcaccatggctgagagtgtggctctagctaacgactcggaccgatg

SEQ ID NO: 7535 - DNA, 203 bp, Homo sapiens
  source 1..203: mol_type = other DNA
ggcgcgccagtccttgaaggtactgcagttgactattcaacagctgggtgtgcatcatctgtggatgatatagtcatggtgcttagacgctggcagattgtgggtgattttcagtgggctaacacagtgacccctggcaacaggattagtaggtttcaggtggtttttaatcgaatgccaacttttgccgactcggaccgatg

SEQ ID NO: 7536 - DNA, 203 bp, Homo sapiens
  source 1..203: mol_type = other DNA
ggcgcgccagtccttacgccagccaccctcatcttgcccttcactaataccacatggcgaaaaagcacacgtgaaaattatggctatataacctggcatgttgtgaatcgcctgacagtcaactcaacatccccatccacaattagctgtgtcattttgatgcgagttggtaaggattttcagtttaccgactcggaccgatg

SEQ ID NO: 7537 - DNA, 203 bp, Homo sapiens
  source 1..203: mol_type = other DNA
ggcgcgccagtcctagctcccctgtatgggaacctgcagatggccgccaatgatcagggtgattccaatcagcttggtgacgatgaaccagtgtgttttctcaattttgagactgcaaatgtgccaatacaaggggagtcgcacaccttggtgaaacatttttttggccgtcaatggctggttcgtaccgactcggaccgatg

SEQ ID NO: 7538 - DNA, 203 bp, Homo sapiens
  source 1..203: mol_type = other DNA
ggcgcgccagtccttgttcaacatactggtgaggtacaagagatggatttgccagtgcctgaccggggtcatgcatctctactgcgcttctttgcctatttctctggagaagtgattctgaccattgtcaataatggaacaacaccctgcatggttgcacactcttatacaacagacaatctcacttccgactcggaccgatg

SEQ ID NO: 7539 - DNA, 203 bp, Homo sapiens
  source 1..203: mol_type = other DNA
ggcgcgccagtccttgaatatgctgtcactgccatggggggtattcttatcccagcgaactctgccaagaatattagtatcccattttattctgtcacacctctacgccccacccgacccatgccagcatctcaggggggtggcttgacttttggcaggttgtatatctggacacaatctgggagcatcgactcggaccgatg

SEQ ID NO: 7540 - DNA, 203 bp, Homo sapiens
  source 1..203: mol_type = other DNA
ggcgcgccagtcctccttcgcccatttcgcttctgtttgagacttaaaacacttgcctttgagctccatttggaaattgaatcagaccaatttcgaaatgtcagagacctcactactgagggagttgaacccaatccaggccctattatggttgttggtaaatcaggatccggcaaaagtgtattgtgcgactcggaccgatg

SEQ ID NO: 7541 - DNA, 203 bp, Homo sapiens
  source 1..203: mol_type = other DNA
ggcgcgccagtcctctatatttgtgaacataccactcgtcctaagcaccaaaaattggttgagatggtctctggcaccttgaatcaattaaatggcatctccagtgctaaagatttgtgcttgagattgcagcatgtcttgaataagcttcaccaggtcaattttgagccagaattggaatggacacacgactcggaccgatg

SEQ ID NO: 7542 - DNA, 203 bp, Homo sapiens
  source 1..203: mol_type = other DNA
ggcgcgccagtcctccgacccgaacctcttggtatttggatttcaggtgggccaggtgttgggaagagttttttatccaactatatagttaaacaaatagcaaagaaaaggcattggaagtcttatgcaaatccaacagggtcaaagcatatggatgggtatgtttcacaggaaatccatgtttttgacgactcggaccgatg

SEQ ID NO: 7543 - DNA, 203 bp, Homo sapiens
  source 1..203: mol_type = other DNA
ggcgcgccagtccttcctgacgcactagagcgtaggtttccaatccgactcaatattaggccccttcagaaatacaatcataaaggtaggttggatgttgctactgcaatgagggatggcagtctacagaatggcacctgctgggaacgtgacattggtgggttgggccttgaacactggaatccaatcgactcggaccgatg

SEQ ID NO: 7544 - DNA, 203 bp, Homo sapiens
  source 1..203: mol_type = other DNA
ggcgcgccagtcctcaatggagacatacttgtagatgagatcctctcagagctgcaggttagacatgaagtggccaattttatgaatcagggcaaggtgcgtaggctaagtgatttggacacaatgtttgaagaattggatgaattaaaacttgattttgattttgaccgcctggaagaacaggctagcgactcggaccgatg

SEQ ID NO: 7545 - DNA, 203 bp, Homo sapiens
  source 1..203: mol_type = other DNA
ggcgcgccagtccttgccacaggattggcagttggtggcaagtatgtcttaacttttggacattctaagtttactcaattggactccatcagggatatggtctttaattcacctgccaaaggaacaccaattacttatgatgggctaccaacagatctccaactcttggattgtgacataccccaccacgactcggaccgatg

SEQ ID NO: 7546 - DNA, 203 bp, Homo sapiens
  source 1..203: mol_type = other DNA
ggcgcgccagtcctatttaaagatgtgtctaagctcatagccacagatgattaccgaggtaatggctggttggtgtggaaagatgatgatcaatatatgattcaagaggtcactaaaatcagaccctttggacaaactacaactgcttctggcacaacatcatgccaaacatacatttataattgtaacgactcggaccgatg

SEQ ID NO: 7547 - DNA, 203 bp, Homo sapiens
  source 1..203: mol_type = other DNA
ggcgcgccagtcctctacatttgttccaagctgaaagctcgctgtcctgtcttggaaatacaaccatggggtgttgccaggatgcgagcatatactgcctgcatgattatataacctgcaggcatagcagttccagggatctgctgtagtcaattaaaacctgggctcttcgtggttacggggttttccgactcggaccgatg

SEQ ID NO: 7548 - DNA, 203 bp, Homo sapiens
  source 1..203: mol_type = other DNA
ggcgcgccagtcctacttttagaatagttttgctaatcaattccccgtctaggttgatttagttagtatttagtataagaccaatggtgatataaagaccacacctaatctccactttcggtgtgtgaccctaagccattggacttctttactttactattcctccccaccctaaaaaaaaaaaaaaacgactcggaccgatg

SEQ ID NO: 7549 - DNA, 203 bp, Homo sapiens
  source 1..203: mol_type = other DNA
ggcgcgccagtcctgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcaccgactcggaccgatg

SEQ ID NO: 7550 - DNA, 203 bp, Homo sapiens
  source 1..203: mol_type = other DNA
ggcgcgccagtcctaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaagcgactcggaccgatg

SEQ ID NO: 7551 - DNA, 203 bp, Homo sapiens
  source 1..203: mol_type = other DNA
ggcgcgccagtcctgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcgactcggaccgatg

SEQ ID NO: 7552 - DNA, 203 bp, Homo sapiens
  source 1..203: mol_type = other DNA
ggcgcgccagtcctatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtcgactcggaccgatg

SEQ ID NO: 7553 - DNA, 203 bp, Homo sapiens
  source 1..203: mol_type = other DNA
ggcgcgccagtcctctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggccgactcggaccgatg

SEQ ID NO: 7554 - DNA, 203 bp, Homo sapiens
  source 1..203: mol_type = other DNA
ggcgcgccagtcctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgacgactcggaccgatg

SEQ ID NO: 7555 - DNA, 203 bp, Homo sapiens
  source 1..203: mol_type = other DNA
ggcgcgccagtcctgcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacgactcggaccgatg

SEQ ID NO: 7556 - DNA, 203 bp, Homo sapiens
  source 1..203: mol_type = other DNA
ggcgcgccagtcctcatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcgactcggaccgatg

SEQ ID NO: 7557 - DNA, 203 bp, Homo sapiens
  source 1..203: mol_type = other DNA
ggcgcgccagtcctcgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggcgactcggaccgatg

SEQ ID NO: 7558 - DNA, 203 bp, Homo sapiens
  source 1..203: mol_type = other DNA
ggcgcgccagtcctccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcacgactcggaccgatg

SEQ ID NO: 7559 - DNA, 203 bp, Homo sapiens
  source 1..203: mol_type = other DNA
ggcgcgccagtcctctccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccgactcggaccgatg

SEQ ID NO: 7560 - DNA, 203 bp, Homo sapiens
  source 1..203: mol_type = other DNA
ggcgcgccagtcctcaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacccgactcggaccgatg

SEQ ID NO: 7561 - DNA, 203 bp, Homo sapiens
  source 1..203: mol_type = other DNA
ggcgcgccagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctcgactcggaccgatg

SEQ ID NO: 7562 - DNA, 203 bp, Homo sapiens
  source 1..203: mol_type = other DNA
ggcgcgccagtcctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgacgactcggaccgatg

SEQ ID NO: 7563 - DNA, 203 bp, Homo sapiens
  source 1..203: mol_type = other DNA
ggcgcgccagtcctagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcgactcggaccgatg

SEQ ID NO: 7564 - DNA, 203 bp, Homo sapiens
  source 1..203: mol_type = other DNA
ggcgcgccagtcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacccgactcggaccgatg

SEQ ID NO: 7565 - DNA, 203 bp, Homo sapiens
  source 1..203: mol_type = other DNA
ggcgcgccagtcctcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagccgactcggaccgatg

SEQ ID NO: 7566 - DNA, 203 bp, Homo sapiens
  source 1..203: mol_type = other DNA
ggcgcgccagtcctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtacgactcggaccgatg

SEQ ID NO: 7567 - DNA, 203 bp, Homo sapiens
  source 1..203: mol_type = other DNA
ggcgcgccagtccttggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtcgactcggaccgatg

SEQ ID NO: 7568 - DNA, 203 bp, Homo sapiens
  source 1..203: mol_type = other DNA
ggcgcgccagtcctccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatccccgactcggaccgatg

SEQ ID NO: 7569 - DNA, 203 bp, Homo sapiens
  source 1..203: mol_type = other DNA
ggcgcgccagtcctatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgcgactcggaccgatg

SEQ ID NO: 7570 - DNA, 203 bp, Homo sapiens
  source 1..203: mol_type = other DNA
ggcgcgccagtcctctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtcgactcggaccgatg

SEQ ID NO: 7571 - DNA, 203 bp, Homo sapiens
  source 1..203: mol_type = other DNA
ggcgcgccagtcctgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgacgactcggaccgatg

SEQ ID NO: 7572 - DNA, 203 bp, Homo sapiens
  source 1..203: mol_type = other DNA
ggcgcgccagtcctccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaacccccgactcggaccgatg

SEQ ID NO: 7573 - DNA, 203 bp, Homo sapiens
  source 1..203: mol_type = other DNA
ggcgcgccagtcctggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgactcggaccgatg

SEQ ID NO: 7574 - DNA, 203 bp, Homo sapiens
  source 1..203: mol_type = other DNA
ggcgcgccagtcctgaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcaccgactcggaccgatg

SEQ ID NO: 7575 - DNA, 203 bp, Homo sapiens
  source 1..203: mol_type = other DNA
ggcgcgccagtccttagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccagcgactcggaccgatg

SEQ ID NO: 7576 - DNA, 203 bp, Homo sapiens
  source 1..203: mol_type = other DNA
ggcgcgccagtcctcgtttgcggtcgatatctcttcaattgggcggtgaagaccaagctcaaactcactccattgccggaagcgcgcctcctggatttatccagctggttcaccgtcggcgccggcgggggcgacatttatcacagcgtgtcgcgtgcccgaccccgcttattgctctttggcctactcgactcggaccgatg

SEQ ID NO: 7577 - DNA, 203 bp, Homo sapiens
  source 1..203: mol_type = other DNA
ggcgcgccagtcctctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacacgactcggaccgatg

SEQ ID NO: 7578 - DNA, 203 bp, Homo sapiens
  source 1..203: mol_type = other DNA
ggcgcgccagtcctggtaaagtcatcgataccctaacgtgcggattcgccgacctcatggggtacatcccgctcgtcggcgctcctgtaggaggcgtcgcaagagccctcgcgcatggcgtgagggcccttgaagacgggataaatttcgcaacagggaacttgcccggttgctccttttctatcttccgactcggaccgatg

SEQ ID NO: 7579 - DNA, 203 bp, Homo sapiens
  source 1..203: mol_type = other DNA
ggcgcgccagtcctcttcttgctctgttctcttgcttaattcatccagcagccagtctagagtggcggaatacgtctggcctctacgtccttaccaacgactgttccaatagcagtattgtgtatgaggccgatgatgtcattctgcacacacccggctgtgtaccttgtgtccaggacggcaatacacgactcggaccgatg

SEQ ID NO: 7580 - DNA, 203 bp, Homo sapiens
  source 1..203: mol_type = other DNA
ggcgcgccagtcctagacctcgacgccatcaaacggtccagacctgtaactgctcgctgtacccaggccatctttcaggacatcgaatggcttgggatatgatgatgaattggtcccccgctgtgggtatggtggtggcgcatgtcctgcgtttaccccagaccttgttcgacataatggccggggcccgactcggaccgatg

SEQ ID NO: 7581 - DNA, 203 bp, Homo sapiens
  source 1..203: mol_type = other DNA
ggcgcgccagtcctggatggggccccttaacagatgctaacatcaccggtccttctgatgacagaccatactgctggcactacgcacctagaccttgtgacattgtcccggcatcaagtgtctgcggccctgtgtactgcttcacaccatcgccagtggtcgtaggcactactgatgccaggggcgtgcgactcggaccgatg

SEQ ID NO: 7582 - DNA, 203 bp, Homo sapiens
  source 1..203: mol_type = other DNA
ggcgcgccagtcctgatcttttctgccccactgactgcttcaggaaacatcccgagaccacgtacagccggtgtggtgcagggccctggttgacacctcgttgcatggttgactacccataccggctttggcattacccatgtacagtcgatttcagattgttcaaggtgaggatgtttgtgggtgggcgactcggaccgatg

SEQ ID NO: 7583 - DNA, 203 bp, Homo sapiens
  source 1..203: mol_type = other DNA
ggcgcgccagtcctgtcacgctgaacgccgtcgctgctgctgggacacatggtatcggctggtacctggtagctttttgcgcggcgtggtacgtgcggggtaaactcgtcccgctggtgacctacagcctgacgggtctttggtccctagcattgctcgtcctcttgctcccccaacgtgcgtatgctcgactcggaccgatg

SEQ ID NO: 7584 - DNA, 203 bp, Homo sapiens
  source 1..203: mol_type = other DNA
ggcgcgccagtcctgggagtagggatggtgtcatcctgctaacaagcctgctttatccatccttaatttttgacatcactaagctgctgatggcagtattgggcccattatacttaatacaggctaccattactaccaccccctactttgtgcgtgcgcatgtactggtccgcctttgcatgctcgtgcgactcggaccgatg

SEQ ID NO: 7585 - DNA, 203 bp, Homo sapiens
  source 1..203: mol_type = other DNA
ggcgcgccagtcctcgctccgtgataggggggaaatacttccagatgatcatactgagcattggcagatggttcaacacctacctatacgaccacctagcgccaatgcaacactgggccgctgctggtctcaaagacctagcagtggccactgaacctgtaatatttagtcccatggaaatcaaggtccgactcggaccgatg

SEQ ID NO: 7586 - DNA, 203 bp, Homo sapiens
  source 1..203: mol_type = other DNA
ggcgcgccagtcctatcacctggggtgcggatacagcggcttgcggagatattctttgcgggctgcccgtctctgcacgattaggccgtgaggtgttgttgggacctgctgatgactatcgggagatgggctggcgtctgttggccccgattacagcatacgcccagcaaactaggggccttcttgggcgactcggaccgatg

SEQ ID NO: 7587 - DNA, 203 bp, Homo sapiens
  source 1..203: mol_type = other DNA
ggcgcgccagtcctactattgtgactagcttgactggcagagacaagaacgtggtgaccggtgaagtgcaggtgctttctacggctacccagaccttcctaggtacaacagtagggggggttatatggactgtttatcatggagcaggttcgagaacgctcgcgggcgccaaacatcccgcgctccaacgactcggaccgatg

SEQ ID NO: 7588 - DNA, 203 bp, Homo sapiens
  source 1..203: mol_type = other DNA
ggcgcgccagtcctctcgcctgtctcaagggttcctctggaggtcccgttatgtgcccttcggggcatgttgcggggatctttagggctgctgtgtgcaccagaggtgtagcaaaatccctacagttcataccagtggaaacccttagcacgcaggctaggtctccatctttctctgacaattcaactcgactcggaccgatg

SEQ ID NO: 7589 - DNA, 203 bp, Homo sapiens
  source 1..203: mol_type = other DNA
ggcgcgccagtcctcctcctgctgttccacagagctatcaagtaggatacctccatgccccgaccggcagcggtaagagcacaaaggtcccggccgcttatgtagcacaaggatataatgtcctcgtactaaatccatcggtggcggccacattaggcttcggctccttcatgtcgcgtgcctatgggcgactcggaccgatg

SEQ ID NO: 7590 - DNA, 203 bp, Homo sapiens
  source 1..203: mol_type = other DNA
ggcgcgccagtcctttcgattctgtcatagattgcaacgtggctgttgaacagtacgttgacttcagcctggaccccaccttttccattgagacccgcactgctccccaagatgcggtttcccgcagccaacgtcgcggccgaacgggtcgaggtagactcggtacgtaccgatatgtcgcctccggtcgactcggaccgatg

SEQ ID NO: 7591 - DNA, 203 bp, Homo sapiens
  source 1..203: mol_type = other DNA
ggcgcgccagtcctacgccccttctatatcggctggggcctgtccaaaatgaaacctgcttgacacaccccatcacaaaatacctcatggcatgcatgtcagccgatctggaagtaaccaccagcacctgggtgttgctcggaggggtcctcgcagccctagcggcctactgcttgtcagtcggctgccgactcggaccgatg

SEQ ID NO: 7592 - DNA, 203 bp, Homo sapiens
  source 1..203: mol_type = other DNA
ggcgcgccagtccttcagtcaccagtcccctgacgaccaaccaaactatgttttttaacatactcggggggtgggttgccacccatttggcagggccccagagctcctccgcgttcgtggtaagcggcttggcaggcgctgccatagggggtataggcctgggcagggtcttgcttgacatcctggcacgactcggaccgatg

SEQ ID NO: 7593 - DNA, 203 bp, Homo sapiens
  source 1..203: mol_type = other DNA
ggcgcgccagtcctggatacggagctggtgtctcaggcgccttggtagcttttaagatcatgggaggagaatgccccactgctgaggacatggtcaacctgttgcccgccatactatctccgggtgctctcgtcgtcggtgtgatatgcgcagccatactgcgccgacacgtaggacctggggagggacgactcggaccgatg

SEQ ID NO: 7594 - DNA, 203 bp, Homo sapiens
  source 1..203: mol_type = other DNA
ggcgcgccagtcctgcggtacagtggatgaacaggctcatcgcgttcgcatcccggggcaaccacgtctcaccgacgcactatgttcccgagagcgatgctgcggcaagggtcaccgcattgctgagttctctaactgtcacaagtctgctccggcggttacaccagtggatcaatgaagactacccacgactcggaccgatg

SEQ ID NO: 7595 - DNA, 203 bp, Homo sapiens
  source 1..203: mol_type = other DNA
ggcgcgccagtcctagcccttgtagcgacgattggctacgtaccatctgggactgggtttgctcggtgttggccgacttcaaggcatggctctctgctaagattatgccagcgctccctgggctgcccttcatttcctgtcaaaagggatacaagggcgtgtggcggggggacggtgtgatgtcaacacgactcggaccgatg

SEQ ID NO: 7596 - DNA, 203 bp, Homo sapiens
  source 1..203: mol_type = other DNA
ggcgcgccagtcctgctgccaacagctacgttgaggtgcgtcgggtgggggacttccattacatcacgggggccacagaagatgagctcaagtgtccgtgccaagtgccggctgctgagttctttactgaagtggatggagtgagacttcaccgctacgcccctccatgtaagcccctgttgagagatcgactcggaccgatg

SEQ ID NO: 7597 - DNA, 203 bp, Homo sapiens
  source 1..203: mol_type = other DNA
ggcgcgccagtccttccgccagccaactatcagctccgtcgttgaaggccacttgccagacgcataggcctcatccagacgctgagctagtggacgccaacttgttatggcggcaagagatgggcagcaacattacacgggtggagtctgagacaaaggttgtggttcttgattcgttcgagcctctgcgactcggaccgatg

SEQ ID NO: 7598 - DNA, 203 bp, Homo sapiens
  source 1..203: mol_type = other DNA
ggcgcgccagtcctccacggggcgctccaccggtgcctccccctcggaggaaaaggacaattcagctggacggctctaatgtgtccgcggcgctagccgcgctagctgaaaaatcattcccgtcctcgaaaccacaggaagagaatagctcatcctccggggtcgacacacagtccagcactacttcccgactcggaccgatg

SEQ ID NO: 7599 - DNA, 203 bp, Homo sapiens
  source 1..203: mol_type = other DNA
ggcgcgccagtcctaaggtgcccccttctccgggaggggagtccgactcagagtcatgctcgtctatgcctcctctcgagggagagccgggcgacccggacttgagttgcgactcttggtccaccgttagtgacagcgaggagcagagcgtggtctgctgctctatgtcgtattcttggaccggcgcccgactcggaccgatg

SEQ ID NO: 7600 - DNA, 203 bp, Homo sapiens
  source 1..203: mol_type = other DNA
ggcgcgccagtcctttaaaggaggtaaaggagcgagcgtctagggtaaaggctcgcatgctcaccatcgaggaagcgtgcgcgctcgtccctcctcactctgcccgatcgaagttcgggtatagtgcgaaggacgttcgctccttgtccagcagggccattaaccagatccgctccgtctgggaggaccgactcggaccgatg

SEQ ID NO: 7601 - DNA, 203 bp, Homo sapiens
  source 1..203: mol_type = other DNA
ggcgcgccagtcctttgctggaagacaccacaactccaattccaaccaccatcatggcgaagaacgaggtgttttgcgtggaccccgctaaagggggccgcaagcccgctcgcctcattgtgtaccctgacctgggggtgcgtgtctgtgagaaacgcgccctgtatgacgtgatacagaagttgtcacgactcggaccgatg

SEQ ID NO: 7602 - DNA, 203 bp, Homo sapiens
  source 1..203: mol_type = other DNA
ggcgcgccagtcctacagcggctgcaaaggccgcaaacctccggaacccggactttcttgtctgcggagatgatttggtcgtggtggctgagagtgatggcgtcgatgaggatagagcagccctgagagccttcacggaggctatgaccaggtattctgctccacccggagatgctccacaggccactcgactcggaccgatg

SEQ ID NO: 7603 - DNA, 203 bp, Homo sapiens
  source 1..203: mol_type = other DNA
ggcgcgccagtcctaccaagaccaacctcactccattgccagccgctggccagttggatttgtccagctggtttacggttggtgtcggcgggaacgacatttatcacagcgtgtcgcgtgcccgaacccgccatttgctgctttgcctactcctactaacagtaggggtaggcatctttctcttgccacgactcggaccgatg

SEQ ID NO: 7604 - DNA, 203 bp, Homo sapiens
  source 1..203: mol_type = other DNA
ggcgcgccagtcctacggttggtgtcggcgggaacgacatttatcacagcgtgtcgcgtgcccgaacccgccatttgctgctttgcctactcctactaacagtaggggtaggcatctttctcttgccagctcgatgagctggtaagataacactccatttcttttttgttttttttttttttttttttcgactcggaccgatg

SEQ ID NO: 7605 - DNA, 203 bp, Homo sapiens
  source 1..203: mol_type = other DNA
ggcgcgccagtcctttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatcgactcggaccgatg

SEQ ID NO: 7606 - DNA, 203 bp, Homo sapiens
  source 1..203: mol_type = other DNA
ggcgcgccagtcctgtaggcgcccccgtgggtagcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtccgactcggaccgatg

SEQ ID NO: 7607 - DNA, 203 bp, Homo sapiens
  source 1..203: mol_type = other DNA
ggcgcgccagtccttcaggcatctaccatgtcaccaatgactgcccgaattcaagcatagtgtatgaggccgaccatcacatcatgcaccttccaggttgcgtgccctgcgtgagagaggggaatcagtcacgctgctgggtggcccttactcctaccgtcgcagcgccatacatcggcgcaccgcttcgactcggaccgatg

SEQ ID NO: 7608 - DNA, 203 bp, Homo sapiens
  source 1..203: mol_type = other DNA
ggcgcgccagtcctacaggccacagaatggcctgggacatgatgatgaactggagtccaacaaccaccttagttctcgcccaggtcatgaggatcccaaccactctggtagacttactctctggaggccactggggtgtcctcgtgggggtggcctatttcagcatgcaggccaattgggccaaagtccgactcggaccgatg

SEQ ID NO: 7609 - DNA, 203 bp, Homo sapiens
  source 1..203: mol_type = other DNA
ggcgcgccagtcctaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgccgactcggaccgatg

SEQ ID NO: 7610 - DNA, 203 bp, Homo sapiens
  source 1..203: mol_type = other DNA
ggcgcgccagtccttggcactacgcgcctcggccatgcgggattgtgccagcatccagtgtgtgtggccccgtgtattgtttcactcccagccctgtcgtggtcggtactactgatcacgtcggggtccctacttacacctggggggagaacgagactgatgtcttccttttgaactcgaccagaccgcgactcggaccgatg

SEQ ID NO: 7611 - DNA, 203 bp, Homo sapiens
  source 1..203: mol_type = other DNA
ggcgcgccagtcctccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatccgactcggaccgatg

SEQ ID NO: 7612 - DNA, 203 bp, Homo sapiens
  source 1..203: mol_type = other DNA
ggcgcgccagtcctgtgctcgcgttcctgcttctcgcggacgcgagagtctctgcctacctatggatgatgtttatggtaagtcaagttgaggcggctctgtccaacctaattaacatcaatgctgcttcagccgctggtgcccaaggcttctggtacgccatcctcttcatctgcattgtctggcatcgactcggaccgatg

SEQ ID NO: 7613 - DNA, 203 bp, Homo sapiens
  source 1..203: mol_type = other DNA
ggcgcgccagtcctgtcaagggccggttcccagctgctgctgcctacgcagcctgcgggctgtggccctgttttctcctgcttctgatgctgcctgagagggcttatgcatacgaccaggaagtggcagggtcccttggcggcgccatcgttgtcatgctgaccattctgacactgtctccgcactaccgactcggaccgatg

SEQ ID NO: 7614 - DNA, 203 bp, Homo sapiens
  source 1..203: mol_type = other DNA
ggcgcgccagtccttccttcctgggtactgcggttaacggcgtgatgtggaccgtctaccacggggcgggtgccaagaccatcagcggcccgaagggacctgtcaatcaaatgtacactaatgttgaccaagacttggtggggtggccagcaccccccggagtcagatctcttgctccgtgcacctgccgactcggaccgatg

SEQ ID NO: 7615 - DNA, 203 bp, Homo sapiens
  source 1..203: mol_type = other DNA
ggcgcgccagtcctcctgctgaaaccacaacaaggctgaaagcttacttcgacacaccaggccttcctgtgtgccaagaccatctggaattctgggagagcgtctttacagggttaacccacatagacggtcatttcctatcccagaccaagcaatcgggtgagaatttcccgtatcttgttgcttaccgactcggaccgatg

SEQ ID NO: 7616 - DNA, 203 bp, Homo sapiens
  source 1..203: mol_type = other DNA
ggcgcgccagtccttgcatgtcagctgatctcgaggtagtgacaagtacgtgggtcttggtgggcggcgtcctggcagctctggctgcttactgtctttcagtgggcagcgtagtgattgttgggagagtcgtcctgtcgggccaacctgctgtcattcctgatcgcgaagtgctctaccaacagttccgactcggaccgatg

SEQ ID NO: 7617 - DNA, 203 bp, Homo sapiens
  source 1..203: mol_type = other DNA
ggcgcgccagtcctgacgaaatggaggagtgttccaaacacctcccactagtcgagcacgggttacaactggctgagcagttcaagcagaaggccttaggtctcctaaatttcgctggcaagcaagcccaagaggcaacaccagtgatccagtctaacttcgctaaacttgagcagttttgggcgaaccgactcggaccgatg

SEQ ID NO: 7618 - DNA, 203 bp, Homo sapiens
  source 1..203: mol_type = other DNA
ggcgcgccagtcctgtgctaacatccatgctgacagacccatcacacataacggcggaatcggcgcgtcggagattggctcgagggtcacgaccctcgctagctagttcctcggcgagtcagctttcgccccgtcttcttcaggccacgtgtaccgctccccatgactcccctggtactgatctcctccgactcggaccgatg

SEQ ID NO: 7619 - DNA, 203 bp, Homo sapiens
  source 1..203: mol_type = other DNA
ggcgcgccagtcctctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacacgactcggaccgatg

SEQ ID NO: 7620 - DNA, 203 bp, Homo sapiens
  source 1..203: mol_type = other DNA
ggcgcgccagtcctctgatcgtgtatccggatctcggatcccgggtttgcgagaagagagcgcttcacgacgtcatcaaaaaaactgccttagccgtgatgggagccgcttatggcttccaatactccccagcgcagcgggtggaatttcttctgactgcttggaagtcgaagaacgacccaatggggcgactcggaccgatg

SEQ ID NO: 7621 - DNA, 203 bp, Homo sapiens
  source 1..203: mol_type = other DNA
ggcgcgccagtcctgggtatcggagatgtcgcgcaaccggcgtctacaccaccagcttcgggaacacgctgacgtgctatctcaaagccacggccgccatcagggcggcggcgctgagagactgcactatgttggtttgcggtgatgacttagtcgtcatcgctgagagcgacggcgtagaggaggaccgactcggaccgatg

SEQ ID NO: 7622 - DNA, 203 bp, Homo sapiens
  source 1..203: mol_type = other DNA
ggcgcgccagtcctggagtcacctactctatcactccgctggatttaccggcaatcattcaaagactccatggcttaagcgcgttcacgctgcacggatactctccacacgaactcaaccgggtggccggagccctcagaaaacttggggtacccccgctgagagcgtggagacatcgggcccgagcacgactcggaccgatg

SEQ ID NO: 7623 - DNA, 203 bp, Homo sapiens
  source 1..203: mol_type = other DNA
ggcgcgccagtcctgtccgcgctaagcttatcgcccagggaggtagagccaaaatatgtggcatatacctctttaactgggcggtaaaaaccaaactcaaactcactccattgcctgccgctgccaaactcgatttatcgggttggtttacggtaggcgccggcgggggagacatttatcacagcatgcgactcggaccgatg

SEQ ID NO: 7624 - DNA, 203 bp, Homo sapiens
  source 1..203: mol_type = other DNA
ggcgcgccagtcctttacggtaggcgccggcgggggagacatttatcacagcatgtctcatgcccgaccccgctatttactcctgtgcctactcatacttacagtaggggtaggcatcttcctgctgcctgctcggtaggcagcttaacactccgaccttagggtcccctttttttttttttttttggcgactcggaccgatg

SEQ ID NO: 7625 - DNA, 203 bp, Homo sapiens
  source 1..203: mol_type = other DNA
ggcgcgccagtcctccttggcccctttacgccaatgaaggcctcgggtgggcagggtggttgctctccccccgaagctctcggcctaattggggccccaatgacccccggcggaaatcccccaatttgggtagggtcatccataccctaacgtgcggattcccccacctcatggggtacatcccgctccgactcggaccgatg

SEQ ID NO: 7626 - DNA, 203 bp, Homo sapiens
  source 1..203: mol_type = other DNA
ggcgcgccagtcctgtaggcggccccgttgggggcgtctcaagggctctcgcacacggtgtgaaggttcttgaagacgggataaactatgcaacagggaatctacccggttgccctttctctatctttgtccttgcacttctttggtgcctgaccgtccccgcttccgcagttccttaccgtaatgctcgactcggaccgatg

SEQ ID NO: 7627 - DNA, 203 bp, Homo sapiens
  source 1..203: mol_type = other DNA
ggcgcgccagtccttggcactatcccccacgaccgtgcggggtggtgccagcccgggatgtctgcggtccagtctactgtttcacacctagcccagtggtcgttggcactactgaccgcagagggtgtcccacttataactggggcagcaacgagactgacatccttctcttgaataacattaggccccgactcggaccgatg

SEQ ID NO: 7628 - DNA, 203 bp, Homo sapiens
  source 1..203: mol_type = other DNA
ggcgcgccagtcctctcaccccccggtgtttggtgcactacccttaccggttgtggcattacccgtgcaccgtaaattacaccatctttaaggtgcgcatgttcatcggaggcctagagcacaggcttgaagcggcatgcaattggacctatggtgagcggtgtgaccttgaagacagagatagggcccgactcggaccgatg

SEQ ID NO: 7629 - DNA, 203 bp, Homo sapiens
  source 1..203: mol_type = other DNA
ggcgcgccagtcctcatgtcaagggcaggttggtccctggggccacctacctttgcttgggcgtttggccactactcttagtccgtctcctccggccccacagggccctggccctggactcaagcgatggcgggactgtgggttgtcttgtgctaattgttcttacaatctttacacttacccctgggcgactcggaccgatg

SEQ ID NO: 7630 - DNA, 203 bp, Homo sapiens
  source 1..203: mol_type = other DNA
ggcgcgccagtccttacaaaaagaaggtagtgctggtcatgtggtggcttcagtatttcatagcccgagtggaggccatcatccacgtgtgggtgcccccgttgcaggttaagggtggtcgtgacgctgtcatcatgctcacatgcctcttccaccctgccttggggtttgagatcacaaaaatcctccgactcggaccgatg

SEQ ID NO: 7631 - DNA, 203 bp, Homo sapiens
  source 1..203: mol_type = other DNA
ggcgcgccagtcctgaccatcttgcccccatgaaggattgggcagcgtctgggctccgcgaattaacggtggccacagaacccatcgtattctccgcgatggagacgaaggtcatcacgtggggggctgacacggccgcgtgtgggaacatacttgctgttcttccggtatcagctagacggggccgccgactcggaccgatg

SEQ ID NO: 7632 - DNA, 203 bp, Homo sapiens
  source 1..203: mol_type = other DNA
ggcgcgccagtcctgaaattttcctggggccggccgacgacatcaagacgtcgggttggcgactcctcgcccctatcaccgcgtatgcgcagcagacgcgaggggtactgggcgccatagttctcagcctgaccggccgggacaaaaatgaagccgagggtgaggtgcagttcttatccacggcaacacgactcggaccgatg

SEQ ID NO: 7633 - DNA, 203 bp, Homo sapiens
  source 1..203: mol_type = other DNA
ggcgcgccagtcctttcttcgccgacggggggtgctcgggcggcgcgtatgacgtaatcatatgcgacgagtgccattcccaggacgctaccaccatccttgggataggcacagtccttgaccaggcagagacggctggagctaggctcgttgtcttggcgacggccattccccccggcagtgtaacgcgactcggaccgatg

SEQ ID NO: 7634 - DNA, 203 bp, Homo sapiens
  source 1..203: mol_type = other DNA
ggcgcgccagtcctgagactactacagtgccccaggacgcagtgtccagaagccagcgtaggggccgtacagggagaggtaggcacggcatataccggtatgtttcgtctggggagagaccgtccggcattttcgactctgtggtgctctgtgagtgctacgatgccgggtgtgcatggtatgatctgcgactcggaccgatg

SEQ ID NO: 7635 - DNA, 203 bp, Homo sapiens
  source 1..203: mol_type = other DNA
ggcgcgccagtcctactcctgctgagactaccgtgaggttgcgtgcttacctgaacacccccgggctccctgtctgtcaagaacatctggaattctgggaaggggtgttcacagggcttactaacatcgacgcccacatgctgtcacaggcaaagcagggtggggaaaacttcccataccttgtggcacgactcggaccgatg

SEQ ID NO: 7636 - DNA, 203 bp, Homo sapiens
  source 1..203: mol_type = other DNA
ggcgcgccagtccttttgatgagatggaggagtgctcagcctccttgccctatgtggacgaggcacgtgccatcgccgggcaatttaaggagaaagtgcttggcctcattggcacggctggccagaaagctgaaactctgaaaccggcagctacgtccatgtggagcaaggccgagcagttctgggcacgactcggaccgatg

SEQ ID NO: 7637 - DNA, 203 bp, Homo sapiens
  source 1..203: mol_type = other DNA
ggcgcgccagtcctaagcatatgtggaactttgtcagtgggatccaataccttgctggcctttcgaccttgccgggtaatcccgccgtggccacgttgatgtctttcaccgccgcggtgacctcccctcttacaacacatcagaccctcctttttaatattctaggagggtgggtggcctcacagatccgactcggaccgatg

SEQ ID NO: 7638 - DNA, 203 bp, Homo sapiens
  source 1..203: mol_type = other DNA
ggcgcgccagtcctctgcaggcaaaactcctcccgcaactccccggagtgcccttcttctcatgccagaaggggtacaagggtgtatggcgcggggatggagtgaactccaccaagtgtccttgcggagcgacgatatctggtcacgtgaagaacggaaccatgagaatcgtcggcccgaagctgtgccgactcggaccgatg

SEQ ID NO: 7639 - DNA, 203 bp, Homo sapiens
  source 1..203: mol_type = other DNA
ggcgcgccagtcctagtaacacctggcaaggcaccttcccaatcaacgccacaacaacagggcccagcgtacctgccccggcccccaactacaagttcgccttgtggagggtgggcgccgcggactacgcggaggtgcgccgtgtaggggactaccactacataacgggggtgacacaagacaatctgcgactcggaccgatg

SEQ ID NO: 7640 - DNA, 203 bp, Homo sapiens
  source 1..203: mol_type = other DNA
ggcgcgccagtcctaccgtcttaacatcaatgctgtcagatcccgcccacatcacggcggaaacggccaagcgcaggctaaatcgagggtctccaccctctctggcaaactcctcggccagtcagctctcagccccctctctcaaggccacctgcactatacaaggccaccacccagatgcagacctccgactcggaccgatg

SEQ ID NO: 7641 - DNA, 203 bp, Homo sapiens
  source 1..203: mol_type = other DNA
ggcgcgccagtcctggggaccctgacctttcgtcagggtcatggtcaaccgtcagcggtgaggacaacgtggtgtgttgctccatgtcatacacctggactggggcgctcatcaccccttgctctgctgaagaggaaaaattacccatcaatcccttaagcaacaccttattacgccaccacaatcttcgactcggaccgatg

SEQ ID NO: 7642 - DNA, 203 bp, Homo sapiens
  source 1..203: mol_type = other DNA
ggcgcgccagtcctgggaagaagcctgcacggctgatagtctaccccgaccttggagtccgcgtctgcgagaagcgggctttgtacgacgtagctcaaaaactgccgacagcccttatggggccctcgtatgggtttcagtactccccagcgcagcgggttgacttcttactgaaggcgtggaaatctcgactcggaccgatg

SEQ ID NO: 7643 - DNA, 203 bp, Homo sapiens
  source 1..203: mol_type = other DNA
ggcgcgccagtcctcaggggacacacgaagatgaagcgagcctgagagccttcactgaggctatgaccaggtactccgctcccccgggtgatcccccggttccagcttatgacctggagctcgtaacatcttgctcctcgaacgtgtccgtcgcccgcgatgcttcaggcaacagaatttactatctccgactcggaccgatg

SEQ ID NO: 7644 - DNA, 203 bp, Homo sapiens
  source 1..203: mol_type = other DNA
ggcgcgccagtcctctagcatttgaaatgtatgggtcagtttattctgttactccgctggatcttccagctatcattcaaagactccatggacttagcgcgttttcactccattcatactctccgagcgagatcaatagggtggctagttgcctcaggaagcttggggtaccccctttgagagcttggcgactcggaccgatg

SEQ ID NO: 7645 - DNA, 203 bp, Homo sapiens
  source 1..203: mol_type = other DNA
ggcgcgccagtcctacgctgaccggctggacttgtccagctggttcaccgttggcgctggcgggggggacatttatcacagcatgtcccgtgcccgaccccgcaacttactcctgtgcctactcctacttagcgtaggggtaggcatctttttactccccgctcggtgagctgggagctaaacactcccgactcggaccgatg

SEQ ID NO: 7646 - DNA, 203 bp, Homo sapiens
  source 1..203: mol_type = other DNA
ggcgcgccagtcctgccagccccttaacggggcgacactccaccatgatcactcccctgtgaggaactactgtcttcacgcagaaagcgtctagccatggcgttagtatgagtgtcgtgcagcctccaggcccccccctcccgggagagccatagtagtctgcggaaccggtgagtacaccggaattgcgactcggaccgatg

SEQ ID NO: 7647 - DNA, 203 bp, Homo sapiens
  source 1..203: mol_type = other DNA
ggcgcgccagtcctccaggacgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcaacatgagccgactcggaccgatg

SEQ ID NO: 7648 - DNA, 203 bp, Homo sapiens
  source 1..203: mol_type = other DNA
ggcgcgccagtcctggtcactggggtgtcctgatcgccatcgcctacttcggcatgtcaggcaattggttgaaggtaatcgctgtgttattcctgtttgcaggggtagaggcaaccaccaccgtcggcagagcggccggccgttctgcttatctcttcacctccattttctcgtctggtccaaatcagcgactcggaccgatg

SEQ ID NO: 7649 - DNA, 203 bp, Homo sapiens
  source 1..203: mol_type = other DNA
ggcgcgccagtcctaagatacagcttattaacaccaatggtagctggcacataaataggaccgctctaaactgtatcgacagtctccaaactgggtttcttagcgcgttgttctaccgcagcaatttcaactccacgggttgctcagaacggcttggcgcatgcaagcccttggaacacttccagcagcgactcggaccgatg

SEQ ID NO: 7650 - DNA, 203 bp, Homo sapiens
  source 1..203: mol_type = other DNA
ggcgcgccagtcctggatggggccctataacccacaagtccaacatcacagggccgtctgaggaccggccctactgctggcactatgctcctagggagtgtagtgtagtgccggcgtcatcagtgtgtggtcctgtttactgcttcacacctagccctgtcgtggtgggcaccaccgacaggctgggccgactcggaccgatg

SEQ ID NO: 7651 - DNA, 203 bp, Homo sapiens
  source 1..203: mol_type = other DNA
ggcgcgccagtcctcagctcctgtgccctactgactgcttccggaaacatccggaggccacatatcagaagtgtgggtcggggccctggctgacccccaggtgtctggtggactatccctacagattgtggcactatccatgcactgtcaactacacaatacacaaggttcgcatgttcattgggggccgactcggaccgatg

SEQ ID NO: 7652 - DNA, 203 bp, Homo sapiens
  source 1..203: mol_type = other DNA
ggcgcgccagtccttgggacaatagtcaggctgcatcacttggggtcgttgcccttctggtgttgacaatctttaccctcagccctatgtacaaacagctgctcacacacgctatctggtggaaccaatacatgttggctcgggctgaagctatgatacatgattgggtgccagatttgcgggtcaggcgactcggaccgatg

SEQ ID NO: 7653 - DNA, 203 bp, Homo sapiens
  source 1..203: mol_type = other DNA
ggcgcgccagtcctggcggtagggatgccatcattctgctcacctgcttgttacacccacatctcgggtttgaggtcacaaagattttgttagccatcttagcccctctgtatatcctccagcacagtctgctcaaggtgccctactttgtgcgcgcccacatcctcctgcgggcttgtatgttcttccgactcggaccgatg

SEQ ID NO: 7654 - DNA, 203 bp, Homo sapiens
  source 1..203: mol_type = other DNA
ggcgcgccagtcctcgcaaagtggcggccggtaaatatgtgcaagcttgcctcttgaggttgggcgcctggactggcacatacatatacgatcatctagctcctctcagtgagtgggcgagcgacggcttgcgtgatctagccgtagctgttgagccagtcatcttttcccccatggagaaaaagatccgactcggaccgatg

SEQ ID NO: 7655 - DNA, 203 bp, Homo sapiens
  source 1..203: mol_type = other DNA
ggcgcgccagtcctattacgtggggtgcagacaccgctgcgtgtggcgacatcttgaggggtctccctgtgtccgcgagactaggggacttggtgctgctgggacccgcggatgacatgcgtcacggaggttggaagcttctggctcccatcaccgcatacgcccaacagacgcggggactggttggccgactcggaccgatg

SEQ ID NO: 7656 - DNA, 203 bp, Homo sapiens
  source 1..203: mol_type = other DNA
ggcgcgccagtcctccgcctgcggtgcctcagacctaccaggtggggtacctgcacgctccgacgggtagcggtaaaagtactcgtgtcccggcagcttacgccacccagggatacaaggtgctagttctgaatccgtctgtagcggcaacgctgagcttcggggcatacatgagcaaagctcatggtcgactcggaccgatg

SEQ ID NO: 7657 - DNA, 203 bp, Homo sapiens
  source 1..203: mol_type = other DNA
ggcgcgccagtcctcatctcatcttctgtcactcaaagaagaaatgcgacgaactgtctaaacaactaacctcattaggtctcaatgctgtcgcattctatagaggtgtcgatgtggctgtgatccccacctcaggcgacgtcgtcgtctgcgcgacggacgcccttatgaccggctacacgggcgaccgactcggaccgatg

SEQ ID NO: 7658 - DNA, 203 bp, Homo sapiens
  source 1..203: mol_type = other DNA
ggcgcgccagtcctggattgactcacatagatgcccacttcttgtcccagacgaagcaggggggcgagaactttgcctacctcgtggcctatcaggccacggtgtgtgccagagccaaagcccccccgccgtcatgggacgtgatgtggaaatgtctcaccagacttaagccgaccctcacaggtcctcgactcggaccgatg

SEQ ID NO: 7659 - DNA, 203 bp, Homo sapiens
  source 1..203: mol_type = other DNA
ggcgcgccagtcctacccccctcctatatcgtctgggggctgtccaaaatgagatagtaacaacacatccaatcacaaagtacatcatgacctgcatgtctgcagacctggaagtcatcacaagtacgtgggtaatcgtaggtggagtccttgccgcattagcagcctactgtttgacagtgggctgtcgactcggaccgatg

SEQ ID NO: 7660 - DNA, 203 bp, Homo sapiens
  source 1..203: mol_type = other DNA
ggcgcgccagtcctgttgtcatctgtggcaggatcgtgacaagcggcaagcctgcggttgtccctgatcgggaggtcctgtaccagcagtttgatgagatggaggagtgctctaagcacatcccctacctagttgagggtcagcagattgctgagcagttcaagcaaaaggtccttgggctgctccagcgactcggaccgatg

SEQ ID NO: 7661 - DNA, 203 bp, Homo sapiens
  source 1..203: mol_type = other DNA
ggcgcgccagtcctacttgctcatgcggggctcaaattgctggacacgtgaagaacgggtctatgaagatcacaggaccccggatgtgcagcaacacttggcatggaacgtttccgatcaacgccacaactaccagccctagtgtgccggtaccggcccccaactacaaacgcgctctctggcgagttcgactcggaccgatg

SEQ ID NO: 7662 - DNA, 203 bp, Homo sapiens
  source 1..203: mol_type = other DNA
ggcgcgccagtcctgaggtgagcttctctgtgggcctcctagagtttgttgtggggtctcagctcccttgtgagccagagcctgacgtgaccgtagtcacgtcaatgctcactgacccctcacacatcaccgcagagacagcctctcggcgcttgaagaggggatctcccccctccctggcgagttcacgactcggaccgatg

SEQ ID NO: 7663 - DNA, 203 bp, Homo sapiens
  source 1..203: mol_type = other DNA
ggcgcgccagtccttccgccagccagttgtcagcgccatcacttaaagccacttgcacggcgaacggagaccacccggacgccgagctgatcgaggccaatctcctatggagacaggagatgggaagcaacatcacccgggttgagtcggagaccaaagttgtcatcctcgactcgtttgatcctctgcgactcggaccgatg

SEQ ID NO: 7664 - DNA, 203 bp, Homo sapiens
  source 1..203: mol_type = other DNA
ggcgcgccagtcctgttgcagagtatgacgacagggagatatcagtgtcagcagagtgccatagaccacctaggcctaagttccctcctgctctcccgatttgggccagacctgactacaatccacctctcctacagaaatggcaaatgcccggatacgagccccccgtcgtgtctggatgtgcgttgcgactcggaccgatg

SEQ ID NO: 7665 - DNA, 203 bp, Homo sapiens
  source 1..203: mol_type = other DNA
ggcgcgccagtcctcctccagctaaaccaacacctatcccgccaccaaggcggaagaggctcatacagctggacgagtctgctgtatcgcaagctctacaacagctggctgataaggtgtttgtggaggacactagcacctcagagccgagctccggcctcggagggtcaatagccggcccatcatctcgactcggaccgatg

SEQ ID NO: 7666 - DNA, 203 bp, Homo sapiens
  source 1..203: mol_type = other DNA
ggcgcgccagtcctcctgacccgacaacagcagatgacacgtgttctgacgcgggatcctttagctcaatgccccccctcgagggggaacctggagacccagacttgagcactggttcctggtccactgttagtgaagaggacgatgtcgtctgttgctctatgtcatacacttggacgggggccttgcgactcggaccgatg

SEQ ID NO: 7667 - DNA, 203 bp, Homo sapiens
  source 1..203: mol_type = other DNA
ggcgcgccagtcctaccgtgatgggatctgcatacggtttccagtactccccctcccaacgggtagagtacttgctcaaaatgtggcgctcgaagaaaacgccaatggggttttcatatgacaccaggtgcttcgattcgaccgtcaccgagcgggatatccgaactgaagaggacatctaccaatctcgactcggaccgatg

SEQ ID NO: 7668 - DNA, 203 bp, Homo sapiens
  source 1..203: mol_type = other DNA
ggcgcgccagtccttgccaactagaccctaccgcgaggaaagcaatatcatccctcacagaacgcctctattgtggtggcccgatgtttaactccaaaggggaatcatgtggctatcgcagatgccgtgccagtggggtgctcactaccagtttggggaacaccctcacttgttatcttaaggcacagcgactcggaccgatg

SEQ ID NO: 7669 - DNA, 203 bp, Homo sapiens
  source 1..203: mol_type = other DNA
ggcgcgccagtcctgaccttgagctgataacatcatgctcgtccaacgtctccgtagcccacgatggcaccggacagagatattactacctcacccgtgactgtaccactccacttgcgcgagctgcttgggagacagctcgccatacccctgtcaattcgtggttgggcaacatcatcatgtacgcccgactcggaccgatg

SEQ ID NO: 7670 - DNA, 203 bp, Homo sapiens
  source 1..203: mol_type = other DNA
ggcgcgccagtcctcatgggtactctccaactgaactcaacagggtgggagcgagcctcaggaagcttggggcgccacccttaagagcttggagacatcgagccagagctgtcagagccaaactcattgcccaaggtgggaaagcagcgatatgcggcaagtacctctttaactgggcagtgaagacccgactcggaccgatg

SEQ ID NO: 7671 - DNA, 203 bp, Homo sapiens
  source 1..203: mol_type = other DNA
ggcgcgccagtcctaagctcaaactcactccattggctgcggcaagccagcttgatttgtcaggctggtttgtcgcaggctacgacgggggggacatttatcacagcgtgtcccgggctcgaccccgtctgttactccttggcctactcctactcactgtaggggtaggcatctttttactccccgctcgactcggaccgatg

SEQ ID NO: 7672 - DNA, 203 bp, Homo sapiens
  source 1..203: mol_type = other DNA
ggcgcgccagtcctcgggcaactccgcagcggaaccgactactttgggtgtccgtgtttccttttattcctatattggctgcttatggtgacaattgaaagattgttaccatatagctattggattggccatccggtgtcaaacagagcaatcatttatttgtttgttggttttatacctctgaacttcgactcggaccgatg

SEQ ID NO: 7673 - DNA, 203 bp, Homo sapiens
  source 1..203: mol_type = other DNA
ggcgcgccagtcctcggcaggatttctcgcaagatcccagtaagtttaccgaaccggtaaaggatatcatgttaaaaactctaccagcgctgaattcaccaaaagcagaggagtgtgggtatagtgacagagttcgatcaataaccttaggcaactccacaatcaccactcaggaatgtgcaaatgtgcgactcggaccgatg

SEQ ID NO: 7674 - DNA, 203 bp, Homo sapiens
  source 1..203: mol_type = other DNA
ggcgcgccagtcctggcctgttcgggcagaatatgcactaccattatctcggcagatcagggtatacaatacacgtacaatgcaatgcttcaaagttccaccagggatgcgtgctggtggtgtgtgtacctgaggctgagatggggtgtgctcaaacggattccacattcgagcacacagagttgacccgactcggaccgatg

SEQ ID NO: 7675 - DNA, 203 bp, Homo sapiens
  source 1..203: mol_type = other DNA
ggcgcgccagtccttgcaacactattagagcatatcagattcccgtgcaagccaacaatgctaacacaaccacaccgattttcagcttccaagtggacccaggttatagttctgtgctaaataggacactactaggtgagatgctgaattattacgcacattggtctggcagcatcaagttgacatttcgactcggaccgatg

SEQ ID NO: 7676 - DNA, 203 bp, Homo sapiens
  source 1..203: mol_type = other DNA
ggcgcgccagtcctttgttctgtggttcagccatggccaccgggaaattgctattggcatattccccaccaggtgcatcagtcccagaaagtagaaaagacgccatgcttggcacacacataatatgggacctgggcttgcagtcaagctgtgtcttgtgtgtgccatggatcagtcaatcacattatcgactcggaccgatg

SEQ ID NO: 7677 - DNA, 203 bp, Homo sapiens
  source 1..203: mol_type = other DNA
ggcgcgccagtcctactgacctgcaaggcgacaccgatcaacgaaacggacaggtggtggataccaaagctactaacccaacgaactcaactgcggtaccggcgcttactgcagtggaaactgggcacacatcgcaggttgtgcctggcgatactattcagaccagacacgttgtgaacttccactcacgactcggaccgatg

SEQ ID NO: 7678 - DNA, 203 bp, Homo sapiens
  source 1..203: mol_type = other DNA
ggcgcgccagtcctctaagatgtgaacacggggtcattggcgtcgtgactatgggtggtgagggcgttgttggtttcgctgacgtgcgcgacctcttgtggttagaggatgatgcaatggaacagggtgttaaagactatgttgagcaattgggaaacgcctttggctcaggtttcaccaaccagatacgactcggaccgatg

SEQ ID NO: 7679 - DNA, 203 bp, Homo sapiens
  source 1..203: mol_type = other DNA
ggcgcgccagtccttactccttaccaccagaccctgatcattttgacggttacaaacagcaggctgtcgtgatcatggacgacttgtgccaaaatccagatggcaaggatgtgtccttattttgccagatggtgtcgagtgtcgactttgtgccgccaatggcagcacttgaggaaaagggcattctacgactcggaccgatg

SEQ ID NO: 7680 - DNA, 203 bp, Homo sapiens
  source 1..203: mol_type = other DNA
ggcgcgccagtcctgtgagtagggctttcatctgcctgcaagcactaactacatttgtctctgtggcggggataatatacattatctacaagttatttgctggtttccagggagcttacactggtttgcctaaccagaaacccaaagtgccgaccctgagacaggctaaagttcaaggaccagcttttcgactcggaccgatg

SEQ ID NO: 7681 - DNA, 203 bp, Homo sapiens
  source 1..203: mol_type = other DNA
ggcgcgccagtcctgaatttgcagtggccatgatgaaaagaaacgccagtactgtaaaaaccgagtacggcgagttcacaatgctcggcatctacgacaggtgggcagtgttgccccgtcatgctaagcctgggcccaccattttgatgaatgatcaagaagtgggcgtggttgatgccaaagagctgcgactcggaccgatg

SEQ ID NO: 7682 - DNA, 203 bp, Homo sapiens
  source 1..203: mol_type = other DNA
ggcgcgccagtcctaagggcaaatccaggcttattgaggcatcgagtctaaatgactcagtggccatgaggcagacctttgggaacctgtacaagacattccacttgaacccaggtatagtaacaggcagtgcagttggctgcgatcctgatttattctggagcaagattccagtcatgctcgacggccgactcggaccgatg

SEQ ID NO: 7683 - DNA, 203 bp, Homo sapiens
  source 1..203: mol_type = other DNA
ggcgcgccagtcctttcaaaggtggcgggagagttggcctcacgctgtttagcgtgagagctggctctcctgccccttcccctgagccggggatcttggctcattcccctcttttctatcctccctcattggactttacggatgacccggcataaacttgacaaccgatgttggatttcccttgtggccgactcggaccgatg

SEQ ID NO: 7684 - DNA, 203 bp, Homo sapiens
  source 1..203: mol_type = other DNA
ggcgcgccagtcctacgccacatacaccacctccagtgatgtttcgtttggaccaagacctcctcttggctcagacatagctctctcaaatgccgctgctgctaatacgggtgcattaaatcagttgaaatttgtagaagtgcaacagtttgtattgagaaataacaccaacccattcacaggcattgcgactcggaccgatg

SEQ ID NO: 7685 - DNA, 203 bp, Homo sapiens
  source 1..203: mol_type = other DNA
ggcgcgccagtcctatgctccatctctcgcccttgctggtgagggacatttgattgacacacacacccctggagggtatgcacctattagtgatttgattgacctgtctcacataccatccatggttacaaatgacacaacagattaccattactttgattggactgatacaactaataaggatgaaacgactcggaccgatg

SEQ ID NO: 7686 - DNA, 203 bp, Homo sapiens
  source 1..203: mol_type = other DNA
ggcgcgccagtcctttataggtaaatttaattttaagctaaacagtgtccccaattcggcaattttagcgaattcatattctttttttagagggcctataatttttcatgttatcgctgctgcatcaacgatgcatagaggtaggctcagagtttgctttagaccaaattctaatcaggaatatagtgcgactcggaccgatg

SEQ ID NO: 7687 - DNA, 203 bp, Homo sapiens
  source 1..203: mol_type = other DNA
ggcgcgccagtcctctcctcagtcaatggctgtatattattctcttttagacatttcccagagtaattgctgtactcttgctgtcccttttaattcggaaacgtggatgaggagcactgatgatgtgttgggaagactccagatttttgttaataaccagcttgctgctaacaggactgctgctaatccgactcggaccgatg

SEQ ID NO: 7688 - DNA, 203 bp, Homo sapiens
  source 1..203: mol_type = other DNA
ggcgcgccagtcctacactcttgtcaagcatttatttggaaggttcacatatttgggctactacactcccgacagtggtggatggaagaaggtggccctcaacattccaaaacgtggtgtggttaatttgatgagagccttctgttactggtctggtgaagctgtattgtgtataacaaataatgatgcgactcggaccgatg

SEQ ID NO: 7689 - DNA, 203 bp, Homo sapiens
  source 1..203: mol_type = other DNA
ggcgcgccagtcctacctgattacacttctggttgcccaaacttatgatgtgtttgttaatgccctgagtcttgtgtttggccgcttgccccgtaatgtgtatgatgttgctcgccgtgtattctcttcccgccccactcaacaaggctttgcttccttcacctctgcgctgcgcgcatgtgagtggtcgactcggaccgatg

SEQ ID NO: 7690 - DNA, 203 bp, Homo sapiens
  source 1..203: mol_type = other DNA
ggcgcgccagtccttgattggtatgctttgtggcgcatctctatttacccttgccactcatgctttctcatttgtctccaattgtttttcacatggtgaggatccgccaggacctggccctgactgtgtgcgtttaccagagtcagcatatgaggggtgttccacgcggaaaacagccaggcaactggcgactcggaccgatg

SEQ ID NO: 7691 - DNA, 203 bp, Homo sapiens
  source 1..203: mol_type = other DNA
ggcgcgccagtccttcatcttaggtggtagaaaaatgtactttaatacgcattatgcttcagttatcttggacaaagatgttactgtgtgtacacccaataagaagtactttacaagattaactaaggtaagttcaaattatgacacaatgattgttcaattggatattcctgagttgttgccaagcacgactcggaccgatg

SEQ ID NO: 7692 - DNA, 203 bp, Homo sapiens
  source 1..203: mol_type = other DNA
ggcgcgccagtcctgtggtggtttgctcgttggaaagattgatggagcttttaaagcactaggctttcacgctgctggaagtcttgagcgtggctttgccaacgcatttaattctgtcccccctctttcaactgtgcctgatttccctgaatctattaatttatctggattattttcaaatgatgttgcgactcggaccgatg

SEQ ID NO: 7693 - DNA, 203 bp, Homo sapiens
  source 1..203: mol_type = other DNA
ggcgcgccagtcctcttgcaccagtgttctaaattcaattgttaatgttttaatggctaggtacatttgtgctcttatggacattgactacccggtcatggtggcatatggagatgataatgttgtatcatttgatgaggagatagacatagagagaatggtttccttgtataagacagaattcggtgcgactcggaccgatg

SEQ ID NO: 7694 - DNA, 203 bp, Homo sapiens
  source 1..203: mol_type = other DNA
ggcgcgccagtcctttgattggactgaagagggctatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttcgactcggaccgatg

SEQ ID NO: 7695 - DNA, 203 bp, Homo sapiens
  source 1..203: mol_type = other DNA
ggcgcgccagtcctaagaaggaactagggaccttgaccagtgctatcaatcggcggagctcaaaacaaaagaaaagaggaggaaagaccggaattgcagtcatgattggcctgatcgccagcgtaggagcagttaccctctctaacttccaagggaaggtgatgatgacggtaaatgctactgacgtccgactcggaccgatg

SEQ ID NO: 7696 - DNA, 203 bp, Homo sapiens
  source 1..203: mol_type = other DNA
ggcgcgccagtccttatggaagatgcaccaagacacgccactcaagacgcagtcggaggtcactgacagtgcagacacacggagaaagcactctagcgaacaagaagggggcttggatggacagcaccaaggccacaaggtatttggtaaaaacagaatcatggatcttgaggaaccctggatatgcccgactcggaccgatg

SEQ ID NO: 7697 - DNA, 203 bp, Homo sapiens
  source 1..203: mol_type = other DNA
ggcgcgccagtcctggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgactcggaccgatg

SEQ ID NO: 7698 - DNA, 203 bp, Homo sapiens
  source 1..203: mol_type = other DNA
ggcgcgccagtcctcgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtacgaagtggccatttttcgactcggaccgatg

SEQ ID NO: 7699 - DNA, 203 bp, Homo sapiens
  source 1..203: mol_type = other DNA
ggcgcgccagtcctgtccatggaccaactactgtggagtcgcacggaaactactccacacaggttggagccactcaggcagggagactcagcatcactcctgcggcgccttcatacacactaaagcttggagaatatggagaggtgacagtggactgtgaaccacggtcagggattgacaccaatgcacgactcggaccgatg

SEQ ID NO: 7700 - DNA, 203 bp, Homo sapiens
  source 1..203: mol_type = other DNA
ggcgcgccagtccttactacgtgatgactgttggaacaaagacgttcttggtccatcgtgagtggttcatggacctcaacctcccttggagcagtgctggaagtactgtgtggaggaacagagagacgttaatggagtttgaggaaccacacgccacgaagcagtctgtgatagcattgggctcacaacgactcggaccgatg

SEQ ID NO: 7701 - DNA, 203 bp, Homo sapiens
  source 1..203: mol_type = other DNA
ggcgcgccagtcctgagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcacgactcggaccgatg

SEQ ID NO: 7702 - DNA, 203 bp, Homo sapiens
  source 1..203: mol_type = other DNA
ggcgcgccagtcctggggtgttcacctcagttgggaaggctgtccatcaagtgttcggaggagcattccgctcactgttcggaggcatgtcctggataacgcaaggattgctgggggctctcctgttgtggatgggcatcaatgctcgtgataggtccatagctctcacgtttctcgcagttggaggacgactcggaccgatg

SEQ ID NO: 7703 - DNA, 203 bp, Homo sapiens
  source 1..203: mol_type = other DNA
ggcgcgccagtccttgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacgactcggaccgatg

SEQ ID NO: 7704 - DNA, 203 bp, Homo sapiens
  source 1..203: mol_type = other DNA
ggcgcgccagtcctcaggagaacattttgttgatgttggcggctgttttctttcaaatggcttatcacgatgcccgccaaattctgctctgggagatccctgatgtgttgaattcactggcggtagcttggatgatactgagagccataacattcacaacgacatcaaacgtggttgttccgctgctacgactcggaccgatg

SEQ ID NO: 7705 - DNA, 203 bp, Homo sapiens
  source 1..203: mol_type = other DNA
ggcgcgccagtcctgccctgctaacacccgggctgagatgcttgaatctggatgtgtacaggatactgctgttgatggtcggaataggcagcttgatcagggagaagaggagtgcagccgcaaaaaagaaaggagcaagtctgctatgcttggctctagcctcaacaggacttttcaaccccatgatccgactcggaccgatg

SEQ ID NO: 7706 - DNA, 203 bp, Homo sapiens
  source 1..203: mol_type = other DNA
ggcgcgccagtcctcttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgcgactcggaccgatg

SEQ ID NO: 7707 - DNA, 203 bp, Homo sapiens
  source 1..203: mol_type = other DNA
ggcgcgccagtcctctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcaccgactcggaccgatg

SEQ ID NO: 7708 - DNA, 203 bp, Homo sapiens
  source 1..203: mol_type = other DNA
ggcgcgccagtcctattctgccacagatcatcaaagaggccataaacagaagactgagaacagccgtgctagcgccaaccagggttgtggctgctgagatggctgaagcactgagaggactgcccatccggtaccagacatccgcagtgcccagagaacataatggaaatgagattgttgatgtcatgcgactcggaccgatg

SEQ ID NO: 7709 - DNA, 203 bp, Homo sapiens
  source 1..203: mol_type = other DNA
ggcgcgccagtccttgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccacgactcggaccgatg

SEQ ID NO: 7710 - DNA, 203 bp, Homo sapiens
  source 1..203: mol_type = other DNA
ggcgcgccagtcctacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgacgactcggaccgatg

SEQ ID NO: 7711 - DNA, 203 bp, Homo sapiens
  source 1..203: mol_type = other DNA
ggcgcgccagtcctgcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccacgactcggaccgatg

SEQ ID NO: 7712 - DNA, 203 bp, Homo sapiens
  source 1..203: mol_type = other DNA
ggcgcgccagtcctgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctcgactcggaccgatg

SEQ ID NO: 7713 - DNA, 203 bp, Homo sapiens
  source 1..203: mol_type = other DNA
ggcgcgccagtcctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaaccgactcggaccgatg

SEQ ID NO: 7714 - DNA, 203 bp, Homo sapiens
  source 1..203: mol_type = other DNA
ggcgcgccagtcctggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtccccgactcggaccgatg

SEQ ID NO: 7715 - DNA, 203 bp, Homo sapiens
  source 1..203: mol_type = other DNA
ggcgcgccagtcctaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgacgactcggaccgatg

SEQ ID NO: 7716 - DNA, 203 bp, Homo sapiens
  source 1..203: mol_type = other DNA
ggcgcgccagtcctatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccgactcggaccgatg

SEQ ID NO: 7717 - DNA, 203 bp, Homo sapiens
  source 1..203: mol_type = other DNA
ggcgcgccagtcctgtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctcgactcggaccgatg

SEQ ID NO: 7718 - DNA, 203 bp, Homo sapiens
  source 1..203: mol_type = other DNA
ggcgcgccagtcctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctcgactcggaccgatg

SEQ ID NO: 7719 - DNA, 203 bp, Homo sapiens
  source 1..203: mol_type = other DNA
ggcgcgccagtcctccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctcgactcggaccgatg

SEQ ID NO: 7720 - DNA, 203 bp, Homo sapiens
  source 1..203: mol_type = other DNA
ggcgcgccagtcctagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatctcgactcggaccgatg

SEQ ID NO: 7721 - DNA, 203 bp, Homo sapiens
  source 1..203: mol_type = other DNA
ggcgcgccagtcctttaaaactgggctcgggttgtacccacccgagctgcccatgtggcgtggtgctcttgtatcccggtacacttgcacgccagtttgcctctccttaccccgtaacatatctagaagaatgtgcataacggaccaataggtggtggcaacccatgccactgacggtcaagtacttccgactcggaccgatg

SEQ ID NO: 7722 - DNA, 203 bp, Homo sapiens
  source 1..203: mol_type = other DNA
ggcgcgccagtccttgtttccccggtgtgatgtggaatagactctctcagggttgaagccataagcatcgttatccgctacgtgcctacgcaaaacctagtagcattttgaagcttacttggttggccgctcagccactaacccgtggtaggcctggcagatgaggctgggcgcaccccactggcgaccgactcggaccgatg

SEQ ID NO: 7723 - DNA, 203 bp, Homo sapiens
  source 1..203: mol_type = other DNA
ggcgcgccagtcctagtggcccagcctgcgtggctgcctgcccctctttgaggggaagccatttaagtgacaaggtgtgaagagtctcgtgtgctccacgtagaatccttccggcccctgaatgtggctaatcctaaccccgcagctattgcacacaatccagtgtgttgatagtcgtaatgggcaaccgactcggaccgatg

SEQ ID NO: 7724 - DNA, 203 bp, Homo sapiens
  source 1..203: mol_type = other DNA
ggcgcgccagtcctggttggtggtggaagttgcctgattgccttaaagatatgggcatcttcgggcaaaatctgtaccatcatgcattgggtaggtcagggtacataatacacacccaatgtaatgccacaaaattcaatagtggttgtctaatagtggctgttgtaccagaacaccagctagcttaccgactcggaccgatg

SEQ ID NO: 7725 - DNA, 203 bp, Homo sapiens
  source 1..203: mol_type = other DNA
ggcgcgccagtcctattgtagtaccatggatgagcggcaccttccatagacggactaaagctgacaattacacccaggctggatatgtgtcactatggtaccagactgattttgtgtcaccaaatgatgggattgggacaatcgttgctacatgctccggatgtcctgatttgtctgttagaatgctgcgactcggaccgatg

SEQ ID NO: 7726 - DNA, 203 bp, Homo sapiens
  source 1..203: mol_type = other DNA
ggcgcgccagtcctcgtgacacaccaatgatgaaacaggaaaaagatttgactcaaaacccagttgaggactacatagacaaggtggtcgacactgtactacaggtcccaaacacccaacccagtggtccacaacacagtattcaaccaagtgctttgggcgctatggaaattggggcatcttcaacccgactcggaccgatg

SEQ ID NO: 7727 - DNA, 203 bp, Homo sapiens
  source 1..203: mol_type = other DNA
ggcgcgccagtccttttgaaatgtttacatatgctagatttgacatggaagttactgttgtcaccaacaacacaggtttggtacaaatcatgtttgtaccacctggtatagatgcaccagatagtattgactcccgtctatgggattctgcctccaacccgagtgttttctatcaaccaaaatcaggtcgactcggaccgatg

SEQ ID NO: 7728 - DNA, 203 bp, Homo sapiens
  source 1..203: mol_type = other DNA
ggcgcgccagtcctagtgatctctttgtccatacagccactatgatttacaggaatgcgcacttaaccagcttgaatgacaaaaccgttctactggctctcagtgcagatctccaggtggacgcagctgaccagccaggcccagataccatcccacaatgtgactgcttggagggctgctactatagccgactcggaccgatg

SEQ ID NO: 7729 - DNA, 203 bp, Homo sapiens
  source 1..203: mol_type = other DNA
ggcgcgccagtcctatcacagctggtggagacaatcatgtagctttcacagatctaagaccctattcatgtttagacactcaccaaggtcctattcaggactatgtgacacaattagggagtgcctttggtagcggtttcactgacacacttaaagaccaattgacagatgtgagtgcccatattaaacgactcggaccgatg

SEQ ID NO: 7730 - DNA, 203 bp, Homo sapiens
  source 1..203: mol_type = other DNA
ggcgcgccagtcctgacaaaattacttcaaaggtagttaaatggctagtacgtatcatcagtgcacttaccataatgatacgtaacagtactgacacacccactgtacttgcaacccttgctcttttaggctgtcacaagtcaccatggtcatttctcaaggaccggttatgtcagtggttaaacatccgactcggaccgatg

SEQ ID NO: 7731 - DNA, 203 bp, Homo sapiens
  source 1..203: mol_type = other DNA
ggcgcgccagtcctaaaatagatctttatcaagaacaggttaaaggattttccaaagttgatgaaccagctcagcaggaactactaattaaagttgaaaaactgaagaaaggtttagacagcctagcacctctgtatgcagttgaaaacaaaagagttacaaacatctataaagaactcaaagcattgcgactcggaccgatg

SEQ ID NO: 7732 - DNA, 203 bp, Homo sapiens
  source 1..203: mol_type = other DNA
ggcgcgccagtcctgcccaaggaccatacacaggcatgcctactacacccaagaagaaacctgagttaagaagagcaaccttgcaaggtcctgaacatgaatttttgaatgcccttattagaagaaactgccatatcattaccactgacaaaggagaatttaacctactaggtatatactctaactgtcgactcggaccgatg

SEQ ID NO: 7733 - DNA, 203 bp, Homo sapiens
  source 1..203: mol_type = other DNA
ggcgcgccagtcctgctgtagtaccaacacatgctgaacctggtgacgtggtagatattgatggaaggttagttagagtgcttaaacaacaagtcctcactgatatgaatgatgtggatacggaagtaactgtgttgtggcttgaccagaatgaaaagttcagagacataagaagatttatacctgaacgactcggaccgatg

SEQ ID NO: 7734 - DNA, 203 bp, Homo sapiens
  source 1..203: mol_type = other DNA
ggcgcgccagtcctcaactttacatgcttgacatcaacccagaaccaatcaccatggaacaagcaatatatggttatgctaacttggaaccattggaccttaccactagccctggtttcccttatgtgtctttgggcgtgaaaaagaaagacatcttaaacaacgctactaaagacacaaggaaaatgcgactcggaccgatg

SEQ ID NO: 7735 - DNA, 203 bp, Homo sapiens
  source 1..203: mol_type = other DNA
ggcgcgccagtcctcaacagatgttagatctgtatggtattgatctaccctacataactttcctaaaggatgaactccgcgccccagagaaaattaaggctggtaagaccaggattgtggaggctgctagtgtcaatgatacagtgtactttagaacaacttttggcaatctatacagtacttttcatcgactcggaccgatg

SEQ ID NO: 7736 - DNA, 203 bp, Homo sapiens
  source 1..203: mol_type = other DNA
ggcgcgccagtcctgcaaacccaggtatcttaacaggctcagctgtggggtgtaatccagatgtgttttggtcacaaatgcatgctatgttagatggagaactcattgcttttgattacaccaattatgatggcagcttggaaccagtgtggtttaaagcgcttgggaaagtgttagatcagcttggccgactcggaccgatg

SEQ ID NO: 7737 - DNA, 203 bp, Homo sapiens
  source 1..203: mol_type = other DNA
ggcgcgccagtcctaccaagacaacagtttcaagtgatgaacatcgaacgtctaaactggatccgtaactggacatgttagggcaaggacttcccccctggtaacaggagcctggctggccaaaagccccgctcattgagcctagcatgttgtcgaccctggactgttcagtttagttagtacatggacgactcggaccgatg

SEQ ID NO: 7738 - DNA, 203 bp, Homo sapiens
  source 1..203: mol_type = other DNA
ggcgcgccagtcctattcacttgtcacggttcttctgaactcggtctctagtatgacagcctaaggatgccctccaggtaccccggggtaacaagtgacacccgggatctgaggaggggactactttacgtagtttaaaaaacgtctaagctgttatggtgaccagaggctggcacctttcacttttacgactcggaccgatg

SEQ ID NO: 7739 - DNA, 203 bp, Homo sapiens
  source 1..203: mol_type = other DNA
ggcgcgccagtcctaacttggtttcaacaacactctcgtaactgctgaccttgacggaaatgaaaagatcatacacggtttgcctaatagacatgataattgttggctcaattcgcttatgcaaatgaccaactgggttggagaagggtttttcaaaaacacctatgacaaccctgatctaattcctccgactcggaccgatg

SEQ ID NO: 7740 - DNA, 203 bp, Homo sapiens
  source 1..203: mol_type = other DNA
ggcgcgccagtcctatcacacagacatcactaccactcagtctaccgttggaatcacccacgggtacgcacactccgagctcgaccaagtcaatgctgccagtggtactcacgaacatgtagaccacgtgtctcgtatttacatgaaaaaactttttacttggtccatgagcgacgccacagggtattcgactcggaccgatg

SEQ ID NO: 7741 - DNA, 203 bp, Homo sapiens
  source 1..203: mol_type = other DNA
ggcgcgccagtccttgcctatgacaatctccaacggtggtagtgatctcaccagtcttgatgttcgggctagtttcacaccccttaatgttaaggttgctggacctatgcccaacaaacaaggtattgtacctgtggcagccaaagctggttattcagggttttgcaccactagtcccatcaccgcggcgactcggaccgatg

SEQ ID NO: 7742 - DNA, 203 bp, Homo sapiens
  source 1..203: mol_type = other DNA
ggcgcgccagtcctcccaacattgtataactctggaatgggataccggattgaattctgagacagtgtttaatataccctacatttcccagacttattacacttcaactcactccagtacagctgacattggtaatgtttcaggtagagtacagatataccaagttacagcaccttcctctacttcagcgactcggaccgatg

SEQ ID NO: 7743 - DNA, 203 bp, Homo sapiens
  source 1..203: mol_type = other DNA
ggcgcgccagtcctagttattagttctgttctcttctggtagagatttccagctgcgttgcccagttgagcctgtgaaacaagtcactgacgttggagaaacaggtaggtacaagatcttggatgcaactcaacaaaacggacactcggctaacaccttccgtcttcacaccgatgtttctttcgctccgactcggaccgatg

SEQ ID NO: 7744 - DNA, 203 bp, Homo sapiens
  source 1..203: mol_type = other DNA
ggcgcgccagtcctttgaccgctacgcactactcagtgttgtctctggaaacgcaagcaatacacaccagagatacaccaatcttgaccctaccaaactgcctgccgacacgttcatgaaaaagctcattgactcttgcacctactacttttctgacttggaagttacagttattgcaaaaggtgaagcgactcggaccgatg

SEQ ID NO: 7745 - DNA, 203 bp, Homo sapiens
  source 1..203: mol_type = other DNA
ggcgcgccagtcctctttttacagagttctacctacgaaatacgctggtagaactctctttgtaaaacaagaacagtttgagccattcaaccacggaggttttggtgagattatcactacagggagagaggccaccaaacacagagtacttatcagaatgaaaagagcagaaatgtactgtcctcgagcgactcggaccgatg

SEQ ID NO: 7746 - DNA, 203 bp, Homo sapiens
  source 1..203: mol_type = other DNA
ggcgcgccagtcctctctttacccttccgcctcagtgacacagctttccaccagacgaaaacttaggctaacgggtgaaattgttaagcaaggagccacgaatttcgaacttttacaacaagctggtgacgtggagaccaacccaggacccgcatctttcagtaaactaattgaagactttggatgttcgactcggaccgatg

SEQ ID NO: 7747 - DNA, 203 bp, Homo sapiens
  source 1..203: mol_type = other DNA
ggcgcgccagtcctgattagaggtttttgacaccagagtcatgatggacaatcttgtagacaggtttaaaccatactttcatgttagtccacccaaatttgactttaagactgaagttttagacaaggtcagggacttctttgctactgacgaggaagaagaggagtttgatgctactaaccccttcacgactcggaccgatg

SEQ ID NO: 7748 - DNA, 203 bp, Homo sapiens
  source 1..203: mol_type = other DNA
ggcgcgccagtccttcctggtgcctgatgagtacgctgaagcacacaactggctggaaaggaaaagagaagttctcctccaggctaatcagtatgctcttgctaagctctgtgaacccaaggttggaccaccacctgaaacaaggcctgaaccagtggttatcttgttcagaggggattccggccaggcgactcggaccgatg

SEQ ID NO: 7749 - DNA, 203 bp, Homo sapiens
  source 1..203: mol_type = other DNA
ggcgcgccagtcctacaaactcaaagtaaaccctctcattacaactgagagtgggaaccctccaactgacatgcagttggtggtactcaagaacacacaaccaatttcactagttagagatggacaaattgtcgccacttgttgtgctcttggcgtttttggaaccacctatttagttccctaccacccgactcggaccgatg

SEQ ID NO: 7750 - DNA, 203 bp, Homo sapiens
  source 1..203: mol_type = other DNA
ggcgcgccagtcctgcatactcgtcaaagatggttctcacacagtcatcataggcatccatagtgcaggaggtaacggaaaaggttacgctagttgtgtcactcgttccgcactcctcgcactgaggggcagagaaaggcccgagctcgaagggcttatgttaggagaacgacctggagagaaagttccgactcggaccgatg

SEQ ID NO: 7751 - DNA, 203 bp, Homo sapiens
  source 1..203: mol_type = other DNA
ggcgcgccagtcctctctttaccgtctctgtgctgctgagtatgcctcacatcttcacaatgttcttggcaagaccggtgcgcctttgaccaacgttgaggccgtgctcggtattgacggactcgacgccatggagcccaatactgcccccggtctaccttgggctcttcagcacaaacgcagacatgcgactcggaccgatg

SEQ ID NO: 7752 - DNA, 203 bp, Homo sapiens
  source 1..203: mol_type = other DNA
ggcgcgccagtcctcttgtcactcaacccagctcatgtcagttatggctgacgaggttttctcagacgcatacggttttgatgagagggcacgttacgctgtgaaatccttgtgcaagacagtccatgcatacgaggacaagcgtatcaccatagatggtggtttaccttcaggttgtagtgccaccacgactcggaccgatg

SEQ ID NO: 7753 - DNA, 203 bp, Homo sapiens
  source 1..203: mol_type = other DNA
ggcgcgccagtcctacaccataacacctgaagacaagtctgacaatggttttactttaggtaagaacattacagatgtcacatttcttaaacgcgctttcgaacgcgattgtgtcctagggttttacaaacccgtgatgaactccaaggttttggaggccatcctgtcctttgcacggcgtggcacaccgactcggaccgatg

SEQ ID NO: 7754 - DNA, 203 bp, Homo sapiens
  source 1..203: mol_type = other DNA
ggcgcgccagtccttccaggagaagctaacctcagtggcaggtcttgctttccacagtggagaagaagagtacaacagacttttctctccatttgtggggagtttcgagattccgtcatacaggtgccttcgcctgagatgggtacacaaaatgtcaaattgaattgaacataaccaaactaactccacgactcggaccgatg

SEQ ID NO: 7755 - DNA, 203 bp, Homo sapiens
  source 1..203: mol_type = other DNA
ggcgcgccagtcctttccccgggagggtctgacggtaagctgtacccacggctgaagtatgacctaccgttaaccggctacctacttcgagaagtctagtaataccattgaagttttgttggcgttacgctcaacacactaccccgtgtgtagttttggctgatgagtcacggcattccccacgggcgcgactcggaccgatg

SEQ ID NO: 7756 - DNA, 203 bp, Homo sapiens
  source 1..203: mol_type = other DNA
ggcgcgccagtcctgccataacaactggactctttgtgtagtgccagttgttcccctagattactcagatggagcaaccacagtagttccagtcactgtaaccttggccccaatgtgttgtgagtttgatgggttaagaaatgcagtttcacagggcttgccagttaaggcaactccaggatcttatccgactcggaccgatg

SEQ ID NO: 7757 - DNA, 203 bp, Homo sapiens
  source 1..203: mol_type = other DNA
ggcgcgccagtcctgcaagatattgatagcatacacccctccaggaggtagcgcacctacagatcgaaagagtgctatgttaggcacccacataatttgggattttgggctacaatcctcagccacccttgttattccctggattagtaatacatgtatgcgaaatgttgctagcttggcctatcaggcgactcggaccgatg

SEQ ID NO: 7758 - DNA, 203 bp, Homo sapiens
  source 1..203: mol_type = other DNA
ggcgcgccagtcctttgatgcagagttcaccatgctagtgtgtgcggatgaagagattaacccttataatatacagtacatgtatgttccaccaggtagcggtgttccatctgatcatgattcttacttgtggcaatcaggtaccaacccatccatatacgtaaaatccactgatccacccgctcaatcgactcggaccgatg

SEQ ID NO: 7759 - DNA, 203 bp, Homo sapiens
  source 1..203: mol_type = other DNA
ggcgcgccagtcctataactacatgcggttcaagaccaaatcccgcattgaacctgtatgtttgttaatacatgggagcccaggtgcagggaagtccgttgtatccagcctggtggggcgtgccattgctgaaaagatgaacagctcagtttattcccttccaccagacccagatcattttgatggttcgactcggaccgatg

SEQ ID NO: 7760 - DNA, 203 bp, Homo sapiens
  source 1..203: mol_type = other DNA
ggcgcgccagtcctctataatctgtggaaaagccctgatgttcagtgataggcggacttcagtgcgttacaccactgatatgctggtctcagagatgtttagggaatactcacacaggaactcaattggcaatgtgcttgaggcactctttcagggaccaccagtctacaaggaattgaaaatttcagcgactcggaccgatg

SEQ ID NO: 7761 - DNA, 203 bp, Homo sapiens
  source 1..203: mol_type = other DNA
ggcgcgccagtccttgagaagaaatgagaaattcagggacatccgagggtttttgccaaatgaaccaggagaaattggtgatgcagtgcttgctattaatactagcaggttcccaaacatgtttattcctgtaggaaaggtgactgaatatggatttctcaatctaagtgggacaccaacacacagagcgactcggaccgatg

SEQ ID NO: 7762 - DNA, 203 bp, Homo sapiens
  source 1..203: mol_type = other DNA
ggcgcgccagtccttgctcatgtacaacttccctactaaatcagggcagtgcggtggagtgctaatggcaacaggaaaagttctaggaatccatgtgggaggcaatggacaccaaggctttgctgctactcttttgaggtcttactttaatgaagaacagggtcagattgaatggattgagaccaacacgactcggaccgatg

SEQ ID NO: 7763 - DNA, 203 bp, Homo sapiens
  source 1..203: mol_type = other DNA
ggcgcgccagtcctaagaatcaggctatccaataatcaatgcccccaccaagaccaaattggaacccagtgtgttccacgatatctttgagggaaagaaagaaccagcagtcctgaacccaagagacccacgtttgaagactgattttgaggaagccattttctccaagtatgtagggaatgtgaacgcgactcggaccgatg

SEQ ID NO: 7764 - DNA, 203 bp, Homo sapiens
  source 1..203: mol_type = other DNA
ggcgcgccagtcctgtccagtgtggttcgctgcactaaaactggtactggaaaagttaggttacactagtgatgaaaccaagtatattgactacttgtgtaactcataccacttgtataaaaacaagcattactttgtgagaggagggatgccatcgggatgttctggcacttctatcttcaacagtacgactcggaccgatg

SEQ ID NO: 7765 - DNA, 203 bp, Homo sapiens
  source 1..203: mol_type = other DNA
ggcgcgccagtccttctccccgggaggggctaatggtacgctgtgcccacggcggaaatgagccctaccgttaaccggcagtctacttcgggaagcccagtaactacattgaaactttgaggcgttacactcagcacataaccccaatgtgtagttctggtcgatgagccttggcatcccccacaggccgactcggaccgatg

SEQ ID NO: 7766 - DNA, 203 bp, Homo sapiens
  source 1..203: mol_type = other DNA
ggcgcgccagtcctaacttttaccactgatcaagataaaaatgggagcgcaggtgtctactcaaaagactggtgcgcatgaaactggtaacgttgccactggaggctcaacaataaattacacctccataaattattataaggattcagcatctaattcagctaacagacaggacttctctcaagacccgactcggaccgatg

SEQ ID NO: 7767 - DNA, 203 bp, Homo sapiens
  source 1..203: mol_type = other DNA
ggcgcgccagtccttgtatcattatttaggtcgagcagggtacaccttccatgtacaatgcaacgcttccaggtttcaccaagggtgtcttcttgtagtgtgcgtaccagaagcagaaatggggtgttctaacgtgaacaatcaacccagttttgaacagttggctaatggagacacggcacatgtttcgactcggaccgatg

SEQ ID NO: 7768 - DNA, 203 bp, Homo sapiens
  source 1..203: mol_type = other DNA
ggcgcgccagtccttcactgaagatgccgcaactggtgaacagggagtacagacagccgtttgcaacgcagcaatgggagttggtgtggggaacctgaccatctacccccatcagtggataaatttaagaacaaacaacagtgctacaatagtcatgccatatattaattgtgtaccaatggacaatacgactcggaccgatg

SEQ ID NO: 7769 - DNA, 203 bp, Homo sapiens
  source 1..203: mol_type = other DNA
ggcgcgccagtccttgcaaagacataataacttgacactgatgataataccatttgttgagttagattactctgcaggggcaactacattcgttcccattaccgtgactgttgcccctatgtgcgcagagtataacggccttcgcctagcctcaccacagggcttgccaacaatgaatacaccaggtacgactcggaccgatg

SEQ ID NO: 7770 - DNA, 203 bp, Homo sapiens
  source 1..203: mol_type = other DNA
ggcgcgccagtcctcaacgggtaagttgattctggcttattcacctccaggtgctggtgccccaacaaacaggaaacaggccatgctgggcacccacgttatatgggacttaggattgcaatctagctgtgtgctgtgtgtcccatggatcagccaaacccactacaggtatgtagtggtcgacacatcgactcggaccgatg

SEQ ID NO: 7771 - DNA, 203 bp, Homo sapiens
  source 1..203: mol_type = other DNA
ggcgcgccagtccttctaccctgtgtccttccaaggccctggcattgtgcagatggcggcaaatgagtactaccccgaaagagcgcaaacacatgtcttgctggctaatggcccagcacaacctggtgattgcggcgggttgctgtgttgtacgcatggagtggttggcatcctcacagcgggtggtgcgactcggaccgatg

SEQ ID NO: 7772 - DNA, 203 bp, Homo sapiens
  source 1..203: mol_type = other DNA
ggcgcgccagtccttacagttcaagtccaaatgccgcattgaacctgtgtgtctgctgttgcacggagctccaggagcgggtaaatcagtagccaccaatttgattggcagagcaattgcagagaagttaaatagctcagtatattctctaccacctgatccggaccactttgatggatataaacaaccgactcggaccgatg

SEQ ID NO: 7773 - DNA, 203 bp, Homo sapiens
  source 1..203: mol_type = other DNA
ggcgcgccagtcctaggcagtggttattatggacgatttatgtcaaaaccccgatggaaaggatgtgtccctgttctgtcagatggtatctagtgttgactttgttccaccaatggctgcactagaagaaaagggaattttgttcacatcaccgtttgtgttggcttcaaccaatgctagctccatcccgactcggaccgatg

SEQ ID NO: 7774 - DNA, 203 bp, Homo sapiens
  source 1..203: mol_type = other DNA
ggcgcgccagtcctatgccccaactgtttcagatagtagggctcttgcaagaagattccattttgacatgaacatagagatcctagacatgtaccagcagagcgggaagttgaacatgccattggcagccaagtcatgtgatgatgagtgtattccggcgaatttcaaaaaatgttgtcccttagtgtcgactcggaccgatg

SEQ ID NO: 7775 - DNA, 203 bp, Homo sapiens
  source 1..203: mol_type = other DNA
ggcgcgccagtcctatatgccgcccccacctgctattgctgatttgttgaagagcgtggatagtgaagaattgagggaatactgtaaggagaaaggttggattattccagaacaggcctctagcctagtcaccgaaaaacatataagtagggcctttatttgcctacaagccctcactacctttatttcgactcggaccgatg

SEQ ID NO: 7776 - DNA, 203 bp, Homo sapiens
  source 1..203: mol_type = other DNA
ggcgcgccagtcctataggaacgaaaagttcagggacattagagggtttataccaaaggaggaatctgagattggtgacgccatcctggctatgaatactagcaagtttccaaacatgttcataccagtgggtcaggtcactgagtatggtttcttaaacctgagtggagtccccacacaccgcatgccgactcggaccgatg

SEQ ID NO: 7777 - DNA, 203 bp, Homo sapiens
  source 1..203: mol_type = other DNA
ggcgcgccagtccttcatgtacaactttccaacaagagccgggcagtgtggtgggatactgatggccactggtaaagtactcggcattcatgttggcggtaatggtcaccaagggtttgctgctgcactgctcagacactacttcgctgatgaacagggtgaaattgagtggacggtgcctagtaaggcgactcggaccgatg

SEQ ID NO: 7778 - DNA, 203 bp, Homo sapiens
  source 1..203: mol_type = other DNA
ggcgcgccagtcctttaataatataataatcaggacccttttgttgaaagtgtataagaacattgatcttgataaatttaggatgattgcatatggagatgacgtaattgcatcatacccatattcaatagatgcaggcctacttgctaaggcggggaaggagtacggtctgacaatgacaccagctgcgactcggaccgatg

SEQ ID NO: 7779 - DNA, 203 bp, Homo sapiens
  source 1..203: mol_type = other DNA
ggcgcgccagtcctgcctgtgggaaaatgccttctactcccagcctactctacattacgtagaaagtggcttgattcattttaattaggcccatatttgactttaatttggctaattgggttaaccctgtcacgtatctggacgtgacataagcgtgacaggggtaaatttagcacaaccagagtgctcgactcggaccgatg

SEQ ID NO: 7780 - DNA, 203 bp, Homo sapiens
  source 1..203: mol_type = other DNA
ggcgcgccagtcctaatcccctacgtccttgattcaggtgtcccattatctcaagctcttatatacccacatcaatggatcaatctgaggacaaacaactgcgccacgatagtgatgccatacattaatgctgtgccttatgacagtgctttaaaccactgcaattttgggttagctattatccctgtcgactcggaccgatg

SEQ ID NO: 7781 - DNA, 203 bp, Homo sapiens
  source 1..203: mol_type = other DNA
ggcgcgccagtccttgccactgctgatgatggacaagcagattctacaatgatacagtatatgtacataccaccaggtgctcccaaaccaacacagagagattcatttgaatggcagtcagccaccaatccttccatctttgttaggatggctgacccaccagcccaagtttctgtccctttcatgtccgactcggaccgatg

SEQ ID NO: 7782 - DNA, 203 bp, Homo sapiens
  source 1..203: mol_type = other DNA
ggcgcgccagtcctgatgaaacacattagagcttgggtgccaagaccattcagaagccagccataccttctaaagaattatccaaacatggatggtacaaatttgaagtgcgctagcaccagcagagccaagataacaaccacaggggccttcggtcaacagtccggtgctatctatgtctgcaattacgactcggaccgatg

SEQ ID NO: 7783 - DNA, 203 bp, Homo sapiens
  source 1..203: mol_type = other DNA
ggcgcgccagtcctggaaaagatcctcaaaaacttggtcaagattgtgtcagcactggtcatagtaatcaggagtgactacgacctagtcacgatgactgcaacacttgctttgatcggttgccacacaagcccatgggcatggttgaaatcaaaagtgtgtagcttccttggcctaccgatagcgcacgactcggaccgatg

SEQ ID NO: 7784 - DNA, 203 bp, Homo sapiens
  source 1..203: mol_type = other DNA
ggcgcgccagtcctcaagaacaaacaacggattgaacctgtatgtttgatcatccgcggcgctccaggcacaggaaagtcactcgccacaggcatcattgctagagctattgcagaaaaataccactctagtgtttactccttgccaccagacccagaccattttgatggttaccgccagcaagttgtcgactcggaccgatg

SEQ ID NO: 7785 - DNA, 203 bp, Homo sapiens
  source 1..203: mol_type = other DNA
ggcgcgccagtccttgtcatctacaaattgtttgctggttttcagggtgcttattcgggtatgcctaaaactgcactgaagaagccagtgttgagaactgccacagtgcaaggaccctgccttgactttgccttgtccctacttcgtaggaatattagacaagtgcagacagacaaaggccactttaccgactcggaccgatg

SEQ ID NO: 7786 - DNA, 203 bp, Homo sapiens
  source 1..203: mol_type = other DNA
ggcgcgccagtcctcatgctcggcgtgcgtgaccgcattgctgtactgcctcgccatgctgagccaagtggaaccatctggatcgaaggcaagcaggtcaaagtcttagatgctgttgagttggtagatgaacaacaagtcaatcttgaactcactcttgttactcttgacatgaacgaaaagttcagcgactcggaccgatg

SEQ ID NO: 7787 - DNA, 203 bp, Homo sapiens
  source 1..203: mol_type = other DNA
ggcgcgccagtcctcaaagctgggcaatgtggtggagtggtcaccagtgttggtaaaattattggaattcatgttggaggaaatgggcgccagggcttttgtgcagccttgaagcggtgttacttcaccactgagcaaggtgagattcaatggatgaaaccaaatagtgagactggtagatacaatatcgactcggaccgatg

SEQ ID NO: 7788 - DNA, 203 bp, Homo sapiens
  source 1..203: mol_type = other DNA
ggcgcgccagtccttcaagcagctcaccattacgccaaccagctcaagcagctgaacatagacacatccaaaatgtctatggttgatgcctgttatggaactgaaaacctggaagcaatagaccttagcactagtgctggttacccatacaatgcattaggcgtcaagaaaaggcagattctgaaccccgactcggaccgatg

SEQ ID NO: 7789 - DNA, 203 bp, Homo sapiens
  source 1..203: mol_type = other DNA
ggcgcgccagtcctcgggcatctattcgaggctttccacgccaatccaggcactattactggatctgctgtcggctgcaacccagacactttctggagcaagattcctatactcctaccaggatcactctttgcctttgattacacaggttatgatgctagtttgagccctgcatggtttagagctctcgactcggaccgatg

SEQ ID NO: 7790 - DNA, 203 bp, Homo sapiens
  source 1..203: mol_type = other DNA
ggcgcgccagtccttgttaccccgggcttagtaccaatagactgccatcgcggttgaaggggaaaacgctcgttatccggctctctactgcgagaagcctagtaacgccttagaaatgctcaagcgttgcgctcagcacaaccccagtgtagctcaggtcgatgagtcactgcattccccacgggcgacgactcggaccgatg

SEQ ID NO: 7791 - DNA, 203 bp, Homo sapiens
  source 1..203: mol_type = other DNA
ggcgcgccagtccttcgatgctattaaagaatcctctgtcccactcaagtcaccatcagctgaagcgtgtgggtatagcgatcgtgttgcgcagctgacactaggaaactccacagtcacaactcaagaagcagcaaacatcactgtcgcttatggtgagtggcccgagtattgtccagatacagatgcgactcggaccgatg

SEQ ID NO: 7792 - DNA, 203 bp, Homo sapiens
  source 1..203: mol_type = other DNA
ggcgcgccagtcctgtttctgcattcatgttcagtgcaatgcgagcaagttccatcagggtactctacttgttgttgctataccagaaatgacagttgcgagatctagtggtgacaccaagcccaccactgcaccccacccttcttacgcagctgcacagcctggcccaaatggcaaagagtttgcttcgactcggaccgatg

SEQ ID NO: 7793 - DNA, 203 bp, Homo sapiens
  source 1..203: mol_type = other DNA
ggcgcgccagtccttgtgtgcaagctttcgagtggatcctggtcgggcagggccatgggaatcaacgttagtgggacagtactgcaagtactacacacaatggtcgggctcgctggaagtcactttcatgttcacaggctcctttatggccacaggcaaaatgttgatcgcttacacaccgccaggtgcgactcggaccgatg

SEQ ID NO: 7794 - DNA, 203 bp, Homo sapiens
  source 1..203: mol_type = other DNA
ggcgcgccagtcctctcacataagcagtgcactgacagcagcagacacacgcccaagcacacatcaagtagcgactggcaacactcctgcgctgcaagctgcagagactggggcgacatcgaatgctagtgatgagagtatgatcgagactcggtgtgtagtcaacaaacacagtgttgctgaaactacgactcggaccgatg

SEQ ID NO: 7795 - DNA, 203 bp, Homo sapiens
  source 1..203: mol_type = other DNA
ggcgcgccagtcctgtgtagaacattttttctcaagggcagcattagttggttatattagcatactgacatcaacaacgaccgctaatggcttcacaaattgggatattgacatcatgggttttgtccaacagcgcaggaaagtggaaggtttcacatacatgaggtttgatgctgagttcacatttgcgactcggaccgatg

SEQ ID NO: 7796 - DNA, 203 bp, Homo sapiens
  source 1..203: mol_type = other DNA
ggcgcgccagtcctttgccaccgcagacgacgggcaagcagacacgacgatgctccagtatatgtacatcccacctggagctcccaaacccactcaaagggactcattcgagtggcaatctgcaaccaacccatctctgtttgttcggatgagtgaacctcctgcacaagtgtcagttcctttcatgtcgactcggaccgatg

SEQ ID NO: 7797 - DNA, 203 bp, Homo sapiens
  source 1..203: mol_type = other DNA
ggcgcgccagtcctggatgaagcacattagggcatggatccccaggcccttaagaaaccagccttatgtgctaaagaattaccctaactttgatggaacaaacatcaagtgcagctccaccagcaggcagagcatcaccaccacaggagcttttggtcaacagtctggtgcagtctatgtttgcaactcgactcggaccgatg

SEQ ID NO: 7798 - DNA, 203 bp, Homo sapiens
  source 1..203: mol_type = other DNA
ggcgcgccagtccttagttgggtttgctgacttgagggacctattgtggctagaagatgatgtcatggagcaaggagtcacagattacattaaaggcctgggtgatgcttttggcactggcttcaccgactccatatctagagagatttccaacttgagagaccagttactcgggtctgagggagtggcgactcggaccgatg

SEQ ID NO: 7799 - DNA, 203 bp, Homo sapiens
  source 1..203: mol_type = other DNA
ggcgcgccagtccttcaagagcaaacaacgtattgaaccagtatgtttaattattagaggcccaccaggcacaggaaaatcccttgccacaggcatcatagctagagccattgctgagaaatacaactctagtgtctactctctcccaccagaccccgatcattttgacgggtacaggcaacaagtggcgactcggaccgatg

SEQ ID NO: 7800 - DNA, 203 bp, Homo sapiens
  source 1..203: mol_type = other DNA
ggcgcgccagtccttgacagttatggatgatttgtgtcaaaatcctgacggaaaggacatctcccttttctgccagatggtttctactgttgagttcatcccacccatggcctcacttgaagaaaaagggctcccgtttacttccaagtttgtgattgcatctaccaactccagtaatattattgtaccgactcggaccgatg

SEQ ID NO: 7801 - DNA, 203 bp, Homo sapiens
  source 1..203: mol_type = other DNA
ggcgcgccagtcctaagcaatacaactgaaagatagaaagtccaaggtgagatatagcttagattctgttgtttctgagctcattagggagtataataacaggtgtagtgttggtaacacaattgaagcactgttccaaggaccccctgttttcaaacctattaagatctctatggaccaaccggccccgactcggaccgatg

SEQ ID NO: 7802 - DNA, 203 bp, Homo sapiens
  source 1..203: mol_type = other DNA
ggcgcgccagtccttagagttggtgctgagggatctaggttacgatgagcaggccatatcagtgatagagggcatcaaccattcccaccatatctatagaaacaagacatattgtgtgcttgggggtatgccatccggatgctctggtaccagtatattcaactctatgatcaataacatcattatcacgactcggaccgatg

SEQ ID NO: 7803 - DNA, 203 bp, Homo sapiens
  source 1..203: mol_type = other DNA
ggcgcgccagtcctggaccttgctgatcagaaccttcaaggggattgacctggatgagttgaatatggtggcatatggtgatgatgtgcttgctagctaccctttccccatagattgtcaggaacttgctaacacagggaaagaatatggcttgatcatgacacctgcagataagagtagctgtttcacgactcggaccgatg

SEQ ID NO: 7804 - DNA, 203 bp, Homo sapiens
  source 1..203: mol_type = other DNA
ggcgcgccagtcctatgaggtcaactgggaaaatgccacatttcttaagagagggtttaaaccagataaacagtttcctttcctcatacatcctaccatgcccatgaaagagatccatgagtcgatcaggtggaccagggatgcgcgcaacacacaagaccacgtgcgctcactgtgtcttcttgcttcgactcggaccgatg

SEQ ID NO: 7805 - DNA, 203 bp, Homo sapiens
  source 1..203: mol_type = other DNA
ggcgcgccagtcctgggtttgccgtacatgtgcagtgcaatgccagcaagtttcaccagggggctttattagtggtagctatacctgaatggacccaaggacgcggactaacgagcagcaccaacacttacatggagtactcacagaccaaccctggaaagaatggtggcacgttcaatcacccttatcgactcggaccgatg

SEQ ID NO: 7806 - DNA, 203 bp, Homo sapiens
  source 1..203: mol_type = other DNA
ggcgcgccagtcctaattatgatgcaggggccactcctcttgttccaattaccatcaccatcgctcccatggcatgcgagttttcaggtctacgaaaggcaatctcccaagggttgccagcccaactgaccccaggttccactcagtttgtaacaacggacaatgacagttcccagccattaatcccacgactcggaccgatg

SEQ ID NO: 7807 - DNA, 203 bp, Homo sapiens
  source 1..203: mol_type = other DNA
ggcgcgccagtcctggcttaagcaacacatcagcatctgatgcagtcattgagactgccaacacaccagcattgcaggcagccgaaacaggagccacgtcaaacgcagatgatgcagggctgatcgaaaccagggatgtcattaacacacaacgcccaactgaaacaactgtgcaggcgttctatgctcgactcggaccgatg

SEQ ID NO: 7808 - DNA, 203 bp, Homo sapiens
  source 1..203: mol_type = other DNA
ggcgcgccagtcctagggctggtttagttggaatggtagatatcattcatagtgacagcaactcacccaagtttgcatcgtggaccatcgacacgatggcttttgtccaacaacggcgaaagctcgaaatgttcacgtacatgaggtttgctgcggagttcacctttgtagtgtcaactgaatccacacgactcggaccgatg

SEQ ID NO: 7809 - DNA, 203 bp, Homo sapiens
  source 1..203: mol_type = other DNA
ggcgcgccagtcctacaaagatacctaacactatgattcagtatatgtacgtaccaccaggagcaccaatacccacgactagcaatgggtacgaatggcaatctggcaccaacccatcagttattgtacgtatgaatgaggcaccagctagagtgcgagttcccttcattagcccagcaggtgcatatcgactcggaccgatg

SEQ ID NO: 7810 - DNA, 203 bp, Homo sapiens
  source 1..203: mol_type = other DNA
ggcgcgccagtcctgcctggttttatgatggctacactgattttggtactcatccctcaccaaatggtaaaggagatgcaaattatggattgaatccagccaatcagtttggcacttttgcaacccgcattattggaaacggggcaatctccgcgattaggattagaatttacatgaaaccaacgcaacgactcggaccgatg

SEQ ID NO: 7811 - DNA, 203 bp, Homo sapiens
  source 1..203: mol_type = other DNA
ggcgcgccagtcctagacacttggctaatgagtttgacgcccagtcaatggtgtgggagagttatgagagagatcttctagtgtccaccactacagcccatggttgtgacgtaattgcccgatgcaattgtaacactggtgtgtatttctgccgtagcaagggaaaacactacccagtctgctttcaacgactcggaccgatg

SEQ ID NO: 7812 - DNA, 203 bp, Homo sapiens
  source 1..203: mol_type = other DNA
ggcgcgccagtcctaaagcgttaatcaagattgtaagtgctcttgtgattatagttaggaatcatgaagatctcatcacagtaacggccactctagccctcattggatgttctgggtcaccatggcaatggttaaagaccaaagtatgccagtacttgcaaataccagtagtggaaaaacaaggagatcgactcggaccgatg

SEQ ID NO: 7813 - DNA, 203 bp, Homo sapiens
  source 1..203: mol_type = other DNA
ggcgcgccagtcctgatttatgtcagaacccagatgggaaagatgtgagcttgctatgtcagatggtttccacagtggattttattccacctatggctagcttagaggaaaagggaattctatatacttcccctttcatgattgcatctactaaccatggttccatcactgctccaaccatctcggatcgactcggaccgatg

SEQ ID NO: 7814 - DNA, 203 bp, Homo sapiens
  source 1..203: mol_type = other DNA
ggcgcgccagtcctgcagacttgttgaagtcagttgattctgaggaagtgagacaatactgtcaagagaagggttggataataccagtcactgagtgtcagacagaaagacacctcagtagagctttgactattctccaagctgtttcaacatttgtggctgtagctgggtgtatctacatagtgtaccgactcggaccgatg

SEQ ID NO: 7815 - DNA, 203 bp, Homo sapiens
  source 1..203: mol_type = other DNA
ggcgcgccagtcctaagctgtttgctggatttcaaggggcatacactggattgcctttcaacaaacccaaagttccaaccataaggcaggcaaaggtacaaggaccttctttcgaatttgcagtggcaatgatgaagaggaattcagccattattaaaacaggacaaggtgagttcaccatgctcggtcgactcggaccgatg

SEQ ID NO: 7816 - DNA, 203 bp, Homo sapiens
  source 1..203: mol_type = other DNA
ggcgcgccagtcctcaatgtggtggagtgttgatggcaactggtaaagtcataggtattcacgttggtggtaatggacatcaaggatttgctgccacactactcagagactacttcaatgaagaacaaggtgaaattgagtggatggagacaaacaaagaatcaggttacccaattatcaatgcaccacgactcggaccgatg

SEQ ID NO: 7817 - DNA, 203 bp, Homo sapiens
  source 1..203: mol_type = other DNA
ggcgcgccagtcctgaccactatgctgggcaattaatgacccttgacattgacattagtgagatgtgccttgaggatgctgtttatgggactgaagggcttgaagcacttgacctgacaactagtgcaggatacccttatgtgacaatgggaatcaaaaagagagacatattatcaaagaaaactagacgactcggaccgatg

SEQ ID NO: 7818 - DNA, 203 bp, Homo sapiens
  source 1..203: mol_type = other DNA
ggcgcgccagtcctcttgaaaaattaggttatgattacaaggctggcaggtacatttcgtacttgtgtcactcataccacctttacaaaaacaagcactattttgtgcgaggtggtatgccttcagggtgttctggtacatcaatcttcaactccatgataaacaacatcataattcgaacattgttgcgactcggaccgatg

SEQ ID NO: 7819 - DNA, 203 bp, Homo sapiens
  source 1..203: mol_type = other DNA
ggcgcgccagtcctctgttgggcgatgtctactgctacctgcatacacaacactcaggcgcaagtggctcgaccaattctaaaatggttttcaatttgaccttaattcggcctaattggaagaccctgtcacgtatctggacgtgacaaaagcgtgacaggggtaaatttagcacaaccagagtgcttcgactcggaccgatg

SEQ ID NO: 7820 - DNA, 203 bp, Homo sapiens
  source 1..203: mol_type = other DNA
ggcgcgccagtcctaaagccccgtggataagatccactgctgtgagcggtgcaaccccagcaccctggttcgatggccattctctatggaaccagaaaatggttttctcaagccctccggtagagaagccaagaatgtcctgaaggtaccccgcgcgcgggatctgatcaggagaccaattggcagtgcgactcggaccgatg

SEQ ID NO: 7821 - DNA, 203 bp, Homo sapiens
  source 1..203: mol_type = other DNA
ggcgcgccagtcctaggcgtaatcatcaacaactactattcaaatcaataccaaaactcaattgatctttcagccaatgccaacggtgttggaaaagaaaattcaaaaccgcaaggtcagttgatgaatattcttggtagcgcggcggatgcattcaagaacatcgcgcctcttctcatggaccaggacgactcggaccgatg

SEQ ID NO: 7822 - DNA, 203 bp, Homo sapiens
  source 1..203: mol_type = other DNA
ggcgcgccagtcctcactgaagaaatgaccaacctttctgatagagtgtcttcggacaccgcaggcaacacggccacaaacactcaatctacagtaggccgtttgtttgcatttggtacaagacacaagggtaaacatccagcttcctgtgctgacacagccactgacaaagtactcgctgccgagagcgactcggaccgatg

SEQ ID NO: 7823 - DNA, 203 bp, Homo sapiens
  source 1..203: mol_type = other DNA
ggcgcgccagtcctgtactacacctttaaaatagccacttggtccacccaaaaagcatttgatcatgtaaggattccttttccccacgtcctatcaggaagcaaaggaggcgtttttggttctactctaagacgccactacttgtgtaagtgtggttggagaatacaggtacagtgtaatgcttcacacgactcggaccgatg

SEQ ID NO: 7824 - DNA, 203 bp, Homo sapiens
  source 1..203: mol_type = other DNA
ggcgcgccagtccttgccttgaatcatcagaatcattggcagtggactgtctatccacatcaaattcttaacctcaggactaacactacgtgtgacttagaagtgccttatgttaacatttgtcccacgtcctcgtggacccagcacgctaactgggttttggtagtggctgttttgtctcctcttcacgactcggaccgatg

SEQ ID NO: 7825 - DNA, 203 bp, Homo sapiens
  source 1..203: mol_type = other DNA
ggcgcgccagtcctatattcttcaggttcttcccccaatgtagacattactgtgtctgttcaacccgtaaagcctgtctttaacggtctcagacatacagttttggaggaccagagccccataccagtcacaattagagagcatgctggaacattctattccaccactccggacactaccgttcccatcgactcggaccgatg

SEQ ID NO: 7826 - DNA, 203 bp, Homo sapiens
  source 1..203: mol_type = other DNA
ggcgcgccagtcctagctatgcaagccacatatgcgatttgggacttgggcctcaactctagctacaatttcaccgtcccattcatctccccgacacactaccgccaaacctcttatacaactccctcaatcacttccgttgacggttggctctcaatttggcaactaaccccactcacttacccagccgactcggaccgatg

SEQ ID NO: 7827 - DNA, 203 bp, Homo sapiens
  source 1..203: mol_type = other DNA
ggcgcgccagtccttaacaccccacagagtgccgatatactaactttggtttcaggtggggatgacttcactctcagaatgccggtgactcctagtaagtacacgccccatggagtggataacgcagaaaaaggcaaggttgcaaatgacaacgcttcagcagactttgtagcagtccctatagctctcgactcggaccgatg

SEQ ID NO: 7828 - DNA, 203 bp, Homo sapiens
  source 1..203: mol_type = other DNA
ggcgcgccagtccttcctgaaaaccagacaaaagtggccttcttttacgacagggcggtcctagcgtccgcccttgtcaatgctcaggacctgaactcaaacttttctcttcaagacgcagcaaatgtgatgaacaatgcacttttgacaccactcccaagcaaccgtcttgatgactcaacatatggcgactcggaccgatg

SEQ ID NO: 7829 - DNA, 203 bp, Homo sapiens
  source 1..203: mol_type = other DNA
ggcgcgccagtcctctacaccccatgtcgcgcgccagtggatctgtctgaacaaactatcccctacactccatcattgtcagatacccgtgatccacatatgtgggttgttggacccggtgctactaatcaaatttcttttgtcattccttacacttctcctttgtccgtattaccagctgtttggttcgactcggaccgatg

SEQ ID NO: 7830 - DNA, 203 bp, Homo sapiens
  source 1..203: mol_type = other DNA
ggcgcgccagtccttaatgggttttctgattttgacaacaaaacacggtttggtgttgcaccaaacgctgactttggtcgattgttcgttcagggtgcagacaggttctcggtccactaccggtacaaaaagatgagagtgttttgtccaagaccaactgtgtttttcccgtggcccgccaactcagtcgactcggaccgatg

SEQ ID NO: 7831 - DNA, 203 bp, Homo sapiens
  source 1..203: mol_type = other DNA
ggcgcgccagtccttggacgccttctcgtctgtatgggcgagaagccctgtcagcttcccgtctctactcccaagtgtttctaccacatcgtttttactggctccagaaattcctttggtgtgtccatctacaaagctagatacagaccctggaagcagccccttcacgatgagttgtacgactatggcgactcggaccgatg

SEQ ID NO: 7832 - DNA, 203 bp, Homo sapiens
  source 1..203: mol_type = other DNA
ggcgcgccagtcctcctacacaatccagatttgaccactactgtctgtctgtctttgatggctggaatagatgttctcactaatgatagtgtttttaactggctgtccactaaactatccaagttcttccacacccctgcccctcccattgttcctcttttgcaacaacagtctcctgttagagaagccgactcggaccgatg

SEQ ID NO: 7833 - DNA, 203 bp, Homo sapiens
  source 1..203: mol_type = other DNA
ggcgcgccagtcctaaatgataactttaatttggcaaagaacatagaatgggcaataaaaacaattaaaagaatagtagaatggattacttcatggttcaaacaggaagaaacaagtcctcaagctaagttagataaaatgttagcagactttccagaacactgttcttccattcttgctatgagaaacgactcggaccgatg

SEQ ID NO: 7834 - DNA, 203 bp, Homo sapiens
  source 1..203: mol_type = other DNA
ggcgcgccagtccttgctggacaaggaaagtccgtgaccagtcaaatcatcgcccaagcagtctccaaacttttgtttggtcgtcaatcagtttattctctcccaccggattcagattacttagatggttacgagaatcaatattcagtaatcatggatgatctgggacaaaatcccgatggcgaagacgactcggaccgatg

SEQ ID NO: 7835 - DNA, 203 bp, Homo sapiens
  source 1..203: mol_type = other DNA
ggcgcgccagtccttttcaaagtattttgtcaaatggtttcaagcacaaattttctcccaaacatggcccacctggaaaagaaaggaactccattcacttctaacttcataatagcaacgaccaaccttcccaagtttcggcctgtcaccgtagcacactacccagctgttgatagaagaattaccttcgactcggaccgatg

SEQ ID NO: 7836 - DNA, 203 bp, Homo sapiens
  source 1..203: mol_type = other DNA
ggcgcgccagtcctcaaccttcaacaagtggttaagatggtaaagaataccatcgataacaaagtggaaaacttgaagaaaatgaacacattggttgctcaatcacctggaaatgacatggattacgtgttgacctgtttgagacaaactaatgcagctttgcaagaccaaattgatgaacttcaagacgactcggaccgatg

SEQ ID NO: 7837 - DNA, 203 bp, Homo sapiens
  source 1..203: mol_type = other DNA
ggcgcgccagtccttgcttactctggaggcaagaaaggtgagaagcaaacacttcaaattttggacgtacaaggcggaggaaagatcgtagcccaggctggaaacccaattatggattatgaagtaaacattgcaaagaatatggttacccccatcaccttcttttatgcagacaaggcacaagtcaccgactcggaccgatg

SEQ ID NO: 7838 - DNA, 203 bp, Homo sapiens
  source 1..203: mol_type = other DNA
ggcgcgccagtcctaggacctttgttcaaggacaattctaggaaattttgttctaaagatgatgacttcccggctagaaacgagactgttacaggaattatgaatactggagtcccttttgtcttcactggaaagtttttggttggcaatcagccggttaacacaaccactggtgcatgtttcaatcacgactcggaccgatg

SEQ ID NO: 7839 - DNA, 203 bp, Homo sapiens
  source 1..203: mol_type = other DNA
ggcgcgccagtcctttgtatacactatagagctacaacacatcgaggatggtgcgggtcggcactcatctgtcatgtcaacggcaagaaggccgtgtatgcaatgcactcagctggtggtggcggcatggctgccgctacgataatcactcaggaaatgattgaagctgctgaaaaggccttggattgcgactcggaccgatg

SEQ ID NO: 7840 - DNA, 203 bp, Homo sapiens
  source 1..203: mol_type = other DNA
ggcgcgccagtcctagcaaagactagaattgtagacgtacccccatttcatcactgtatatggggacgtcaactattagggcgctttgcttctagatttcaaacaaatcctggcttggatcttggttcagcgattggcacggaccctgacacagattggaccgctttcgcctttcaactcttacagtacgactcggaccgatg

SEQ ID NO: 7841 - DNA, 203 bp, Homo sapiens
  source 1..203: mol_type = other DNA
ggcgcgccagtcctagttaagggtggtctcccgtcagggtgtgccgctacaagcatgttgaacacaattataaacaacatagtaatcagagcagctttacacttgacctattctaactttgaatttgatgacatcaaagttttgtcttatggtgatgatttactcattgccacaaattatcaaattaacgactcggaccgatg

SEQ ID NO: 7842 - DNA, 203 bp, Homo sapiens
  source 1..203: mol_type = other DNA
ggcgcgccagtccttaccaatgttattggtgtggtctgcgagttctagcctactcgtttctcccccgaccattcactcacccacgaaaagtgtgttgtaaccataagatttaacccccgcacgggatgtgcgataaccgtaagactggctcaagcgcggaaagcgctgtaaccacatgctgttagtcccgactcggaccgatg

SEQ ID NO: 7843 - DNA, 203 bp, Homo sapiens
  source 1..203: mol_type = other DNA
ggcgcgccagtcctctttatggctgcaagatggctacccacctcggatcactgaactggagctcgaccctccttagtaagggaaccgagaggccttcgtgcaacaagctccgacacagagtccacgtgactgctaccaccatgagtacatggttctcccctctcgacccaggacttctttttgaatatcgactcggaccgatg

SEQ ID NO: 7844 - DNA, 203 bp, Homo sapiens
  source 1..203: mol_type = other DNA
ggcgcgccagtcctccacggctcgatccagagggtggggcatgacccctagcatagcgagctacagcgggaactgtagctaggccttagcgtgccttggatactgcctgatagggcgacggcctagtcgtgtcggttctataggtagcacatacaaatatgcagaactctcatttttctttcgatacacgactcggaccgatg

SEQ ID NO: 7845 - DNA, 203 bp, Homo sapiens
  source 1..203: mol_type = other DNA
ggcgcgccagtcctcagggaggcctcaacggaggggccttcacagctaccctacatagacactttttgatgaagtgcgggtggcaggtgcaggtccaatgtaatttgacacaattccaccaaggcgctcttcttgttgccatggttcctgaaaccacccttgatgtcaagcccgacggtaaggcaaagcgactcggaccgatg

SEQ ID NO: 7846 - DNA, 203 bp, Homo sapiens
  source 1..203: mol_type = other DNA
ggcgcgccagtcctagcttacaggagctgaatgaagaacagtgggtggaaatgtctgacgattacgggaccgggaaaaacatgccttttcagtctcttggcacatactatcggccccctaactggacttggggtcccaatttcatcaacccctatcaagtaacggttttcccacaccaaattctgaaccgactcggaccgatg

SEQ ID NO: 7847 - DNA, 203 bp, Homo sapiens
  source 1..203: mol_type = other DNA
ggcgcgccagtcctataaccgaccttttgcaactggcccgcatacccactctcatggcatttgagcgggtgcctgaacccgtgcctgcctcagacacatatgtgccctacgttgccgttcccacccagttcgatgacaggcctctcatctccttcccgatcaccctttcagatcccgtctatcagaaccgactcggaccgatg

SEQ ID NO: 7848 - DNA, 203 bp, Homo sapiens
  source 1..203: mol_type = other DNA
ggcgcgccagtcctaccctggttggcgccatcagttcaaatttcgccaattaccgtgggtgtatccaaatcactctgacattttgtggacccatgatggcgagagggaaattcctgctctcgtattctcccccaaatggaacgcaaccacagactctttccgaagctatgcagtgcacatactctattcgactcggaccgatg

SEQ ID NO: 7849 - DNA, 203 bp, Homo sapiens
  source 1..203: mol_type = other DNA
ggcgcgccagtccttgggacataggcttgaactctagttggaccttcgtcgtcccctacatctcgcccagtgactaccgtgaaactcgagccattaccaactcggtttactccgctgatggttggtttagcctgcacaagttgaccaaaattactctaccacctgactgtccgcaaagtccctgcattcgactcggaccgatg

SEQ ID NO: 7850 - DNA, 203 bp, Homo sapiens
  source 1..203: mol_type = other DNA
ggcgcgccagtcctaagttcctgtttgatcgatctcgattattgaatgtaatcaaggtactggagaaggacgccgttttcccccgccctttccctacacaagaaggtgcgcagcaggatgatggttacttttgtcttctgaccccccgcccaacagtcgcttcccgacccgccactcgtttcggcctgcgactcggaccgatg

SEQ ID NO: 7851 - DNA, 203 bp, Homo sapiens
  source 1..203: mol_type = other DNA
ggcgcgccagtccttccagctttgtctacgaccagctgcatgtgcccttccactttactgggcgcactccccgcgctttcgctagcaagggtgggaaggtatctttcgtgctcccttggaactctgtctcgtctgtgctccccgtgcgctgggggggggcttccaagctctcttctgctacgcggggtcgactcggaccgatg

SEQ ID NO: 7852 - DNA, 203 bp, Homo sapiens
  source 1..203: mol_type = other DNA
ggcgcgccagtcctggcgatatcgagaccaatcctggtcctgcttctgacaacccaattttggagtttcttgaagcagaaaatgatctagtcactctggcctctctctggaagatggtgcactctgttcaacagacctggagaaagtatgtgaagaacgatgatttttggcccaatttactcagcgagcgactcggaccgatg

SEQ ID NO: 7853 - DNA, 203 bp, Homo sapiens
  source 1..203: mol_type = other DNA
ggcgcgccagtcctctagtgggggaaggctctgtcgccttggccgccacgctatccaaccaagcttcagtaaaggctcttttgggcctgcactttctctctcgggggctcaattacactgacttttactctttactgatagagaaatgctctagtttctttaccgtagaaccacctcctccaccagctcgactcggaccgatg

SEQ ID NO: 7854 - DNA, 203 bp, Homo sapiens
  source 1..203: mol_type = other DNA
ggcgcgccagtcctgacacccccgtcgacgaggcgttgggtagagttctctcccccgctgcggtcgatgaggcgcttgtcgacctcactccagaggccgacccggttggccgtttggctattcttgccaagctaggtcttgccctagctgcggtcacccctggtctgataatcttggcagtgggactccgactcggaccgatg

SEQ ID NO: 7855 - DNA, 203 bp, Homo sapiens
  source 1..203: mol_type = other DNA
ggcgcgccagtcctgcggtcgctaagaaagtggtcgtccccattaccttcatggttcccaacagaccttctgggcttacacagtccgctcttctggtgaccggccggaccttcctaatcaatgaacatacatggtccaatccctcctggaccagcttcacaatccgcggtgaggtacacactcgtgatcgactcggaccgatg

SEQ ID NO: 7856 - DNA, 203 bp, Homo sapiens
  source 1..203: mol_type = other DNA
ggcgcgccagtcctgacattctgaccgtcaaagaagcaattctgggcatccccggactagaccccatggatccccacacagctccgggtctgccttacgccatcaacggccttcgacgtactgatctcgtcgattttgtgaacggtacagtagatgcggcgctggctgtacaaatccagaaattcttacgactcggaccgatg

SEQ ID NO: 7857 - DNA, 203 bp, Homo sapiens
  source 1..203: mol_type = other DNA
ggcgcgccagtcctgacggtgactactctgaccatgtcttccaaacttttctgaaagatgagatcagaccctcagagaaagtccgagcgggaaaaacccgcattgttgatgtgccctccctggcgcattgcattgtgggcagaatgttgcttgggcgctttgctgccaagtttcaatcccatcctggccgactcggaccgatg

SEQ ID NO: 7858 - DNA, 203 bp, Homo sapiens
  source 1..203: mol_type = other DNA
ggcgcgccagtccttttagccctgcgctgggaccgtatctcagatccctggctgtctcggtgcacgcttacggcgagcgtcgcatcaagattaccggtggcctcccctccggttgtgccgcgaccagcctgctgaacacagtgctcaacaatgtgatcatcaggactgctctggcattgacttacaagcgactcggaccgatg

SEQ ID NO: 7859 - DNA, 203 bp, Homo sapiens
  source 1..203: mol_type = other DNA
ggcgcgccagtcctttttgcgagaaatgggacgtctgcgcacgaaacgcgccgtcgcttgaggaggacttgtacaaacacgatctacgcaggtttccccaactgacacttaccgtgcaacttgaaatcccgcctggtctttccaggtctagaggggtgacaatttgtactgtggttgactccacgctccgactcggaccgatg

SEQ ID NO: 7860 - DNA, 203 bp, Homo sapiens
  source 1..203: mol_type = other DNA
ggcgcgccagtcctactgatactggtactcaaacactggtggcaggctaaggatgcccttcaggtaccccgaggtaacacgcgacacttgggatctgagaaggggactgaggcttctttaaaagcgctcggtttaaaaagcttctacgcctgaacaggtgaccggaggccggcacctttctctacaatcgactcggaccgatg

SEQ ID NO: 7861 - DNA, 203 bp, Homo sapiens
  source 1..203: mol_type = other DNA
ggcgcgccagtcctcatcctccagttgtttaggtacgtcgatgaacctttcttcgactgggtctataactcgcccgagaatcttacgcttgatgctatcaagcagttggaaaacttcaccgggcttgagttgcacgagggcggaccacctgcccttgtgatctggaacatcaaacacttgctccaaaccgactcggaccgatg

SEQ ID NO: 7862 - DNA, 203 bp, Homo sapiens
  source 1..203: mol_type = other DNA
ggcgcgccagtcctaattacacacgggaaggctgaaaatgacaccttggtagtgtcggctagcgccggcaaagactttgagttgcgcctcccaattgacccccggccacaaaccactgctactggggagtccgcagaccctgtcaccaccaccgtggagaactacggcggtgagacacaagtccagagcgactcggaccgatg

SEQ ID NO: 7863 - DNA, 203 bp, Homo sapiens
  source 1..203: mol_type = other DNA
ggcgcgccagtcctacgccaccacacggacgtcggcttcatcatggaccgatttgtgaagataaacagcctgagccccacacatgtcattgacctcatgcacacccacaaacacgggatcgtgggtgcgttacttcgtgcagccacgtactacttctccgacttggagattgttgtgcggcacgatggcgactcggaccgatg

SEQ ID NO: 7864 - DNA, 203 bp, Homo sapiens
  source 1..203: mol_type = other DNA
ggcgcgccagtcctacctgactttaaccggttggtgtccgcttttgaggaattggccactggggttaaagctatcagaaccggtctcgatgaggccaaaccctggtacaagctcatcaagctcctaagccgcctgtcgtgcatggccgctgtggcagcacggtccaaggacccagtccttgtggccatcgactcggaccgatg

SEQ ID NO: 7865 - DNA, 203 bp, Homo sapiens
  source 1..203: mol_type = other DNA
ggcgcgccagtcctcatgctggccgacaccggtctcgagattctggacagcactttcgtcgtgaagaaaatctccgactcgctctccagtctctttcacgtgccggcccccgccttcagtttcggagccccgattctgttggccgggttggtcaaggtcgcctcgagtttcttccggtccacacccgacgactcggaccgatg

SEQ ID NO: 7866 - DNA, 203 bp, Homo sapiens
  source 1..203: mol_type = other DNA
ggcgcgccagtcctagaccttgagagagcagagaaacagctcaaagcacgtgacattaacgacatcttcgccattctcaagaacggcgagtggctggtcaaactgatccttgccatccgcgactggattaaggcatggattgcctcagaagagaagttcgtcaccatgacggacttggtgcctggcatcgactcggaccgatg

SEQ ID NO: 7867 - DNA, 203 bp, Homo sapiens
  source 1..203: mol_type = other DNA
ggcgcgccagtcctctgctgtgctactggagtgtttggcactgcttacctcgtgcctcgtcatcttttcgcagagaagtatgacaagatcatgttggaaggcagagccatgacagacagtgattacagagtgtttgagtttgagattaaagtaaaaggacaggacatgctctcagacgcggcactcatcgactcggaccgatg

SEQ ID NO: 7868 - DNA, 203 bp, Homo sapiens
  source 1..203: mol_type = other DNA
ggcgcgccagtcctggtgcttcaccgtgggaaccgcgtgagagacatcacgaaacactttcgtgatacagcaagaatgaagaaaggcacccccgtcgtcggtgttgtcaacaacgccgatgttgggagactgattttctctggtgaggcccttacctacaaggacattgtagtgtgcatggatggagacgactcggaccgatg

SEQ ID NO: 7869 - DNA, 203 bp, Homo sapiens
  source 1..203: mol_type = other DNA
ggcgcgccagtcctcaccatgcccggcctctttgcctacaaagccgccaccaaggctggctactgtggaggagccgttcttgccaaggacggggctgacacatttatcgtcggcactcactctgcaggtggcaatggagttggatactgctcatgcgtttccaggtccatgcttcaaaagatgaaggccgactcggaccgatg

SEQ ID NO: 7870 - DNA, 203 bp, Homo sapiens
  source 1..203: mol_type = other DNA
ggcgcgccagtcctagttgttctcgatgaagtcattttctccaaacacaaaggagacgtaaagatgaccgaagaggacaaagcgctgttccgccgctgcgccgctgactacgcgtcacgcctgcacagcgtgctgggtacggcaaatgccccattgagcatctacgaggcaatcaagggcgttgatggcgactcggaccgatg

SEQ ID NO: 7871 - DNA, 203 bp, Homo sapiens
  source 1..203: mol_type = other DNA
ggcgcgccagtcctactcgacgccatggagccggacactgcacctggcctcccctgggccctccagggaaaacgccgcggtgcgctcatcgacttcgagaacggcacggtcggacccgaagttgaggctgccttgaagctcatggagaaaagagaatacaagtttgcttgtcagaccttcctgaaggacgactcggaccgatg

SEQ ID NO: 7872 - DNA, 203 bp, Homo sapiens
  source 1..203: mol_type = other DNA
ggcgcgccagtcctgcaaagatttggcacacatttcgcccaatacagaaacgtgtgggatgtggattactcggcctttgatgcaaaccactgcagtgacgctatgaacatcatgtttgaggaggtgttccgcacagactttggcttccacccaaacgctgaatggatcctgaagactctcgtgaacaccgactcggaccgatg

SEQ ID NO: 7873 - DNA, 203 bp, Homo sapiens
  source 1..203: mol_type = other DNA
ggcgcgccagtcctactaggctcacagtcgtacctcctccaggctgacgactgtcgcccttctagggcctacgaccttcaagttacggttttggcgttcttcccgcggccggatcgcctgcgcgaacgctggctcttcacccgaaggcctacctttcaccccccccccccataaagaacgtttccgtccgactcggaccgatg

SEQ ID NO: 7874 - DNA, 203 bp, Homo sapiens
  source 1..203: mol_type = other DNA
ggcgcgccagtcctttttatgaagacaactgactgtttcaacgttttgctcgagatccttcacaggttcagacacacattcaagataaatagagagatggaattcacactctacaacggagagaagaagaccttctacagcaggcccaatacgcacgggaattgctggctcaactcgttgttgcagctcgactcggaccgatg

SEQ ID NO: 7875 - DNA, 203 bp, Homo sapiens
  source 1..203: mol_type = other DNA
ggcgcgccagtcctctttcgatacgtcgatgagcctctcttcgagtctgagtacctgtcacctgaaaataagacattggatatgatcaaacaactttctgattacactaaactagacttgtcagacggtgggccacccgccctcgtcctgtggctgatcaaggactgtcttcaaactggcgttggcaccgactcggaccgatg

SEQ ID NO: 7876 - DNA, 203 bp, Homo sapiens
  source 1..203: mol_type = other DNA
ggcgcgccagtcctcagcactcgccctagcgagatctgtgtgatcaacggggttgtcatgaccctggctgatttccacgccggcattttcatcaagggtaccgaacacgctgtgttcgccctcaacacatctgagggctggtacgccattgatgatgaggtgttctacccttggacacctgaccctgacgactcggaccgatg

SEQ ID NO: 7877 - DNA, 203 bp, Homo sapiens
  source 1..203: mol_type = other DNA
ggcgcgccagtcctacacaagctttttgattggacactcgaacagcaatttggcacaacgcacattttggaactccccacagatcataagggcatctatgggcagctggttgactcacacgcgtacatccgaaacggatgggacgtgcaagtgtcggccactgccacacagtttaacggaggctgcctcgactcggaccgatg

SEQ ID NO: 7878 - DNA, 203 bp, Homo sapiens
  source 1..203: mol_type = other DNA
ggcgcgccagtcctgttggtggccatggtgcctgagctgtgtaaactggctgacagagagaaataccaactcactctcttcccacaccaattcttgaacccacgcaccaacaccaccgcacacattcaggtaccatacctgggtgttgacagacacgaccagggaactcgtcacaaggcgtggaccctcgactcggaccgatg

SEQ ID NO: 7879 - DNA, 203 bp, Homo sapiens
  source 1..203: mol_type = other DNA
ggcgcgccagtcctcgtcgtgatggtggtggcaccatacactaacgaccagacaattggctcactaaaagctgaggtctacgttaacattgcaccaaccaatgtgtacgtggccggtgagaaacccgccaaacagggaattttccctgtggccgttgctgacggctacggtggttttcagaacaccgacgactcggaccgatg

SEQ ID NO: 7880 - DNA, 203 bp, Homo sapiens
  source 1..203: mol_type = other DNA
ggcgcgccagtccttgaaacaccagagatggcctcacactgctatcacgctgagtgggatactgggttgaactcaacatttaccttcaccgtgccgtacatttcagcagcggattacgcctacacctactctgatgagcctgaacaggcttcagtacaaggttgggttggtgtgtatcagatcactgacgactcggaccgatg

SEQ ID NO: 7881 - DNA, 203 bp, Homo sapiens
  source 1..203: mol_type = other DNA
ggcgcgccagtcctcaccgacgtcgctttccttctcgaccggttcactctggttgggaaaaccatggaaaacaaaatggttctggatttgttgaccacgaaggagaaatcactggttggcgcactcctgcgtgcggccacgtattacttctctgatttggaggtggcatgcgtcgggaacaacaaatgcgactcggaccgatg

SEQ ID NO: 7882 - DNA, 203 bp, Homo sapiens
  source 1..203: mol_type = other DNA
ggcgcgccagtcctcggaaacatccgcggggacctcgccgctgtggctgggaggatcgccagtgagacccacatcccgacgacatttaatttcgggatgatttacacagaggcagaggtggacgtgtacctgaggatgaaaagggcggaactctactgtccccgacccgttctcacgcactacgaccacgactcggaccgatg

SEQ ID NO: 7883 - DNA, 203 bp, Homo sapiens
  source 1..203: mol_type = other DNA
ggcgcgccagtcctcatgtccaccaagcacggacccgacttcaaccgtctggtgtccgcatttgaggaattgacaaagggagttaaggctatcaaggacggtctcgatgaggccaaaccctggtacaaagtcattaaactcctcagccgcctgtcgtgcatggccgctgtcgcagctcgctccaaggacgactcggaccgatg

SEQ ID NO: 7884 - DNA, 203 bp, Homo sapiens
  source 1..203: mol_type = other DNA
ggcgcgccagtccttttccggtccacgcccgaagacttggagagagcagagaaacaactcaaggcacgtgacatcaacgacatcttcgccatcctcaagaacggcgaatggctggtcaaacttatcctggctatccgcgactggatcaaagcctggatttcctcggaggagaagtacatctccatgaccgactcggaccgatg

SEQ ID NO: 7885 - DNA, 203 bp, Homo sapiens
  source 1..203: mol_type = other DNA
ggcgcgccagtcctacccgtggtcgtttgcctccgtggcaaatccggccagggcaagagcttccttgctaatgtgctcgcacaagcaatctcaacccacttcactggcagaaccgactctgtctggtactgcccacctgaccccgaccacttcgacggttacaaccaacaaactgtcgttgtcatggacgactcggaccgatg

SEQ ID NO: 7886 - DNA, 203 bp, Homo sapiens
  source 1..203: mol_type = other DNA
ggcgcgccagtcctaggacagcacgaagcggcaattgaattctacgaagggatggtacatgacagcattaaagaggaacttaagcccttgttggagcaaaccagcttcgccaagcgtgctttcaagcgcctcaaggagaacttcgaggtcatcactctcgttgttgtgctgttggcaaacatcatcatcgactcggaccgatg

SEQ ID NO: 7887 - DNA, 203 bp, Homo sapiens
  source 1..203: mol_type = other DNA
ggcgcgccagtcctcaaaactgacgatgaagtgaactctgagccagccaaacccgcggagaaaccacaagctgaaggaccctatgctggcccccttgaacgacaacagccgctgaaacttaaggctaagctccctcaggctgagggaccttacgtcgggccactagagagacaacaaccactgaaattcgactcggaccgatg

SEQ ID NO: 7888 - DNA, 203 bp, Homo sapiens
  source 1..203: mol_type = other DNA
ggcgcgccagtcctgagagcaagactgcctgtggccaaggaagggccatatgaaggaccagtgaagaagcctgtcgctttgaaactgaaagcaaaagccccgattgtcactgaaagcggatgcccaccgactgacttgcaaaagatggtcatggcaaacgtcaagcctgttgagcttatcctcgacggcgactcggaccgatg

SEQ ID NO: 7889 - DNA, 203 bp, Homo sapiens
  source 1..203: mol_type = other DNA
ggcgcgccagtcctgaagacagttgcgctctgctgcgcgactggagtgttcgggacggcttacctcgtgcctcgtcatcttttcgcagagaagtacgacaagatcatgctggacggccgagccttgacagacagtgacttcagagtgtttgagtttgaggtaaaagtaaaaggacaggacatgctctccgactcggaccgatg

SEQ ID NO: 7890 - DNA, 203 bp, Homo sapiens
  source 1..203: mol_type = other DNA
ggcgcgccagtcctcctgcaaatgaaagcccacatcgaccctccccctcacaccgaggggttggtagtggacaccagagaagttgaggagcgcgtgcatgtcatgcgcaagactaaacttgcacccaccgtggctcacggtgtgtttcagcctgaatttggacccgccgccctgtcgaacaacgacaacgactcggaccgatg

SEQ ID NO: 7891 - DNA, 203 bp, Homo sapiens
  source 1..203: mol_type = other DNA
ggcgcgccagtcctacgcctgaacgaaggcgtggttctggacgaggtcatcttctccaaacacaagggcgatgccacaatgtctgaggctgacaaaagactgttccgtctgtgcgctgctgattatgcctcgcatcttcacaatgtgctggggacagccaactctccactgagcgtgtttgaagccatcgactcggaccgatg

SEQ ID NO: 7892 - DNA, 203 bp, Homo sapiens
  source 1..203: mol_type = other DNA
ggcgcgccagtcctccctgatgttgattggcaacgatttggcactcactttgcccagtacaaaaacgtttgggacattgattattcggcctttgatgctaaccattgcagtgacgccatgaacatcatgttcgaggaggtcttccgtgaggaatttggatttcatccgaacgctgtttggattctcaacgactcggaccgatg

SEQ ID NO: 7893 - DNA, 203 bp, Homo sapiens
  source 1..203: mol_type = other DNA
ggcgcgccagtcctttcctacggggatgacattgtagttgcaagtgattacgatttggactttgaagctctcaagcctcactttaaatctcttggtcaaacaatcactccagccgacaaaagcgacaaaggttttgttcttggtcagtccatcaccgatgtcactttcctcaagaggcattttcatttcgactcggaccgatg

SEQ ID NO: 7894 - DNA, 203 bp, Homo sapiens
  source 1..203: mol_type = other DNA
ggcgcgccagtccttaggctggtcatcgtacctcctctaggctgacaactgtcgcccttttagggcccacgaccttcaagttacggttttagcgtccctcccgcggccgactcgcctacgtgaatgctagctcttcacccgaaggcctgcctttcaccccccccccccataaagaacgttaccgtcttcgactcggaccgatg

SEQ ID NO: 7895 - DNA, 203 bp, Homo sapiens
  source 1..203: mol_type = other DNA
ggcgcgccagtcctactggcgggtgctagtaacactcactttgcttcgtagcggagcacatgagcggtgggaacacccccgtggtaacacggacccaccgggccaaaagccacgcctcacggcctcatgtgtgtgcaaccccagcacggcaaattgtttgtgaaacacatcttaaggtaacactgggacgactcggaccgatg

SEQ ID NO: 7896 - DNA, 203 bp, Homo sapiens
  source 1..203: mol_type = other DNA
ggcgcgccagtcctccagcactcgccccagcgagatctgtgtgatcaacggggtcaccatgactctggccgatttccacgccggaattttcatcaagggtactgaacacgccgtgttcgctctcaacacatccgagggctggtacgccatagatgatgaggtgttctacccgtggacacccgaccctgcgactcggaccgatg

SEQ ID NO: 7897 - DNA, 203 bp, Homo sapiens
  source 1..203: mol_type = other DNA
ggcgcgccagtcctacagcgtgcttgcgtacgtgccctacgaccaggaacccctggacgtagattggcaggaccgcgcaggcctgttccttcgtggagcgggtcagtcgtcccctgccactgggtcacaaaaccaatctggcaacactggtagtataatcaacaactactacatgcagcagtaccaaacgactcggaccgatg

SEQ ID NO: 7898 - DNA, 203 bp, Homo sapiens
  source 1..203: mol_type = other DNA
ggcgcgccagtcctaggagacaactcttctggaggaccgcatcctcactacacgccacaacacaactacatccacaacacagagttctgttggcgtgacatacggttacgcctcgggggaccgtttcttgcctggacccaacaccagtgggctcgagacacgcgtcgaacaagcggagagattcttcacgactcggaccgatg

SEQ ID NO: 7899 - DNA, 203 bp, Homo sapiens
  source 1..203: mol_type = other DNA
ggcgcgccagtcctttcttgtcgccatggtccccgagctacaagagttggagaagcgtgacgtttcacaactcacgctctttcctcaccagttcatcaacccgcgcaccaacaccaccgcccacattgtggtgccatacgtgggtgtcaacagacacgaccaggcaaagatgcacaaggcgtggacaccgactcggaccgatg

SEQ ID NO: 7900 - DNA, 203 bp, Homo sapiens
  source 1..203: mol_type = other DNA
ggcgcgccagtccttcgtggtggcggtgctcgcaccgctaaccacttccaacatgggacaggacaacgtcgaggtgtatgcaaacatcgcacccaccaacgtgcacgttgctggagagaggccaatgaaacaaggcatcattcccgtggcctgcaacgatggctacggtggcttccagaacaccgatccgactcggaccgatg

SEQ ID NO: 7901 - DNA, 203 bp, Homo sapiens
  source 1..203: mol_type = other DNA
ggcgcgccagtcctccaagaccgcagatccaatctacggtctagtgtccaacccaccgcgcacagcgtttcccggtaggttcactaacctgctagacgtcgctgaagcgtgtccaacattcctggactttgacggcacaccttacgtcaaaaccaggcacaacagtggtagcaagatactagcacacacgactcggaccgatg

SEQ ID NO: 7902 - DNA, 203 bp, Homo sapiens
  source 1..203: mol_type = other DNA
ggcgcgccagtcctcgcacgaccctgactcggcggtgcttgtctcggtcagcgctggcgctgatcttgaatttcggctcccgattaaccctgcgacccaaacaactagtgcaggtgagggtggtgacgttgtgacaaccgatgtcacgacacatggcggagttgtggacacaccgcgacgccaacacacgactcggaccgatg

SEQ ID NO: 7903 - DNA, 203 bp, Homo sapiens
  source 1..203: mol_type = other DNA
ggcgcgccagtcctccaacgtggagttcctgctggacaggttcacacacattggtacgatcaccgcctcaaagacaatcgacctcatggacacgaaggaacacacattggtgggcgcaatcctgcgctcggctacgtactacttctgtgacctggaggttgctgtcttgggctcggaaaaatggactgcgactcggaccgatg

SEQ ID NO: 7904 - DNA, 203 bp, Homo sapiens
  source 1..203: mol_type = other DNA
ggcgcgccagtcctcgtgggttcccaacggttgcccacacaccgaacgcgtggaggacaacccagttgttcacgcgaagaacggtgtagcccgttttgccctgccatacacagcaccacacagggttcttgctacagtgtacaatggtaactgcaaatactccaaaacccagcacgttgtagcacgcccgactcggaccgatg

SEQ ID NO: 7905 - DNA, 203 bp, Homo sapiens
  source 1..203: mol_type = other DNA
ggcgcgccagtcctgtggcgacatggcagtgttggcacaacgcgttgagagtgaaatcacaagatgcaggcccacaacattcaacttcgggagactgttgtgtgaaacaggtgaggtctactaccggatgaaaagagctgagctgtattgcccacgacccttgcgggtcaggtacacgcataccactgcgactcggaccgatg

SEQ ID NO: 7906 - DNA, 203 bp, Homo sapiens
  source 1..203: mol_type = other DNA
ggcgcgccagtccttggcgatcatgctagctgacaccggtctcgagattctggacagcaccttcgtcgtgaagaaaatctccgacgcgctctccagcgttttccacgtcccggcccctgtcttcagtttcggagccccgattctgttggcaggtttggtcaaggtcgcctccacgttcttccggtccacgactcggaccgatg

SEQ ID NO: 7907 - DNA, 203 bp, Homo sapiens
  source 1..203: mol_type = other DNA
ggcgcgccagtcctagaaccctgacggcaaggacttcaagtacttcgcccagatggtctccaccacagggttcatcccacccatggcttcgctcgaagataagggaaaaccgttcaacagcaaggtcatcattgcgacgagcaacctttattctgggttcacacctaggacgatggtctgccccgacgcgactcggaccgatg

SEQ ID NO: 7908 - DNA, 203 bp, Homo sapiens
  source 1..203: mol_type = other DNA
ggcgcgccagtcctacggactcgacgccatggagcctgacacagcacccggtcttccctgggccctccaggggagacgccgcggagctctcatcgatttcgagaacggcactgtcggacccgagattgaacaggcactgaagctcatggagaagaaggagtacaagttcacctgccaaaccttcctgacgactcggaccgatg

SEQ ID NO: 7909 - DNA, 203 bp, Homo sapiens
  source 1..203: mol_type = other DNA
ggcgcgccagtcctacacggaacacgcctacgagaacaagcgcatcactgttgaaggtggaatgccctcgggttgctccgccaccagcatcatcaacaccattctcaacaacatctacgtgctctacgccctgcgtagacactatgagggagtcgagctgtcgcactacaccatgatttcctacggggcgactcggaccgatg

SEQ ID NO: 7910 - DNA, 203 bp, Homo sapiens
  source 1..203: mol_type = other DNA
ggcgcgccagtcctcacatgtcgccagtgtcagttgaaggtacgaatgtcatcatgttgattcttggattgaatattagtttgtataatgaaattaagcgcactttgaatgtagatagcataccaatggtacttaatttaaatgaattcagtagtatagttaaatcaattagcagtaaatggtataatcgactcggaccgatg

SEQ ID NO: 7911 - DNA, 203 bp, Homo sapiens
  source 1..203: mol_type = other DNA
ggcgcgccagtcctgttgatgaattggataaattgccaatgtcaataaaatcaacggaggaactgattgaaatgaagaattctggaactttaactgaagaatttgagctactgatctccaactcagaagatgacaatgagtgaaattactaatgtcactatctaattatacagtatttagccatcacacgactcggaccgatg

SEQ ID NO: 7912 - DNA, 203 bp, Homo sapiens
  source 1..203: mol_type = other DNA
ggcgcgccagtcctatattgtcaccatttctcagagcacaaaattatggtattaatcttccaatcacaggctccatggacactgcatacgctaattcaacgcaagaagaaacattcctcacttctacactttgcctatattatccgactgaggctgcgactgaaataaacgataattcatggaaagaccgactcggaccgatg

SEQ ID NO: 7913 - DNA, 203 bp, Homo sapiens
  source 1..203: mol_type = other DNA
ggcgcgccagtcctacactgtcacaactatttcttacgaaagggtggccaactggatccgtatattttaaagaatatactaacattgcatcgttttctgttgatccgcagttgtattgtgattataacgtagtactaatgaaatatgacgcgacgttgcaattggatatgtcagaacttgcggatctacgactcggaccgatg

SEQ ID NO: 7914 - DNA, 203 bp, Homo sapiens
  source 1..203: mol_type = other DNA
ggcgcgccagtcctaattgcagagcaacagattcaaaattttcaggtagctaattggttacattttgttaattataatcagtttagacaagtagtgattgatggagtgttaaatcaagtcttgaatgataatataagaaatggtcatgtagtcaaccaattaatggaagctctgatgcaattatctagcgactcggaccgatg

SEQ ID NO: 7915 - DNA, 203 bp, Homo sapiens
  source 1..203: mol_type = other DNA
ggcgcgccagtccttgaaaaattgcaattaacatcagtaacatcattatgtatgctaattggaaatgctacggttataccgagtccgcaaacattgttccattactataatgtgaatgtcaattttcattcaaattataatgaaagaattaatgacgcagttgcaattataactgcggcaaatagattcgactcggaccgatg

SEQ ID NO: 7916 - DNA, 203 bp, Homo sapiens
  source 1..203: mol_type = other DNA
ggcgcgccagtcctttgattttagagcgtcaatgcatatgttaacgtctaacctaacatttaccgtatattcagatttgcttgcgttcgtttcagctgatactgttgaaccaattaatgctgttgcttttgataatatgcgcatcatgaacgaactgtaaacgccaaccccattgtggagatatgacccgactcggaccgatg

SEQ ID NO: 7917 - DNA, 203 bp, Homo sapiens
  source 1..203: mol_type = other DNA
ggcgcgccagtccttcgaatggtgagtcaaggcagctaaagtttggtaggaaaacaattttttcaactaaaaagaatatgcatgtcatggatgatatggctaacgaaagatacacgcctggtataataccaccagtgaatgttgataaaccaataccattaggaagaagagatgttccaggaagaaggcgactcggaccgatg

SEQ ID NO: 7918 - DNA, 203 bp, Homo sapiens
  source 1..203: mol_type = other DNA
ggcgcgccagtcctgaaattttgatactattagactatcattccagttaatgagaccaccaaacatgacaccagcagtagcagtactattcccgaatgcacagccattcgaacatcatgcaacagtgggattgacacttagaattgagtctgcagtttgtgagtctgtactcgccgatgcaagtgaaacgactcggaccgatg

SEQ ID NO: 7919 - DNA, 203 bp, Homo sapiens
  source 1..203: mol_type = other DNA
ggcgcgccagtcctggatataagtggtcagaaatatcatttaagccagcgaattatcaatacacatatactcgtgatggtgaagaagttaccgcacatactacttgttcagtgaatggcgttaatgacttcagttttaatggaggatatttaccaactgattttgttgtatctaaatttgaagtaattcgactcggaccgatg

SEQ ID NO: 7920 - DNA, 203 bp, Homo sapiens
  source 1..203: mol_type = other DNA
ggcgcgccagtcctaaagagaattcatacgtctatatcgattactgggatgattcacaagcatttcgtaacgtggtgtatgtccgatcgttagcagcaaacttgaattcagttatgtgtactggaggcagctataattttagtctaccagttggacaatggcctgttttaactgggggagcagtttctcgactcggaccgatg

SEQ ID NO: 7921 - DNA, 203 bp, Homo sapiens
  source 1..203: mol_type = other DNA
ggcgcgccagtcctggttcatctatacgttcgattggatcttcagcatcagcatggacggatgtatcaacacaaataactgatatatcgtcatcagtaagttcagtttcgacacaaacgtcaactatcagtagaagattgagactaaaggaaatggcaacacaaactgagggtatgaattttgatgatcgactcggaccgatg

SEQ ID NO: 7922 - DNA, 203 bp, Homo sapiens
  source 1..203: mol_type = other DNA
ggcgcgccagtcctttaaaaatttgaacgataattacggcattactaagcaacaagcatttaatcttttaagatctgacccaagagttttacgtgaattcattaatcaggacaatcctataattagaaatagaattgaacaactgattatgcaatgcaggttgtgagtaatttctagaggatgtgacccgactcggaccgatg

SEQ ID NO: 7923 - DNA, 203 bp, Homo sapiens
  source 1..203: mol_type = other DNA
ggcgcgccagtcctcacaccccactgactgactcctttggatcttgacctcggaatgcctacttgacctcccacttgcctctcccttttcggattgccggtggtgcctggcggaaaaagcacaagtgtgttgttggctaccaaactcctacccgacaaaggtgcgtgtccgcgtgctgagtaatgggacgactcggaccgatg

SEQ ID NO: 7924 - DNA, 203 bp, Homo sapiens
  source 1..203: mol_type = other DNA
ggcgcgccagtccttaggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcgactcggaccgatg

SEQ ID NO: 7925 - DNA, 203 bp, Homo sapiens
  source 1..203: mol_type = other DNA
ggcgcgccagtcctcttgatagagtcgcggctggccgactcatgggttaaagtcagttgacaagacacatggcttcttcaattctgatctctgactccaccttcgcccccatcctcacccacaagctctctcgacgtgtcaggcgacaccccgttgcctggcatcccagagagaacacccggctgtcccgactcggaccgatg

SEQ ID NO: 7926 - DNA, 203 bp, Homo sapiens
  source 1..203: mol_type = other DNA
ggcgcgccagtccttacatcacagccatggaagagttggatgcttgctacatcaacgaacaacaccggctcttcccccttccccgtccctctcattggtacaactgtctctactgtcaacatccctcggaggacggtgacactctcatgtcgctggcctgtgagtacgatgaagactgcccccaccatcgactcggaccgatg

SEQ ID NO: 7927 - DNA, 203 bp, Homo sapiens
  source 1..203: mol_type = other DNA
ggcgcgccagtcctaggcctctttccaagttctttgctgaaaaccctcctcctgcttcccttgcagggaaaatgaatctctctgacttttctgacctcaccctctccacaccttgccaaatcgtgcgccagggaaattcaaccactaacatctacggaagtaataacaatgttactactgacgttggtcgactcggaccgatg

SEQ ID NO: 7928 - DNA, 203 bp, Homo sapiens
  source 1..203: mol_type = other DNA
ggcgcgccagtcctgcaaacggttggactcctacggttaacacaggtcttggtgatggtcctgtctcctcttctgctgacgatcttgctggtcgctgtggtggatcctccaccgctagcaaggattcctccaaatcctctaaggttaaggttcacaactttaaccattggtgggaacctgctgcagctcgactcggaccgatg

SEQ ID NO: 7929 - DNA, 203 bp, Homo sapiens
  source 1..203: mol_type = other DNA
ggcgcgccagtcctaaagctctctcccgtggcgttgacaaagcgctcgacgggattgagggcgccggcaaacttgccggtagtgccatcaaaagcaagctctcaggtgcccgccctggcccctcccctaatctcatagctctcaacccctcttccacccaatctggtaatgctatgatcacaacgggtcgactcggaccgatg

SEQ ID NO: 7930 - DNA, 203 bp, Homo sapiens
  source 1..203: mol_type = other DNA
ggcgcgccagtccttccactgctcctgtggttgttgcttaccctcccaccccttctgtccctctccccaatccagatgctccctcacaacctggcccgtctggtgaccgtacatggttgctagacagtctcgaatggaccaccgaggacccatccttctggtgcctcgctggtccaaacgggatgcaacgactcggaccgatg

SEQ ID NO: 7931 - DNA, 203 bp, Homo sapiens
  source 1..203: mol_type = other DNA
ggcgcgccagtcctacaatggctgagacgactggcgaaaaagttgccgaggctgtgattgaacctgtccttcttgctgctactggaactcctatttcttttgtcactaacctcttcgcccaatggcgaggggagctccagctttcccttcttttcactggttctgctcaacactttgggcgtcttgcacgactcggaccgatg

SEQ ID NO: 7932 - DNA, 203 bp, Homo sapiens
  source 1..203: mol_type = other DNA
ggcgcgccagtcctactcttggtactgtctctatctgggtgatgaatccactcaccggaccatcatccgctcccccctctgctgtgatccaggctttcgtttctgctggggaatccttcaccttgcgtggtatccaagctcctggattccaaatccaggctgctgacgatgctgacgctcccactccacgactcggaccgatg

SEQ ID NO: 7933 - DNA, 203 bp, Homo sapiens
  source 1..203: mol_type = other DNA
ggcgcgccagtcctgtttccaacattgagtctggttctgctactactgttcctgaacctcgtaccaccttctcctacactgacaatcctactccccctgacaccaacctacagcgtttcttctccatttacagacccatctttgtgaatggtcaggattactctgtgggcttcactgctgaggctggccgactcggaccgatg

SEQ ID NO: 7934 - DNA, 203 bp, Homo sapiens
  source 1..203: mol_type = other DNA
ggcgcgccagtcctgtccgtcctaagggccgttcccgcattgtgcgtcagtgcttgactaacgatgtccccacccccacactctgtccagatgtgcgggtatacattgtcaaggtccagcgcatgacgtacacccattgggcactccgcgcggtccattcagatcgcgtggaacaaatttctctctcccgactcggaccgatg

SEQ ID NO: 7935 - DNA, 203 bp, Homo sapiens
  source 1..203: mol_type = other DNA
ggcgcgccagtcctaacactggcttctctctcctccttggcttgggcgctcttgcccttctgtctggttgtgccgccgtgcaagcgtcgaaaggcggtataattcgacagggtcttctgtctcttgaagctcctcctgaggttgtccaggctgcaaaccgtgttgctgaatcaattgagaccactgctcgactcggaccgatg

SEQ ID NO: 7936 - DNA, 203 bp, Homo sapiens
  source 1..203: mol_type = other DNA
ggcgcgccagtccttcggtagtgcgtgaggctgacctagccaggtctaccctcaatatctcaatggcagcaaaccgagttgctgagtcgattgaaaccaccgccaccgcagtgcgcgaggctgacctcgctagatcgaccctcaacatctcaatggctgcgtctgacatcagaatggcagcgacacagcgactcggaccgatg

SEQ ID NO: 7937 - DNA, 203 bp, Homo sapiens
  source 1..203: mol_type = other DNA
ggcgcgccagtcctgtttcttccagtctgaacggcttcactgacatgctttcctctttctccaaaaccttcactcagggtgcttccaaaatgctgagtgatggtatttccactttccttacttgggtggccaaagtctttggttaccttcttgtcctctttggatctcccactccgatgtccatagctcgactcggaccgatg

SEQ ID NO: 7938 - DNA, 203 bp, Homo sapiens
  source 1..203: mol_type = other DNA
ggcgcgccagtccttcctctgagcgcactccggtgtccgcgatcacggacgccatcacgcgctgtcgcgagctcaccaaggtggctgccgacgctaagtctggctctcactcttccttcctcctccaggccttgcgtaactaccaacttgctcttaattctgcacgcaaggcccaatctggtccccgtcgactcggaccgatg

SEQ ID NO: 7939 - DNA, 203 bp, Homo sapiens
  source 1..203: mol_type = other DNA
ggcgcgccagtcctccagaacccgttgtgatctacctctatggtccaccgggaactggcaagtccctccttgcttctctccttgctagagttcttgctcagaagttatctggtaacccagatgacgtctactctccttcttctgccgtctgcgaatacttcgacggttacactggccaggtcgtccaccgactcggaccgatg

SEQ ID NO: 7940 - DNA, 203 bp, Homo sapiens
  source 1..203: mol_type = other DNA
ggcgcgccagtcctctgggaaaggaacttacaatcatccatttccctaccatccgccaacatcgcgatctccgtcgctttattggctaccacccctatcccactggacatcttatttccactctctctggccctcctgtttacctgcggttttccaaaaaccgtatggttactcttgacctccccggtcgactcggaccgatg

SEQ ID NO: 7941 - DNA, 203 bp, Homo sapiens
  source 1..203: mol_type = other DNA
ggcgcgccagtcctgttgtggaagaacctacagcttatggttacaaagcccccaccttccagggtctctgtggtgcacctctcatcacggatgatccagcaggtgttaagctgttgggactccacgttgccggggttactggttgctctggcttctctgtaccaatctctacctatcttcctgagatccgactcggaccgatg

SEQ ID NO: 7942 - DNA, 203 bp, Homo sapiens
  source 1..203: mol_type = other DNA
ggcgcgccagtcctaaagtcacattaggcctcacacgtgtggtcgaagctgcacccatccacgctatcatcgctggtaggatgctgcttggtggactcattgagtacatgcaggcaaatcctggcaagcatggtagtgctgttggttgcaacccagacctacactggactaaattcttcttcaaattccgactcggaccgatg

SEQ ID NO: 7943 - DNA, 203 bp, Homo sapiens
  source 1..203: mol_type = other DNA
ggcgcgccagtccttgtcactaccctcaagtctttgatctggattacaagtgttttgatgccaccctcccttcctgtgccttccgcattgttgagaaacacctcgaacgcctcattggagacgaacgggtaacccgttacatcgagaccatacgacactcgcgccatgtctttggcaacgagacgtatcgactcggaccgatg

SEQ ID NO: 7944 - DNA, 203 bp, Homo sapiens
  source 1..203: mol_type = other DNA
ggcgcgccagtcctccatcattcatcaaggagttctacgacaggtacaccccacttgttgtgactccagcaaacaaaacagacactttcccggaaaactccaccatctatgacgtcacgtttctgaaacgttggtttgtgcctgatgacattcgaccattctacatccacccggtcatggatccagaccgactcggaccgatg

SEQ ID NO: 7945 - DNA, 203 bp, Homo sapiens
  source 1..203: mol_type = other DNA
ggcgcgccagtcctcgatgccgggaaggccatttcgtttgctaccacattgggagtgaacaagtgccacgtacagatcatggacctcgggcacatgtgtgacgccaccatgagttatgagtgccctatgctggatgagggagtggaaccagatgatgtcgattgctggtgcaacacgacatcaacttgcgactcggaccgatg

SEQ ID NO: 7946 - DNA, 203 bp, Homo sapiens
  source 1..203: mol_type = other DNA
ggcgcgccagtccttgtcttggaacatggaggctgcgttaccgtgatggcacaggacaagccaacagtcgacatagagttggtcacgacgacggttagtaacatggccgaggtaagatcctattgctacgaggcatcgatatcggacatggcttcggacagtcgttgcccaacacaaggtgaagcctacgactcggaccgatg

SEQ ID NO: 7947 - DNA, 203 bp, Homo sapiens
  source 1..203: mol_type = other DNA
ggcgcgccagtcctagtcgggggtgtgttcaactcactgggtaagggcattcaccagatttttggagcagccttcaaatcactgtttggaggaatgtcctggttctcacagatcctcataggcacgctgctagtgtggttaggtttgaacacaaagaatggatctatctccctcacatgcttggccctcgactcggaccgatg

SEQ ID NO: 7948 - DNA, 203 bp, Homo sapiens
  source 1..203: mol_type = other DNA
ggcgcgccagtcctagtcaagcaggcctgggaagaggggatctgtgggatctcatccgtttcaagaatggaaaacatcatgtggaaatcagtagaaggggagctcaatgctatcctagaggagaatggagttcaactgacagttgttgtgggatctgtaaaaaaccccatgtggagaggtccacaaagcgactcggaccgatg

SEQ ID NO: 7949 - DNA, 203 bp, Homo sapiens
  source 1..203: mol_type = other DNA
ggcgcgccagtccttgaggaatgtccaggcaccaaggtttacgtggaggagacatgcggaactagaggaccatctctgagatcaactactgcaagtggaagggtcattgaggaatggtgctgtagggaatgcacaatgcccccactatcgtttcgagcaaaagacggctgctggtatggaatggagatcgactcggaccgatg

SEQ ID NO: 7950 - DNA, 203 bp, Homo sapiens
  source 1..203: mol_type = other DNA
ggcgcgccagtcctaggactactgttactcacaaggagtgggaagcggagctggccccctagtgaagttctcacagccgttggcctgatatgtgcactggccggagggtttgccaaggcagacattgagatggctggacccatggctgcagtaggcttgctaattgtcagctatgtggtctcgggaaacgactcggaccgatg

SEQ ID NO: 7951 - DNA, 203 bp, Homo sapiens
  source 1..203: mol_type = other DNA
ggcgcgccagtcctgagtgtggacatgtacattgaaagagcaggtgacatcacatgggaaaaggacgcggaagtcactggaaacagtcctcggcttgacgtggcactggatgagagtggtgacttctccttggtagaggaagatggtccacccatgagagagatcatactcaaggtggtcctgatggccgactcggaccgatg

SEQ ID NO: 7952 - DNA, 203 bp, Homo sapiens
  source 1..203: mol_type = other DNA
ggcgcgccagtcctactcagcgaggtacagcttttggccgtacctcccggagagagggccagaaacattcagaccctgcctggaatattcaagacaaaggacggggacatcggagcagttgctctggactaccctgcagggacctcaggatctccgatcctagacaaatgtggaagagtgataggactcgactcggaccgatg

SEQ ID NO: 7953 - DNA, 203 bp, Homo sapiens
  source 1..203: mol_type = other DNA
ggcgcgccagtccttgatgcgtttcctgactctaactcaccaatcatggacacagaagtggaagtcccagagagagcctggagctcaggctttgattgggtgacagaccattctgggaaaacagtttggttcgttccaagcgtgagaaacggaaatgaaatcgcagcctgtctgacaaaggctggaaacgactcggaccgatg

SEQ ID NO: 7954 - DNA, 203 bp, Homo sapiens
  source 1..203: mol_type = other DNA
ggcgcgccagtcctgcgggtcatacagctcagcaggaagacttttgagacagaatttcagaaaacaaaaaatcaagagtgggactttgtcataacaactgacatctcagagatgggcgccaacttcaaggctgaccgggtcatagactctaggagatgcctaaaaccagtcatacttgatggtgagagcgactcggaccgatg

SEQ ID NO: 7955 - DNA, 203 bp, Homo sapiens
  source 1..203: mol_type = other DNA
ggcgcgccagtcctagtcatcttggctgggcccatgcctgtcacgcatgctagtgctgctcagaggagaggacgtataggcaggaaccctaacaaacctggagatgagtacatgtatggaggtgggtgtgcagagactgatgaaggccatgcacactggcttgaagcaagaatgcttcttgacaacatcgactcggaccgatg

SEQ ID NO: 7956 - DNA, 203 bp, Homo sapiens
  source 1..203: mol_type = other DNA
ggcgcgccagtcctcgctggaaaaagaggagcggctttgggagtaatggaggccctgggaacactgccaggacacatgacagagaggtttcaggaagccattgacaacctcgccgtgctcatgcgagcagagactggaagcaggccttataaggcagcggcagcccaactgccggagaccctagagaccgactcggaccgatg

SEQ ID NO: 7957 - DNA, 203 bp, Homo sapiens
  source 1..203: mol_type = other DNA
ggcgcgccagtcctgtttttattactggtggtgctcatacccgagccagagaagcaaagatctccccaagataaccagatggcaattatcatcatggtggcagtgggccttctaggtttgataactgcaaacgaacttggatggctggaaagaacaaaaaatgacatagctcatctaatgggaaggagcgactcggaccgatg

SEQ ID NO: 7958 - DNA, 203 bp, Homo sapiens
  source 1..203: mol_type = other DNA
ggcgcgccagtccttggcatgggcaaagggatgccatttatgcatggggaccttggagtcccgctgctaatgatgggttgctattcacaattaacacccctgactctgatagtagctatcattctgcttgtggcgcactacatgtacttgatcccaggcctacaagcggcagcagcgcgtgctgcccacgactcggaccgatg

SEQ ID NO: 7959 - DNA, 203 bp, Homo sapiens
  source 1..203: mol_type = other DNA
ggcgcgccagtcctggctggagctctgatcacagcagcgacctccaccttgtgggaaggctctccaaacaaatactggaactcctctacagccacctcactgtgcaacatcttcagaggaagctatctggcaggagcttcccttatctatacagtgacgagaaacgctggcctggttaagagacgtggcgactcggaccgatg

SEQ ID NO: 7960 - DNA, 203 bp, Homo sapiens
  source 1..203: mol_type = other DNA
ggcgcgccagtcctaggtgggacgggagagactctgggagagaagtggaaagctcgtctgaatcagatgtcggccctggagttctactcttataaaaagtcaggtatcactgaagtgtgtagagaggaggctcgccgtgccctcaaggatggagtggccacaggaggacatgccgtatcccggggaagcgactcggaccgatg

SEQ ID NO: 7961 - DNA, 203 bp, Homo sapiens
  source 1..203: mol_type = other DNA
ggcgcgccagtccttgcaaagatcagatggttggaggagagaggatatctgcagccctatgggaaggttgttgacctcggatgtggcagagggggctggagctattatgccgccaccatccgcaaagtgcaggaggtgagaggatacacaaagggaggtcccggtcatgaagaacccatgctggtgcacgactcggaccgatg

SEQ ID NO: 7962 - DNA, 203 bp, Homo sapiens
  source 1..203: mol_type = other DNA
ggcgcgccagtcctaagctatgggtggaacatagttcgtctcaagagtggagtggacgtcttccacatggcggctgagccgtgtgacactctgctgtgtgacataggtgagtcatcatctagtcctgaagtggaagagacacgaacactcagagtgctctctatggtgggggactggcttgaaaaaagcgactcggaccgatg

SEQ ID NO: 7963 - DNA, 203 bp, Homo sapiens
  source 1..203: mol_type = other DNA
ggcgcgccagtcctaccaggggccttctgtataaaggtgctgtgcccatacaccagcactatgatggaaaccatggagcgactgcaacgtaggcatgggggaggattagtcagagtgccattgtgtcgcaactccacacatgagatgtactgggtctctggggcaaagagcaacatcataaaaagtgtcgactcggaccgatg

SEQ ID NO: 7964 - DNA, 203 bp, Homo sapiens
  source 1..203: mol_type = other DNA
ggcgcgccagtcctatacggccaacaaagagtcttcaaagaaaaagtggacaccagggtgccagatccccaagaaggcactcgccaggtaatgaacatagtctcttcctggctgtggaaggagctggggaaacgcaagcggccacgcgtctgcaccaaagaagagtttatcaacaaggtgcgcagcaacgactcggaccgatg

SEQ ID NO: 7965 - DNA, 203 bp, Homo sapiens
  source 1..203: mol_type = other DNA
ggcgcgccagtccttctcagaccagctgaaggaggaaaaacagttatggacatcatttcaagacaagaccagagagggagtggacaagttgtcacttatgctctcaacacattcaccaacttggtggtgcagcttatccggaacatggaagctgaggaagtgttagagatgcaagacttatggttgttcgactcggaccgatg

SEQ ID NO: 7966 - DNA, 203 bp, Homo sapiens
  source 1..203: mol_type = other DNA
ggcgcgccagtcctaccctcgactggatggagcaattgggaagaagtcccgttctgctcccaccacttcaacaagctgtacctcaaggatgggagatccattgtggtcccttgccgccaccaagatgaactgattggccgagctcgcgtctcaccaggggcaggatggagcatccgggagactgcctgcgactcggaccgatg

SEQ ID NO: 7967 - DNA, 203 bp, Homo sapiens
  source 1..203: mol_type = other DNA
ggcgcgccagtccttcttgcaaaatcatatgcgcagatgtggcagctcctttatttccacagaagagaccttcgactgatggctaatgccatttgctcggctgtgccagttgactgggtaccaactgggagaaccacctggtcaatccatggaaagggagaatggatgaccactgaggacatgctcatcgactcggaccgatg

SEQ ID NO: 7968 - DNA, 203 bp, Homo sapiens
  source 1..203: mol_type = other DNA
ggcgcgccagtcctaggagaagctgggaaaccaagctcatagtcaggccgagaacgccatggcacggaagaagccatgctgcctgtgagcccctcagaggacactgagtcaaaaaaccccacgcgcttggaagcgcaggatgggaaaagaaggtggcgaccttccccacccttcaatctggggcctgacgactcggaccgatg

SEQ ID NO: 7969 - DNA, 203 bp, Homo sapiens
  source 1..203: mol_type = other DNA
ggcgcgccagtcctccttttcggcctaaagaagatccttatgaagttgctgggagggtttggaccagttaggctggttctagccttccttgccttcttcaaattcacatcgctgcgcccttcccctggactcctcaagagatggagctcggtagggaagaaagaggccagcagaaccctcaaagggttcgactcggaccgatg

SEQ ID NO: 7970 - DNA, 203 bp, Homo sapiens
  source 1..203: mol_type = other DNA
ggcgcgccagtcctacctggcgaggatggcatcaacaggtgcatactgcaggccatggatgttggcgaactctgcgctcataccatgacgtatgaatgcccaatccttgataagttggttgaacctgaagacatagactgctggtgcaatgcttcggccacctgggtgatgtacgggacgtgtttgcacgactcggaccgatg

SEQ ID NO: 7971 - DNA, 203 bp, Homo sapiens
  source 1..203: mol_type = other DNA
ggcgcgccagtcctgacagtcatgggtgaaaacagacccaccatcgacatagagcttctcaagacagctgcctccaacatggctcatgcaagggcctactgctatgaggcgaccataagtgatacagtcatggagacaagatgcccgacacaaggagaagcagtgtctgacaaaaaaggggatggcaacgactcggaccgatg

SEQ ID NO: 7972 - DNA, 203 bp, Homo sapiens
  source 1..203: mol_type = other DNA
ggcgcgccagtccttatcggaaaggcagtgcaccaggttctgggcggagccttcaggacgctgtttggtggcatgaattggttcaccaagatcctgatcggtgggctactgtgctggctgggagtgaactcccgtagcacgtcgctggcagcagggttcatcacattgggggcaatcctcatctttttcgactcggaccgatg

SEQ ID NO: 7973 - DNA, 203 bp, Homo sapiens
  source 1..203: mol_type = other DNA
ggcgcgccagtcctctctacgcacacaatttggagtgagggagtggaggagagtcatttgatcatcccacacacactagcaggaccacgctcttggcacaacaccaggaaaggataccagacccaggtcaaggggccttgggctgaaggtgagcttgaattggtttttgaccactgcccaggaaccaccgactcggaccgatg

SEQ ID NO: 7974 - DNA, 203 bp, Homo sapiens
  source 1..203: mol_type = other DNA
ggcgcgccagtcctggtcactctcatggacttgggcaggtacatgttcctggtggggacagcgttcgctgaagtgaactctggtagagacgtggcccatctggcgttgattgccactttcaaagttaggccggcattgctaacaacatatctatggagattgcactggggcacaagggaagagataggcgactcggaccgatg

SEQ ID NO: 7975 - DNA, 203 bp, Homo sapiens
  source 1..203: mol_type = other DNA
ggcgcgccagtcctgagaaggagctggcccccaacagaagctctatccgccgtagggatgttgggcctggtgatgggcgcgacgatgaagcccggagctgagctgtcagggccactcgtagcctccggcctcctgctggtttgctacatcatatctggaaaaggcacagatctttttttagagcgcgccgactcggaccgatg

SEQ ID NO: 7976 - DNA, 203 bp, Homo sapiens
  source 1..203: mol_type = other DNA
ggcgcgccagtccttgcggaactgtcctggtgtccggacgcagcggtttcaggcaccagcccaaggcttgatgtgaagatcacagaaggtggagatatggaactgattgatgataaaggaccatccacagaatctatcgtcctcaaggcaaccctcgtggctgtgtgtggaatgtggccgctggcaatcgactcggaccgatg

SEQ ID NO: 7977 - DNA, 203 bp, Homo sapiens
  source 1..203: mol_type = other DNA
ggcgcgccagtcctggcaccaggtaaaggagcagagaatgtgcagaccaaacctgggatattcaacacagccacagggaccataggggcggttgcattggattaccccgctggcacctctggctcacccatcctaaacagtgaagggaaggttgtgggcttgtacgggaacggtgtgctggtgggcggcgactcggaccgatg

SEQ ID NO: 7978 - DNA, 203 bp, Homo sapiens
  source 1..203: mol_type = other DNA
ggcgcgccagtcctaagctcatatgtgagtgccatatcccaggtcaagcaccctgagacccaaccacaggtggtcagtgacgacatgttcaggaaaaagaacttgaccattcttgacctccatcccggggcgggaaagaccagacgcatcctgcctgagatagtgaaacaagctattgacaggaggatcgactcggaccgatg

SEQ ID NO: 7979 - DNA, 203 bp, Homo sapiens
  source 1..203: mol_type = other DNA
ggcgcgccagtcctgaggacagtcatcttggccccgacgagagttgttgccgcggagatgggtgaggctctgaaggggctgcccgttagatacatgaccacagccgtgcagagagagcacacaggaaccgagatcgtggatgtcatgtgccatgcaacattcaccatgcggttgatacagcccatgcgcgactcggaccgatg

SEQ ID NO: 7980 - DNA, 203 bp, Homo sapiens
  source 1..203: mol_type = other DNA
ggcgcgccagtcctagatgacatggaaatcatggttcccgataaaccctggaataaagggtttgaatgggtcaccgactatcctggcaagactgtgtggtttgttcctagtgtccgcaatgggaatgagatagcatgttgtctggaaaaggcaggaaagaaaaccattcagctaaataggaaaagcttcgactcggaccgatg

SEQ ID NO: 7981 - DNA, 203 bp, Homo sapiens
  source 1..203: mol_type = other DNA
ggcgcgccagtcctcaacacagagtatcagagaacaaagaatgaacaatgggactttgtgatcacaacagacatctcggagatgggcgccaactttgacgctgagcgcgtgattgactcacgaaaatgcataaaaccagtcattctggaggaaggcagggttaacctggtgggaccaatcccagtgaccgactcggaccgatg

SEQ ID NO: 7982 - DNA, 203 bp, Homo sapiens
  source 1..203: mol_type = other DNA
ggcgcgccagtcctcgcctcaagcgccgctcagagaagagggaggatcggcagaaatccgagtagaacaggtgacgagtaccgatactcgggggggaccgttgaggatgatagtgaccacgcccactggacagaagccaaaatcctccttgacaatgtgcagatgccagacaggataataccccagctcgactcggaccgatg

SEQ ID NO: 7983 - DNA, 203 bp, Homo sapiens
  source 1..203: mol_type = other DNA
ggcgcgccagtcctctatggacctgagcaaggaaaagtgaatgacgttgacgggatctacagactgcgggagccagagaaaaaagtgttcattgagcttctcaagagagctgaattgccagtgtggctaacctaccaggtcgcgtcagcgggcatacagtacaatgacaaaaaatggtgctttgatggcgactcggaccgatg

SEQ ID NO: 7984 - DNA, 203 bp, Homo sapiens
  source 1..203: mol_type = other DNA
ggcgcgccagtcctaacgggcggtggatgcttgctgatgatgaagagcaaacccatagggaaaatgactgcgggactggtggtgacattggtagcagccggcctgtgttggcaagccaacgtcagtaaggttgtgatcgccagcgggatgaccgtgaccttgctcctgctgatagtgctcgtcccagacgactcggaccgatg

SEQ ID NO: 7985 - DNA, 203 bp, Homo sapiens
  source 1..203: mol_type = other DNA
ggcgcgccagtcctacggctcgaacttgatttgaaacctgcaaccacctggacactgtacgcagtcattaccattatcttgtcacccttcgtgcagcacagcatcattaccacatacaacaacttctcattgacagcaataggcaaccaggccgggattctgttcggaatggggacgggagtccccttcgactcggaccgatg

SEQ ID NO: 7986 - DNA, 203 bp, Homo sapiens
  source 1..203: mol_type = other DNA
ggcgcgccagtcctctacagaacttgggcttacctagggagttacaccaccgagccaaagggaacatccgcctccatggtgaacggagtcgtgaagcttctcacgaagccctgggatgtggtgagcggagttgtgaacatagccatgaccgacacaaccccttttgggcaacagagagtgttcaaggacgactcggaccgatg

SEQ ID NO: 7987 - DNA, 203 bp, Homo sapiens
  source 1..203: mol_type = other DNA
ggcgcgccagtcctcgccgatgacacagcaggatgggacactcgtgttacggaagcagacttggatgacgaagcgctcatcatagagagcatggacagagagcacgcccagctggcttcggtgctcacggaaatggcttacaagaacaaagtggtttgtgtgctgaggccgggaaaaggggaaaccctcgactcggaccgatg

SEQ ID NO: 7988 - DNA, 203 bp, Homo sapiens
  source 1..203: mol_type = other DNA
ggcgcgccagtcctgatggatgtgattagccgcagggaccaaagagggagtgggcaggtggtgacatacgcactgaacacctttacaaatgagaaagtccagctcattagatgcatggaggccgagggcgtcctagaagagagtgacgcagagcacctgatggatgagagcaaagtcaacaaatggctcgactcggaccgatg

SEQ ID NO: 7989 - DNA, 203 bp, Homo sapiens
  source 1..203: mol_type = other DNA
ggcgcgccagtccttgtgcggcctgcgagccccctgggactatcggtatccaggctaaacaaaaaccgttgcacctcattgggctggtgcgtaaaatgacattgcggggcccaagccggctaagctgtaaccggtggaaggactaggaggttagaggagaccccccgcgcccataaccaacataaaaccgactcggaccgatg

SEQ ID NO: 7990 - DNA, 203 bp, Homo sapiens
  source 1..203: mol_type = other DNA
ggcgcgccagtcctgctgtaaccggtggaaggactaggaggttagaggagaccccccgcgcccataaccaacataaaacagcatattgacacctgggaaagaccggagactctgttggctttccccacaccagccccctggcacagagcgccagatcgggggttggtgtggagcaacccaacaggactcgactcggaccgatg

SEQ ID NO: 7991 - DNA, 203 bp, Homo sapiens
  source 1..203: mol_type = other DNA
ggcgcgccagtcctgatatctcggatcaagaggatgctcgatggactactcagaggagtaggaccagtcagaattgtcttggcgatcttaacctttttcaaatttacagctttgaaaccaacggcaggattgttgagacgatggaagctagtgggggtggttgaggccacccgccacttgaaaagcttcgactcggaccgatg

SEQ ID NO: 7992 - DNA, 203 bp, Homo sapiens
  source 1..203: mol_type = other DNA
ggcgcgccagtcctggcggttatgatcccaactgctggaggaaacaaccgatgcgttgtgaaagctctggatgtcggattgatgtgccctgatgacatcacgtatttatgtcccaagctagaggatgggtatgacccagaggatatagactgctggtgcaacaccacggagatctacatccactacggcgactcggaccgatg

SEQ ID NO: 7993 - DNA, 203 bp, Homo sapiens
  source 1..203: mol_type = other DNA
ggcgcgccagtcctccggtgcaccccaacgcgacacgcgagacgatcgaggcggtctatcacagtgcaccatcacggagagagcttgctcgaagcaaagaatacaccatggatggactcaaccaaggctaccaaatacttgaccaaggtggaaaactgggccatacgtaaccctggatacgcactagccgactcggaccgatg

SEQ ID NO: 7994 - DNA, 203 bp, Homo sapiens
  source 1..203: mol_type = other DNA
ggcgcgccagtcctaagctgtgtgaccattacagcaaaggacaagcccacaatcgatgtgaagatgatgaacatggaagccactgacttggcgcttgtgagatcatattgttacgagcctaaaatcactgatgttagtactgaaccaagatgccccaccatgggagaggcccacaacaccaaagccaacgactcggaccgatg

SEQ ID NO: 7995 - DNA, 203 bp, Homo sapiens
  source 1..203: mol_type = other DNA
ggcgcgccagtccttaaccaggagtacgtgtgtaagaaaggttatactgacagaggttggggtaatggttgtggactgttcggaaagggcagtattcacacatgcgccaaatttgagtgcaccaataaggctgagggaagaattgtgcagaaggaaaatgttcatttcgagttggctgtgtttgtgcacgactcggaccgatg

SEQ ID NO: 7996 - DNA, 203 bp, Homo sapiens
  source 1..203: mol_type = other DNA
ggcgcgccagtcctagggcatgggacagttgttgtggaactcagctattctgggtctgatggaccatgtcgtatacccatatcaatgacagccaaccttcaggatttgaccccgataggaaggctcataacggtcaatccatatgtgtctacatcatcatcggggacaaaagtggttgttgagcttgacgactcggaccgatg

SEQ ID NO: 7997 - DNA, 203 bp, Homo sapiens
  source 1..203: mol_type = other DNA
ggcgcgccagtcctacgggaaaaaggaatctgtggtgtaaggtccgtgggaagactggagcataacatgtggaattcaatcaagcatgagctgaatgccatacttgaggacaacgggccagacttgacagtcgtcgttgaacagccaactggtagatttaggaaaacccaccggcgtttagtgtggaccgactcggaccgatg

SEQ ID NO: 7998 - DNA, 203 bp, Homo sapiens
  source 1..203: mol_type = other DNA
ggcgcgccagtcctaggcaccaaagtgacagtcaccccaacatgcagggatagggttgcctccgccagaacaacaacggcaagcggtaagctgatcacagattggtgctgtaggtcatgcactctccctccattgcggtacatgacaaagagcggctgctggtatggaatggagattagacctacagtcgactcggaccgatg

SEQ ID NO: 7999 - DNA, 203 bp, Homo sapiens
  source 1..203: mol_type = other DNA
ggcgcgccagtccttgccaccctcttaggcgtggcactggcaatgataaccatggcgttgcacgactggaacatgaccatacccagcttgttgaattcaggagccacggcgtggctgttgctgcgcgcagtgagtgaagggaccgtcagcgcggcctgtattcccattctcggacttttggctccaggcgactcggaccgatg

SEQ ID NO: 8000 - DNA, 203 bp, Homo sapiens
  source 1..203: mol_type = other DNA
ggcgcgccagtcctaatgaaaataattggaattgatgtatttcggatcgggctgcttatcatcggagttatgtcactcctgaaagaaagaaacaatgccatcgcaaaaaagaaaggtggagtgctgattggtttggccctggcccaagacggctgggtgaatccactggtgtacgcaggactgacgttcgactcggaccgatg

SEQ ID NO: 8001 - DNA, 203 bp, Homo sapiens
  source 1..203: mol_type = other DNA
ggcgcgccagtccttgacctgtggttggagcgagctggagacatctcgtggattgaggatgcccaaataacaggaagctcacaacggtatgacgttgagatagattgtgatgggaacatgaaattgatgaatgatcaaggagtccctttttccatttgggcccttaggacaggactcattctagcatccgactcggaccgatg

SEQ ID NO: 8002 - DNA, 203 bp, Homo sapiens
  source 1..203: mol_type = other DNA
ggcgcgccagtcctagctggagtaggagtgatgtttgatggggttttccacacgatgtggcatgtgacgaatggggccaccattaacgtgggggacggttgcctagtcccctattgggctagtgtaagagaggacttgatatcgtatggaggaccttggaagatgggcacgaaatggaacggggttgacgactcggaccgatg

SEQ ID NO: 8003 - DNA, 203 bp, Homo sapiens
  source 1..203: mol_type = other DNA
ggcgcgccagtccttaatggcattcttgtcggagcaggcagcttcgttagcatgatttcccaaggccagcgaatggaagaagagattccgcaagtgttcagtgaagacatgctgaggaaaagacagctaactgtgcttgacttgcacccaggctcaggaaaaacaaggaaagtgcttccccaaattgtcgactcggaccgatg

SEQ ID NO: 8004 - DNA, 203 bp, Homo sapiens
  source 1..203: mol_type = other DNA
ggcgcgccagtcctgtcacgccttctcacgccacaacgtgttcccaactacaacttgtttgtgatggatgaagcccatttcaccgaccccgcgagcatagctgcccgaggatacatctcaaccaaagtggagctaggcgaggcggcagccattttcatgacggccacccctccaggaacgcgtgaccccgactcggaccgatg

SEQ ID NO: 8005 - DNA, 203 bp, Homo sapiens
  source 1..203: mol_type = other DNA
ggcgcgccagtcctttgtggcaagagatcagccattggcgtgtctgaagtggtcaaaatgcttccagagcatttcgcacacagaatgggagaatccatggacaatctgtacatgttgaccacttctgagaaaggtagcagggctcacagggaagcgctagaggagctaccagaaacactggaaacaatcgactcggaccgatg

SEQ ID NO: 8006 - DNA, 203 bp, Homo sapiens
  source 1..203: mol_type = other DNA
ggcgcgccagtcctaaggagaacagcagcaggtgtgatgaaaaatccagtggttgatggaatcgtggcaacggacgtaccggatctagaagcaagcacaccaatcactgagaagaaatttggacaggtcatactaattgtggtagccttgtgctcagtttttctgaagcctggaacaacatcactaaccgactcggaccgatg

SEQ ID NO: 8007 - DNA, 203 bp, Homo sapiens
  source 1..203: mol_type = other DNA
ggcgcgccagtcctctccaccacatggcatcatgacacagaaaatccatacaaaacctggaactaccatggaagttatgaagttaaagcaacaggatcagccagttccatggttaatggagtcgtgaaggtgttgtcaaagccttgggatgccttgcagaacgtagtaaacatggccatgactgacaccgactcggaccgatg

SEQ ID NO: 8008 - DNA, 203 bp, Homo sapiens
  source 1..203: mol_type = other DNA
ggcgcgccagtccttagccacgcggcccttggtgcaatctttaaagaacagaacaagtgggcatcagctcgggaagcagtggaggacccagcgttttgggagttggtggatcaggaacgcgaggcgcaccttcaaggaaagtgtgagacatgcatctacaacatgatgggaaagagagaaaagaaaatcgactcggaccgatg

SEQ ID NO: 8009 - DNA, 203 bp, Homo sapiens
  source 1..203: mol_type = other DNA
ggcgcgccagtcctgaaagtgatgcggcctgggagggaaggtatcaccgtgatggatgtgatttccagggaagaccagagaggaagtggacaagtcgtcacctacgcgttgaataccttcaccaatttgtgtgtccaattgattagatgcatggaaggagaaggactgctgaagcctgaagaagttgacgactcggaccgatg

SEQ ID NO: 8010 - DNA, 203 bp, Homo sapiens
  source 1..203: mol_type = other DNA
ggcgcgccagtcctccccgagtggaaaccctcaacgggatggaggaactggcaagacgtccctttctgttcacatcatttccacgagttaaacatgaaggatggcagaaccatcgttgtcccatgcagacaccaggatgaactgataggaagggcacgattgtcaccaggatctgggtggtccctcaccgactcggaccgatg

SEQ ID NO: 8011 - DNA, 203 bp, Homo sapiens
  source 1..203: mol_type = other DNA
ggcgcgccagtccttgaaacagcatgtctgagcaaagcttatggccagatgtggctactcatgtactttcacagacgtgacctgcggctgatggccaatgccatatgttcatctgtgccagtctcatgggtgcccacgggaagaaccacctggtcaattcacggaaaaggagaatggatgacaacagacgactcggaccgatg

SEQ ID NO: 8012 - DNA, 203 bp, Homo sapiens
  source 1..203: mol_type = other DNA
ggcgcgccagtcctagatatgttgagagtctggaacagggtgtggattgaggagaacgaacacatggaagacaagacccctgtggcctcatggaacgatgtgccgtacctcggaaagcgcgaggacagttggtgtggaagtctgatagggcacagaacacgatcaacctgggcagagaacatatacaccgactcggaccgatg

SEQ ID NO: 8013 - DNA, 203 bp, Homo sapiens
  source 1..203: mol_type = other DNA
ggcgcgccagtcctctcggagagctccctggcgttggagaggataggcacccagagtcaggccacaggttttgtgccactagcatgcagtgctgcctgagcaaagacatgccccaggtggactgggtaaacaaagccgcaaggcccccgtggcccaagcaagggaatggtgtgacccttgtgtaaggacgactcggaccgatg

SEQ ID NO: 8014 - DNA, 203 bp, Homo sapiens
  source 1..203: mol_type = other DNA
ggcgcgccagtccttggaggaggagctcctccgaagaaggagagagatcgaggaggccaaaaggtctcgctccctgggacttcaagctccatcggatgggaccgtggcaaacgggtcaagggactcggcggacgaaagggactgctcggcaagctggggctgggatgggggtcttttttacagaaagacgactcggaccgatg

SEQ ID NO: 8015 - DNA, 203 bp, Homo sapiens
  source 1..203: mol_type = other DNA
ggcgcgccagtcctcatcatccaagccatcatgcacctggtcctagtcctacacgccctgttcatgtccattgaccaacgctttaaggcgctcacccggcgggtgcgcgccctcgagaatcgacgatctgccaatcccctactgctcgccactatcatctgcgcggtcgccaccttgtgtggcaccatcgactcggaccgatg

SEQ ID NO: 8016 - DNA, 203 bp, Homo sapiens
  source 1..203: mol_type = other DNA
ggcgcgccagtcctggtgatcgacatgcaagtgtcctccgctaaaggcgtgcaaatttacgaagggaaaacaaaccggactgactacttgcacttgttcaagcttccaaaagatggatgttggaacggagtgctggtttccaaacactgtcctaaggtcggcgacttggccaaggacttggaggccaccgactcggaccgatg

SEQ ID NO: 8017 - DNA, 203 bp, Homo sapiens
  source 1..203: mol_type = other DNA
ggcgcgccagtccttgactgcggatctacatggagcgaattcacactgcgatataatcgatgtgtgggaaagaagcgcgtcaagcgggctaccgaacaaccgaaagcggacctacttgcggagatggagatggtaacgttcaagaccatccgtcaaaacaagacgattttcattatcgctctgctctgcgactcggaccgatg

SEQ ID NO: 8018 - DNA, 203 bp, Homo sapiens
  source 1..203: mol_type = other DNA
ggcgcgccagtccttgacataccagtcaccttccgatttgctaagctcggaaacgcggctatgacttgtcgcttggaatcagagcaactcctgcttgattattaccacgttaccggcaacaaacgcgaaggactattcctgcggtcccaggtggacaattggcctggagtcatatcgtcttctgggggcgactcggaccgatg

SEQ ID NO: 8019 - DNA, 203 bp, Homo sapiens
  source 1..203: mol_type = other DNA
ggcgcgccagtcctgttccgcgattgccaaggattaaaatcatcggtgtttgttcagagtggctttggatacagtggggttgttatcaccacgctgttgcaaccaacgaacgagagctgctcactcaacatggtgtgtcatggatgtcagttgctatcgacgaaaatggtgtttggggctggaaaacccgactcggaccgatg

SEQ ID NO: 8020 - DNA, 203 bp, Homo sapiens
  source 1..203: mol_type = other DNA
ggcgcgccagtcctaacgtcccgtgccttcgtcggctgtgggaaccacactggttcactcttgattggcggtgcatctgtccccattgaatgtgtgatgaaccccatctctcaaggatggaggctaacccgacacgttgtggacaagtaccgacgattcggagtaccaggagttgcaggagtttggcgcgactcggaccgatg

SEQ ID NO: 8021 - DNA, 203 bp, Homo sapiens
  source 1..203: mol_type = other DNA
ggcgcgccagtcctcgatttcgttggaggcttctccctcgggaacctgataaccaactcgacgttgctcgtcctcctagcagcgctggcattcctcgacaagcgtgttgtggtgctcctgctagtctgtggatacttctactacacacgtgctgatgtgggttgtggatttgatcccgacaggaagatcgactcggaccgatg

SEQ ID NO: 8022 - DNA, 203 bp, Homo sapiens
  source 1..203: mol_type = other DNA
ggcgcgccagtcctcgtggtcgtgaaaccggttgagaaaccgagtgaagcgtgcccgacgtacctggccggttcatatgttaagaacgatgtcggagggtacactgatggcatgatgtggatgcgtagccgtaaggtgaatggctcatgggagatgttcgagcttgagacgacccaaagccaccaatgcgactcggaccgatg

SEQ ID NO: 8023 - DNA, 203 bp, Homo sapiens
  source 1..203: mol_type = other DNA
ggcgcgccagtcctcatttggccacaggagtacacatttgatctcacgactcacaacgatagtacattgtttatgccagcccattacggagcgccgatgtccaaagccaaccacatccctgggtacggaactcaacacgagttcccgtggtacaaggccgagataaaattgcggcagggaccagttcccgactcggaccgatg

SEQ ID NO: 8024 - DNA, 203 bp, Homo sapiens
  source 1..203: mol_type = other DNA
ggcgcgccagtccttgcgcattcaaagctcatcatcgagaacgagggtgttgaaatagacgagatggatcagatgttcccaaaaaccgtctctccaatccctggagctgaagctttgcttcaggatttccgggacagcctgccagtagatggatcttctcctttactggtgggcgtgcttctacacctcgactcggaccgatg

SEQ ID NO: 8025 - DNA, 203 bp, Homo sapiens
  source 1..203: mol_type = other DNA
ggcgcgccagtcctcatgaacccattgttgggtatcacgtccatgctcttctgctggtttactgaagcatacgtgtggttgccgaggttgatcttcggcacgagcaatcgccgctctggggtgaacgacgttctgctagcccctcctgtctacgcggacgagattgatgttgaaagcgactttggacacgactcggaccgatg

SEQ ID NO: 8026 - DNA, 203 bp, Homo sapiens
  source 1..203: mol_type = other DNA
ggcgcgccagtcctcataccggatggaacttacaggatagtggcccattgcacctttttcaagtatcacacaggagccggctatgccaaaggtggtgttttccacacactatggcatgtcacatcaggagcttgtgtctactgggagggcagagcggttcgtatgcactcggctgacatctaccgcgacgactcggaccgatg

SEQ ID NO: 8027 - DNA, 203 bp, Homo sapiens
  source 1..203: mol_type = other DNA
ggcgcgccagtcctaaagacgcgcaaggtcttggttgccgaagcacaggaacacatcaaacaaacaaagagattgctcatcctaacaccaacacgagttgtcaaagatgaagtcatccgagcgattggtgaagcttgtccaggcgtggtcattggctcaaatctagccatgtaccggcgaaacgcagtcgactcggaccgatg

SEQ ID NO: 8028 - DNA, 203 bp, Homo sapiens
  source 1..203: mol_type = other DNA
ggcgcgccagtcctcacggtagcatgccacgccacgctaacgcagtatgtcatggagaaaggcattgacagcatcaaattttcaaagatcataatggatgaatgccactttcttgatccgctgtcgattgcttgtcgtggaatcatggattaccataacgcgaagggagtcaacgtcacttacatgagcgactcggaccgatg

SEQ ID NO: 8029 - DNA, 203 bp, Homo sapiens
  source 1..203: mol_type = other DNA
ggcgcgccagtcctgttggagaaagtcggcatcacagaagcctcggcaatccagcggcgtggaagaactggacggcgtgaagaagggcagtacatataccccatcggggttgagcttgaacatgagcccgcgaactgggcttgctggactgaggctcagatggtgcttgaccaaatgatgtgtgggcccgactcggaccgatg

SEQ ID NO: 8030 - DNA, 203 bp, Homo sapiens
  source 1..203: mol_type = other DNA
ggcgcgccagtcctgaagctcaagatccggactgaagcaggggatcacgcgtacgcccccaggttccacgacgaccggtttgagaaatgcaacgaactggaaaagcgcacgaaattgtcaatctttctcaaacaacggagcgtcctcaattttgatgtcctcggtgtggctcatggcctgtatgtcgccgactcggaccgatg

SEQ ID NO: 8031 - DNA, 203 bp, Homo sapiens
  source 1..203: mol_type = other DNA
ggcgcgccagtcctgttgacctcaatcaacatggaaatgctcggtaacacgtttcgcgacacaatcgaaaacctgcatgtcatatcaaatgtggacgacccttacgtctctgatttcacgatggggcaatctctgaatgcttggacagcagtcctcatcggggccgccgccagtacgatcctgctgttcgactcggaccgatg

SEQ ID NO: 8032 - DNA, 203 bp, Homo sapiens
  source 1..203: mol_type = other DNA
ggcgcgccagtcctccacttcctgcgaggactgtttgccaatgaagctcaatcggcgtccgtgattggaggagttcaagtgtcggctattgcttgggagataatgattcccgtggctttttcagctttcttcgccacgacgttcgttacaaagatctacggcatcctgatcggggctatcttcttgatcgactcggaccgatg

SEQ ID NO: 8033 - DNA, 203 bp, Homo sapiens
  source 1..203: mol_type = other DNA
ggcgcgccagtcctgttctggttcatcgtacatccaaaccgtctggcaacccgctcgctggtgaagactgacacttgcggaatcgggtaccggtggaaagagatattgaattctcttgacaagaacgcgtttgatcagtacaggtcccgaggtgtcaatgaaacggataagggagactatgtttctcgcgactcggaccgatg

SEQ ID NO: 8034 - DNA, 203 bp, Homo sapiens
  source 1..203: mol_type = other DNA
ggcgcgccagtcctgttccggacaaaagggcataacctagccacattgaaagctggcgtcgacgtgtatgccgagccgccaaaagattgcaacacgatcgtctgcgacattggagaaagcgattctcgtggtgatgtggagcgaacccgcacgttgaaggtactgggcttgcttgagaagtggttggacgactcggaccgatg

SEQ ID NO: 8035 - DNA, 203 bp, Homo sapiens
  source 1..203: mol_type = other DNA
ggcgcgccagtcctgcacaacccaaatgcagcttttgcctgcaaggtcttgtctccctatcacatcgaagtgcttcgaaaactggagacgttacaacacaagtacggaggccgggtcgttcggctgtcgtatagccggaactccaccgctgaaatgtattacatctcgggcgttcgggcaaacattgtcgactcggaccgatg

SEQ ID NO: 8036 - DNA, 203 bp, Homo sapiens
  source 1..203: mol_type = other DNA
ggcgcgccagtcctaaatctgcacacctggtttgttgatcgtgaacatccttaccagtccttcaactaccacggatcattcgccactgacgacatttcccccggtgggcaaacggtgaatcctatgatgcggcgcatcatgtggccgtgggactttctcactcgtgtcaccacattcatgatgacggacgactcggaccgatg

SEQ ID NO: 8037 - DNA, 203 bp, Homo sapiens
  source 1..203: mol_type = other DNA
ggcgcgccagtcctcgtgtctacgtattcgcagcaaaagatccttagggagaaggtcgacacgctaacagtcgagccggacacacgcacgaggagcttgaaccggctaatcatgaaacatttttcacgcctgttcaagaagcgaggactacgaccccgaatcctagctccctctgactacgtcaacaacgactcggaccgatg

SEQ ID NO: 8038 - DNA, 203 bp, Homo sapiens
  source 1..203: mol_type = other DNA
ggcgcgccagtcctgtctcctaggtactctagctgggagcaagttgagttctgttcccaccatttccacgccttggtgcttagagacggacgagagattatcgctccttgccgtgaccaacatgaaatcattgggagagctcggatccagaaaggaggtgtggttgacatgtcagctgccgggtgcttcgactcggaccgatg

SEQ ID NO: 8039 - DNA, 203 bp, Homo sapiens
  source 1..203: mol_type = other DNA
ggcgcgccagtcctggccaaagctcacgctcaaatgtgggggttgtactacttccaccggcgagacctgcggctaggattcgctgcaatcgtgtcggctgttccctcgaattgggttccaacgggccgcgtctcatggtctgtgcaccagcatgctgagtggatgacaacacaagacatgctggaggtcgactcggaccgatg

SEQ ID NO: 8040 - DNA, 203 bp, Homo sapiens
  source 1..203: mol_type = other DNA
ggcgcgccagtcctatggaacaccgtttggattgtgaacaacccgtggatgaggaccaaagaccttgtcaaagcttggacggacatcccgtatttacctaagtcaaaggacatagcgtgcggcagtttgattggcgaacgtgacagagcttcgtggtccaagaacatcgtggccactgttgagacagccgactcggaccgatg

SEQ ID NO: 8041 - DNA, 203 bp, Homo sapiens
  source 1..203: mol_type = other DNA
ggcgcgccagtcctgcgctgaacaagcttggtatcttggcaactaccactggatggtttccagcccgcgcaaggaaggacacgtaaatcacgtgttcttgggagttgacgactctccgcccccagtccccaggtcagggtatgactccgtggtgttgaaaggacactaaacaagcttggcatcttggccgactcggaccgatg

SEQ ID NO: 8042 - DNA, 203 bp, Homo sapiens
  source 1..203: mol_type = other DNA
ggcgcgccagtcctagcggctagagtgaagaacctagccgttaaagtaaaaaacaaaacaaaacaaagtgcaagaggtttgcgagggttcctcttgtttctagtggcccaaattttctgggctagaaaactaaccccgcaggttaaaagattgtggagaatggtggacaaagtgcaaggtctccggatcgactcggaccgatg

SEQ ID NO: 8043 - DNA, 203 bp, Homo sapiens
  source 1..203: mol_type = other DNA
ggcgcgccagtcctcctgaagaacattaggaacatcgttaccaatctgatgaagggactggctggtcgcaagaaaaagcgaagcttgacagtacccttggtccttttgctgattccactgattgcttactcagctactgtcacccgtcaacgcggattggggcttttgctcaacgtcacttttgctgacgactcggaccgatg

SEQ ID NO: 8044 - DNA, 203 bp, Homo sapiens
  source 1..203: mol_type = other DNA
ggcgcgccagtcctcgttgggaagacctatgaggttgaggggggcaattgctctgtcaacactttggatgcgggcaaatggtgtgaagattatgtggagtatgagtgcgtcactctctctgagggtgaagagcctgacgacctggattgttggtgctacggagtggacaatgtccgtgtcacctatggcgactcggaccgatg

SEQ ID NO: 8045 - DNA, 203 bp, Homo sapiens
  source 1..203: mol_type = other DNA
ggcgcgccagtcctggtggctttagcatactttgttggcacatcaaatgtgcagagggtagttattgccatcttgcttcttggcattggaccagcttattcaacacactgcttaggaattccaaaaagggacttcataaggggacttgatggaaacacctgggtgtcagtggttttagaacagggcagcgactcggaccgatg

SEQ ID NO: 8046 - DNA, 203 bp, Homo sapiens
  source 1..203: mol_type = other DNA
ggcgcgccagtcctgggagccaagaaagatgattgggaaaatcacacaaaattggtgacttttgttccgaccacaggaacatcaactgttgcttttacaggctatggaaactttggcttagagtgtcacgttcagatgatggtggacctcagcaattcctatctggtgaaagtaggaactgatgcctgcgactcggaccgatg

SEQ ID NO: 8047 - DNA, 203 bp, Homo sapiens
  source 1..203: mol_type = other DNA
ggcgcgccagtcctgctggtcaacaaacaatgggttcacgatattactctcccatggcagagtggaacaggaggacattggagagacaagcatttcatggttgactttgaagaaccacatgcagtcactatgaaggcgttggtcctgggtagccaagaaggggctcttagaacagctctgtctggtgccgactcggaccgatg

SEQ ID NO: 8048 - DNA, 203 bp, Homo sapiens
  source 1..203: mol_type = other DNA
ggcgcgccagtcctaatggttgtggaactaaattctaatagatattcccttaaaggaggtcatgtgacgtgtaaggcgtacatgaacaatctcatcctgaaaggttcaacctactcaatgtgcaaaagagggatgtcctttgctaagcaaccagttgagacagaccatggaacagcagtgatgcagatcgactcggaccgatg

SEQ ID NO: 8049 - DNA, 203 bp, Homo sapiens
  source 1..203: mol_type = other DNA
ggcgcgccagtccttggtgctgccttccatgcaatttttggtggtctcagttggataaccaagatattgattggagggttgctcatctggctgggtctcaactctcggagtagttcaatgtcaatgggcttcatatgcattggagccttgctgcttgtgctggccacaggagttggagcagaagtgggcgactcggaccgatg

SEQ ID NO: 8050 - DNA, 203 bp, Homo sapiens
  source 1..203: mol_type = other DNA
ggcgcgccagtccttgatagagcaaagtcagtaagatcaacaacagatagtggaaagatcatacctgaatggtgctgccgcagttgcaccatgcctccagtgagtttctgggggcctgacggctgctggtattccatggaagttaggccaaaacacaccaatgaagcacatctggtgaaatcctgggtcgactcggaccgatg

SEQ ID NO: 8051 - DNA, 203 bp, Homo sapiens
  source 1..203: mol_type = other DNA
ggcgcgccagtccttggagagaccatggctgctgttgggctggttggagtgcttgctggcatgggactgaaggacatgaacggaatgcttggaccagtggccgttggtggagtgttactaattgtaatgagtctttcaggaaaggttgatgggctggtaatcaagaaagtggctgacgtgacctgggacgactcggaccgatg

SEQ ID NO: 8052 - DNA, 203 bp, Homo sapiens
  source 1..203: mol_type = other DNA
ggcgcgccagtccttgaggatgctgagattagtggagcatcacaccgttatgatgtggaacaaactgacacaggtgagttcaagttacgaaatgaagaacccgccccctggattcaggtggctgtcttgacaatagctatccttagtgcagccacacatcctgcttgtcttgccgtggtcacaattggcgactcggaccgatg

SEQ ID NO: 8053 - DNA, 203 bp, Homo sapiens
  source 1..203: mol_type = other DNA
ggcgcgccagtccttcctgtgaatgtgcaaaccacgcccagtgttttccaactgaaaaacggaaaagaaataggagccgttaatcttgactatcctagcggtacctctggctcaccaatattaaacaaaaatggagatgtcattggcctatatggaaatggaatattgattggaaataacacctacgtcgactcggaccgatg

SEQ ID NO: 8054 - DNA, 203 bp, Homo sapiens
  source 1..203: mol_type = other DNA
ggcgcgccagtcctatacggagtggaaggcaccaaaacaacaacaagtccgggagaaacacgactaagagaagaccaacggaaagtgttccgagagctggtcaagagacttgacatgccggtttggttttcatggcaggtcgcgaaggcaggtctcaaggtgcaggacagaagctggtgttttgatggcgactcggaccgatg

SEQ ID NO: 8055 - DNA, 203 bp, Homo sapiens
  source 1..203: mol_type = other DNA
ggcgcgccagtccttttgttaggcttgcaaggatttcctgaatttctgtctgggaaaatgcgggaagcgatcgacacagtaacagtcctatacactagtgacactggaagtagagcctacaaacacgcactagcaatgatgcccgaagctacaacaattttcctactggtgatgctggctatcatttgcgactcggaccgatg

SEQ ID NO: 8056 - DNA, 203 bp, Homo sapiens
  source 1..203: mol_type = other DNA
ggcgcgccagtcctactcattgagggcgacaccaatgcttattggaatggacctattgctgtagcgttttcaggattgatgagaggaaactactatgcaaccattggacttgcctacaatggatggttggccaaacagacaaggagaggcaaagcagctggagtgaccctgggggaagtttggaagagcgactcggaccgatg

SEQ ID NO: 8057 - DNA, 203 bp, Homo sapiens
  source 1..203: mol_type = other DNA
ggcgcgccagtcctgcagctgaacatgttagggaaacaagaatttgagaggtacaaagtgccagacattactgaagtggacgggaccgcagctaggcgttacctgaaagaaggacgaacagatgtgggaatcagcgtctctcgaggagcagccaaaatcagatggcttcacgagcgcggctacctcagcgactcggaccgatg

SEQ ID NO: 8058 - DNA, 203 bp, Homo sapiens
  source 1..203: mol_type = other DNA
ggcgcgccagtcctgcctagtgggaaagccatcatagaaggggacgtgtttcttcccactggaacgcgaagcgttgccagtgaagcgggcaccatagaccatgaggcgctcaagctcagagttgaccagattaaggcagagtactcaaagacttggacacatgattcaaaccacccatatcgaacatgcgactcggaccgatg

SEQ ID NO: 8059 - DNA, 203 bp, Homo sapiens
  source 1..203: mol_type = other DNA
ggcgcgccagtcctgaagagtgcaagtgaggctgtccaggatccacagttctggaaactggttgatgatgagaggaagctgcatctgcaaggccaatgccggacatgtgtgtacaacatgatggggaaacgtgaaaagaaaccctctgaatttggcaaagcaaagggaagcagggcgatctggtacatcgactcggaccgatg

SEQ ID NO: 8060 - DNA, 203 bp, Homo sapiens
  source 1..203: mol_type = other DNA
ggcgcgccagtccttatttcaagaagggatcaaagagggtccgggcaagtggtcacttatgccctgaacaccgtgactaatcttaaggttcaactcatacgcatggcggaggcagagcatgtcattacaaattttgatgttgacacagttagccagaagaccctgcaggacttgagatgctggcttgacgactcggaccgatg

SEQ ID NO: 8061 - DNA, 203 bp, Homo sapiens
  source 1..203: mol_type = other DNA
ggcgcgccagtcctgatgtatttccaccgcagagaccttagagttatggccaacgcaatcaactcgaccgttcctgtggattgggttccaactggaaggacaacatggtctattcatggaaagggagaatggatgaccactgaagacatgctgcaggtgtggaacagagtttggatagaagacaatcccgactcggaccgatg

SEQ ID NO: 8062 - DNA, 203 bp, Homo sapiens
  source 1..203: mol_type = other DNA
ggcgcgccagtcctcctttgcaaataggcagtggtgcatctcccaatgtacaaatgactctcacgcttactccaactggatctgttttcaatggcttgagacatcccaaaccagctgcccaatcaccctttcctactagaccctttcatcactcatttcagtttagttcaactgtgccagatgtgactcgactcggaccgatg

SEQ ID NO: 8063 - DNA, 203 bp, Homo sapiens
  source 1..203: mol_type = other DNA
ggcgcgccagtcctgaaccctgttatggtatgactgttgttccacccaaagacttcatgccagccccaataacagatttggtttctcttgcgaaggtgccaaccttttgcacagttaccgaaaacaagccatatttcgaggtcaacaataataaatcagatgcccccgtttttcagtctaacgtggttcgactcggaccgatg

SEQ ID NO: 8064 - DNA, 203 bp, Homo sapiens
  source 1..203: mol_type = other DNA
ggcgcgccagtcctctttctgaccctcactatgcccacaccctagttgcaggtttgggtcgttactttggaaattacagaggtagtttacaattcactttgatctcagctacaacaagcatgacccgtggaaaactgctgtgttgttacacccctccaggtgctgacaaaccaaccactgttgaacaacgactcggaccgatg

SEQ ID NO: 8065 - DNA, 203 bp, Homo sapiens
  source 1..203: mol_type = other DNA
ggcgcgccagtcctgcaatgatgtctacttatgctatatgggatttaggacttcagtccacctttgaatttgttgtgcctttcatatctactgttgactttagagtaaatgttgtctctacttcctcagccgtcaacgtagatggttggttttcaattttcaaactaaatgctctaacctacccagcacgactcggaccgatg

SEQ ID NO: 8066 - DNA, 203 bp, Homo sapiens
  source 1..203: mol_type = other DNA
ggcgcgccagtcctgttttgatgcttgcccctaatccctctttctgtggtgctgcctataccgtttttgctatgtttgaccagacaggaacaacaggtgcgaagaaaagacttttgtttggtcagggtgattatcatctttacagatcttgtcccttcacttactatactgcagatctggaagtaacacgactcggaccgatg

SEQ ID NO: 8067 - DNA, 203 bp, Homo sapiens
  source 1..203: mol_type = other DNA
ggcgcgccagtcctaaatttatggtctatattagatacaaaaatttcagaggttatgtgcccagacctttaccccgtcttgttcaaccaaacccgagttcacgcgtcaggatggctgcttcagatggtttagcccctagaaagtacttatcctatagaaaaatacagctttcaggtgatgtagaaacacgactcggaccgatg

SEQ ID NO: 8068 - DNA, 203 bp, Homo sapiens
  source 1..203: mol_type = other DNA
ggcgcgccagtccttctgatcgtggtgcagttgaaagacgcatcacttttgacattggagtaacccccggttcagcagcaacccgaaacggtaagctggaccttgctatcgccctgaagccagatggacccggtgaatttccttacaactgtgactgtcagcttttacacacaactggacttgcacttcgactcggaccgatg

SEQ ID NO: 8069 - DNA, 203 bp, Homo sapiens
  source 1..203: mol_type = other DNA
ggcgcgccagtccttacggcttgacagatgttgcagccgttaagataagcaatggcccggagtggaaaaacctttcaaaactctttctgaaccttgaaactgaactcttgcccggaacgaggattacggttttgtctaacgacaacatcaacatgttaagagaaggttcttttcttcgttatgaagaacgactcggaccgatg

SEQ ID NO: 8070 - DNA, 203 bp, Homo sapiens
  source 1..203: mol_type = other DNA
ggcgcgccagtcctagactaaacccaggtgttgattttgattcagtcattttctctaaacacgtgaataacgtggtaattgataaagacacttcaatttggcagtctttgaagctcgctgcccaggtttatgctcaaaggttaaagaatattgacaaagagcctcttacagttgaagaggcaattgctcgactcggaccgatg

SEQ ID NO: 8071 - DNA, 203 bp, Homo sapiens
  source 1..203: mol_type = other DNA
ggcgcgccagtcctggaattcctggacttgaccgcttggaccccaaaactgcttcaggtttgccctacaaaaagacaaggaaacagatgattgactttcaaaaatgtgagatcactgatgaccaacttaagtgtagacttggaatgtggcttgcaggcagaaaaccagaaactctttatcaaacatttcgactcggaccgatg

SEQ ID NO: 8072 - DNA, 203 bp, Homo sapiens
  source 1..203: mol_type = other DNA
ggcgcgccagtcctgttgaatcggttcattgctatgaggacaagcgcatcaccatacgtggtgggctgccttcaggcactgctggaacttcaataatcaacactatcattaataacataatcttgcacgctgctttctattatacctactctaactttgaatgggatgatttacagatgcttgcttatcgactcggaccgatg

SEQ ID NO: 8073 - DNA, 203 bp, Homo sapiens
  source 1..203: mol_type = other DNA
ggcgcgccagtccttgggctccagttatggaaatttcaaatttacaggctatgctttcttggtataaacctggaacactgaatgaaaaactggaaagtgtgtcccgcctcgcccacttttgtggagaggaggaatacaatgaattgttcaagccgtttgttgaggacggctttgacataaagccctggcgactcggaccgatg

SEQ ID NO: 8074 - DNA, 203 bp, Homo sapiens
  source 1..203: mol_type = other DNA
ggcgcgccagtcctgcggagacttaggcctcacagattgtgttttgtgttattggatgctggatggtcacgttggagactgcatgtggcagtcttgaaacgtgtggtttgacgtctatccattatggcagtgggtggagtactgcaaagatgtcaccgtgctttacacggtttttgaaccccacaccgcgactcggaccgatg

SEQ ID NO: 8075 - DNA, 203 bp, Homo sapiens
  source 1..203: mol_type = other DNA
ggcgcgccagtcctaggagacctgaggaatttccatgtggctttgccaggagttgtagcgatgctgtgtgtgtgtgcggatttcccctcatggcaacatgagcctcacaggccaaaagccctgtccgaaaggacccacacagtggagcaaccccagctccctcctacaaagctttgtgagaatgaactcgactcggaccgatg

SEQ ID NO: 8076 - DNA, 203 bp, Homo sapiens
  source 1..203: mol_type = other DNA
ggcgcgccagtcctattgttaataacttttattcaaaccagtattatgcttctattgatgcttctgcccaaggtgttgggacctctactactcctgaaaacggcaacgtatctggctttcttggacttgcaggtagtgcttttaatgctctctctcttctcgcctcaccacgaaccgagacaggaatgcgactcggaccgatg

SEQ ID NO: 8077 - DNA, 203 bp, Homo sapiens
  source 1..203: mol_type = other DNA
ggcgcgccagtcctacaccagaacaatttatgattttccctcaccaacttataaatcctaaagacacaaatgttgccacagtacgtgtgccgtacattaatattgctccaacaaatgatactacagtacatacagtatggacagctgttgttatggttcttgtacctcttaacttttcttctggtgctcgactcggaccgatg

SEQ ID NO: 8078 - DNA, 203 bp, Homo sapiens
  source 1..203: mol_type = other DNA
ggcgcgccagtcctgttgattacatgcccttacccattacagatttagttgagcttgctaaagtgcccagttttgttactgtggcaaacagtgacacgactagcgagcgtagtttcccttatttctctgttagtaacacagaacaaggcagaaatcttttcaaatccagtgtagttctcagcgacttacgactcggaccgatg

SEQ ID NO: 8079 - DNA, 203 bp, Homo sapiens
  source 1..203: mol_type = other DNA
ggcgcgccagtcctacttatgctatctgggatttgggattacaatcaaccttcaattttgtagtcccttttatatctgcttctgacttcagatttaacacctcttctgtatctaatgctttgaactctgatggttggatcacagtgtggcttatgaaccctctaacatatcctcccagtacacctcctcgactcggaccgatg

SEQ ID NO: 8080 - DNA, 203 bp, Homo sapiens
  source 1..203: mol_type = other DNA
ggcgcgccagtccttccctttctccctgtgcgtcagtgtgtggccagcctatctcttccttcctgtttgctcaacgagcgaatcccaagaaaactctaaagctgcgctcaggtgatgaattcttgtatagatgttgccctttttcttacattaaatgtgaccttgagtttactgtggtcccccctgcgcgactcggaccgatg

SEQ ID NO: 8081 - DNA, 203 bp, Homo sapiens
  source 1..203: mol_type = other DNA
ggcgcgccagtccttctcccagacattgcaaggcaataaatgactacaacagaggtgactcctttcagagaccgaccaactcttttgaattcatggacagacttgtggaatgtgctaccaagcttgggaaagtccaaattgcaacttatttcagaaattttactacagctgattctgatacaagcagacgactcggaccgatg

SEQ ID NO: 8082 - DNA, 203 bp, Homo sapiens
  source 1..203: mol_type = other DNA
ggcgcgccagtcctccagagccagttgttgttgttttgcgcgggaaaccaggcgtaggcaaatctgctgcagctactgttatggcagctgcagtatctaaattgttggtaggaagtcaatcagtgtacaccctttccccagatacggaacatatggatggatatcacggacagtttgtgactttgatgcgactcggaccgatg

SEQ ID NO: 8083 - DNA, 203 bp, Homo sapiens
  source 1..203: mol_type = other DNA
ggcgcgccagtcctgatgaccttggacaaaacccagacggagaagacttcagatgtttctgtcaaatggtttcttgtgctcagtacagacctgctatggctgaccttaaagacaaaggaatcctgtttacatccagactgttgattgctactactaatctcccagattttaaccctgttactatctctcgactcggaccgatg

SEQ ID NO: 8084 - DNA, 203 bp, Homo sapiens
  source 1..203: mol_type = other DNA
ggcgcgccagtcctagatttgaggatgaggtaccgactaatgtaggtaacatgccctttgtaatgctttacaaatcaacctcttattttggaatgtgtggctcagttgtatgtagcagatttgttgatggtggaggaataattggaatgcactgcgcaggtggaggcggagtcagtgttggaactcgtcgactcggaccgatg

SEQ ID NO: 8085 - DNA, 203 bp, Homo sapiens
  source 1..203: mol_type = other DNA
ggcgcgccagtcctcggtatgatccgcgattaaatgagggagtcaacttggatgaggtgatcttctcaaaacatactcaaaacactcttgttgagaaaggatccactttcagaagcgcccttgacatggcagcagaaatttatggtgaaaagtttagaggaaatgatttctctcccctttcagttgaacgactcggaccgatg

SEQ ID NO: 8086 - DNA, 203 bp, Homo sapiens
  source 1..203: mol_type = other DNA
ggcgcgccagtcctcattaccagacatttcttaaggatgaaatcaggcccattgaaaaggtcaaagcaggaaagactagaataattgatgttcctcctcttgatcatgtcatcgcttttagaatgctctttggcagattcattgcccactaccacttaaactttggcttcaaaacaggctctgctattcgactcggaccgatg

SEQ ID NO: 8087 - DNA, 203 bp, Homo sapiens
  source 1..203: mol_type = other DNA
ggcgcgccagtcctggttgtgacccagatgtcgcttgggcttcttttggctttgaactcagtggctttccttatctgtatgattttgattactcaaactttgatgcttctcacagtacttcaatatttgaaatcttagaacagaaattcttttccccagaattaggttttgatcctagatgctcacttcgactcggaccgatg

SEQ ID NO: 8088 - DNA, 203 bp, Homo sapiens
  source 1..203: mol_type = other DNA
ggcgcgccagtcctctcttgaaatcccttgcagtttcaacccactgttatgagaacaagagactccagattgctggaggacttccctctggcacggcaggtacctcagtactgaacaccgtgataaacaacattatctttcacggtgcactataccacacttacactaattttgagcgggatgacatccgactcggaccgatg

SEQ ID NO: 8089 - DNA, 203 bp, Homo sapiens
  source 1..203: mol_type = other DNA
ggcgcgccagtcctaaagttgctggagtttgggctccagtgatggaaactgaaaacctcgaggcaatgttgtcttggtacaaaccaggaactcttaatgaaaagctccagagtgtctcaagacttgcccacttctcaggacgtgacgtgtatgaccaccttttcaagcccttcattcgtgatgggtttcgactcggaccgatg

SEQ ID NO: 8090 - DNA, 203 bp, Homo sapiens
  source 1..203: mol_type = other DNA
ggcgcgccagtcctctggcaaataacctaggggactaggttttcctttttattttaaagttgtcaatatgggtgcaaataacagcaaagaatctgtgaacagctctggcaataatggcacaactgttaataacttttatgctaataattattatggctctattgatgcttctgcccagggagttgggacgactcggaccgatg

SEQ ID NO: 8091 - DNA, 203 bp, Homo sapiens
  source 1..203: mol_type = other DNA
ggcgcgccagtcctcctcttctactcccgaaaacggtactgtatctggttttcttggaatggcaagttctgcttttaatgcactttccttattggcttccccaaaggtagaaaactctttatacactgaagacagacttttgacacggaaagctggcaacacatctgtaaattcgcaggctgcagaagcgactcggaccgatg

SEQ ID NO: 8092 - DNA, 203 bp, Homo sapiens
  source 1..203: mol_type = other DNA
ggcgcgccagtccttcatgacacagaagctcagtttgtatcaacctccggctgaggaaattgcccactcacactattctactcagacaataacaccaaacaaaaatgtatcttttgatctagccgacatgactgcagagcaaatgatgttgtttcctcatcaactcatcaaccccaaagatacaaatgcgactcggaccgatg

SEQ ID NO: 8093 - DNA, 203 bp, Homo sapiens
  source 1..203: mol_type = other DNA
ggcgcgccagtccttgcaccacgcttcttctacggctcaaagccctatcccaaccagacctttccaccactctttccagttcagctcaactgttccagatgtcactgagccttgttatggaatgactgttaatcctcccaaagattacatgcctgaaccagtgggtgatttggtttccttagcgaaagcgactcggaccgatg

SEQ ID NO: 8094 - DNA, 203 bp, Homo sapiens
  source 1..203: mol_type = other DNA
ggcgcgccagtccttaggaagtctagttactgtgtcttaccctagcaactcagatcaaccttactttgagatttcaaacaccaaaaaggacactcctcttttcaagtgcaatgttctactttctgaccctcactttcagcacactttggtgtctaatttaggtaagtactttgcaaactatagaggatcgactcggaccgatg

SEQ ID NO: 8095 - DNA, 203 bp, Homo sapiens
  source 1..203: mol_type = other DNA
ggcgcgccagtcctctttacagttttcttttatttcagctactactggcatgactaagggcaagttgcttctttcctacaccccaccaggaagtggtgcaccaaccactttggagcaagcaatgaatggcacgtactcaatttgggacattggtttacaatccaccttcaactttgttgtgccctacacgactcggaccgatg

SEQ ID NO: 8096 - DNA, 203 bp, Homo sapiens
  source 1..203: mol_type = other DNA
ggcgcgccagtccttatcagctgtggactttagattgtgtgctgcctctgctagctccgtggtaaacacggatggatggtttacagtgtggttgttgaactctcttacttaccctccaggaacccctccaacccagaatgtagtggtcatgttatcagcaggtgaagacttttcctacagaaaccccacgactcggaccgatg

SEQ ID NO: 8097 - DNA, 203 bp, Homo sapiens
  source 1..203: mol_type = other DNA
ggcgcgccagtccttaagtccagcttggacccaaagcccaggttctaccccgcatgacaatgcggagaaaggtaccattgagaattgtgatgcatccttgaacagtggacatagtgtttctctgccaactcctcactctaatgttagatttttctttgatagatacagatttttggggttgttagaaacgactcggaccgatg

SEQ ID NO: 8098 - DNA, 203 bp, Homo sapiens
  source 1..203: mol_type = other DNA
ggcgcgccagtcctctgtcacggttcacttagccacggaagcttctactgagtctagtacaaccactgttacatctagtctttcatcttcaggtagtttgtttacacttaatcctacattttatggcaaaaatggctttccagtctctttcatgatacctttctgtagtcctctcaccctcctccctccgactcggaccgatg

SEQ ID NO: 8099 - DNA, 203 bp, Homo sapiens
  source 1..203: mol_type = other DNA
ggcgcgccagtcctagaaagatagcaaagatgttgagggaccatacaatggacctgacaagaaatcactcaaggttttgaaattaaaggctcagagtcctatgttagatctggaaaagaaagttttcaaaaatgtgttgccttttggacttgtatataatggaaaaacctatcaacaatcttgcttggcgactcggaccgatg

SEQ ID NO: 8100 - DNA, 203 bp, Homo sapiens
  source 1..203: mol_type = other DNA
ggcgcgccagtcctttgtctctactgaggaaggaaccagagtgcacgtaccgcgtgtcagcaagctgaaaagaactcatgcctcataccctgcaacctctaaatatggacctgctgctttgacccgcaatgaccctcggctcaaccctggtgtggatctcgatgaaatgattttctccaaacacaaagcgactcggaccgatg

SEQ ID NO: 8101 - DNA, 203 bp, Homo sapiens
  source 1..203: mol_type = other DNA
ggcgcgccagtcctactttgactattcaaactttgatgcaagtcattccacttccatatttgaaatcttggaagaggaattctttaccccagaaaatggttttgatgtgagatgctctctactgctaaaatctttatcctgttctactcactgttgtgaaaacaaacggcttaccataataagtggttcgactcggaccgatg

SEQ ID NO: 8102 - DNA, 203 bp, Homo sapiens
  source 1..203: mol_type = other DNA
ggcgcgccagtcctgaggagttattcgaaccgtttgtcaagaacggtttcgaaatactgccatggaaacagcttcacttggagtggctcaataaatttggctattaattgttgaactggttaatattctttatcaattggtttaatttggtttaatttggcatttattgggtgtattcaaattttatacgactcggaccgatg

SEQ ID NO: 8103 - DNA, 203 bp, Homo sapiens
  source 1..203: mol_type = other DNA
ggcgcgccagtcctctacgcgggcggagtgatactcccgctccttcttggacaggcggcctccacgctctttgtggatcttaaggctgccaagtcactggtgtttgaagtgaagaatggagagacactagggcgtttcatgtggctttgccagggattgtagcgatgctgtgtgtgtgtgcggatttccgactcggaccgatg

SEQ ID NO: 8104 - DNA, 203 bp, Homo sapiens
  source 1..203: mol_type = other DNA
ggcgcgccagtcctttaaaaactcagctaccattactgacaagcagctcgcactaccagggtttaggtctttcaacaggtcaagggacaatatctgaaaagggttctattgatgctgctggtacaattcctcaacaactcttcatatatccacaccagttgattaacccaaaagacacaaacatagcccgactcggaccgatg

SEQ ID NO: 8105 - DNA, 203 bp, Homo sapiens
  source 1..203: mol_type = other DNA
ggcgcgccagtcctcaccctgctcctaatgtacaaacagcaatacctgttagaatgacacaaaattctggacagttttccacaactcttcctgctagaatggaaccatgttatggcttaactcccaaccccaccagagactttcttcccccagtagtcgaagatttactcagcatagcaaaagtccctcgactcggaccgatg

SEQ ID NO: 8106 - DNA, 203 bp, Homo sapiens
  source 1..203: mol_type = other DNA
ggcgcgccagtcctgatggttatcctgactattcaaggactgttggtgcatacggtgtggcccctgcaaaccactttggcactttgactgtagctgctaatgatgaaggttacaaattctttgtttatgttagatacaaaaacttcaaagggtatgtccccaagaccctacctccacaaccactgtttcgactcggaccgatg

SEQ ID NO: 8107 - DNA, 203 bp, Homo sapiens
  source 1..203: mol_type = other DNA
ggcgcgccagtcctccttctgcttacttagctgcttccgctgtgctcattgcggacggcatttctttccttgactggtatgaaaaaataaaaagatttcttggttctcgttttcgagttccacctcctatcttcactcttgcccaaggaccagatcttagagacttagttactttctttaatgctgctcgactcggaccgatg

SEQ ID NO: 8108 - DNA, 203 bp, Homo sapiens
  source 1..203: mol_type = other DNA
ggcgcgccagtcctatcaagagcaaaaggactacaagcggaatgcttgaaggactggtggtgcagtcgcccaaaattgtaggctacaccaaggacgacgagggcgtcgtcattgttgactgtctcgaggattggcacagaattcgagacaagaaaagaaagcaacaggctcttgagatggttgcagagcgactcggaccgatg

SEQ ID NO: 8109 - DNA, 203 bp, Homo sapiens
  source 1..203: mol_type = other DNA
ggcgcgccagtcctgagatgcaaattcaacatgacaaacattctcagaccatttccttgataaaacagtttctctcagggctcggtgtggtggctgctgttggagccgcctttgccgcaggcaaggtactgaaaaacatgatgacctcagaccgggcacaggatgaaccagactctgaatcccaggagcgactcggaccgatg

SEQ ID NO: 8110 - DNA, 203 bp, Homo sapiens
  source 1..203: mol_type = other DNA
ggcgcgccagtcctctctttgttggaaaaagggttttccttgtgaacaaacatgcaattgactcagttgaacaaaaatttcaagttgcaggaaaaacatatgacttggatgatgttgatgtggcaattcttgacacggaatatggacttacggatgttgcagctgtcaagctcaacacaggcccagaacgactcggaccgatg

SEQ ID NO: 8111 - DNA, 203 bp, Homo sapiens
  source 1..203: mol_type = other DNA
ggcgcgccagtccttggaaaaacctttcaaaactctttgtttcactggacacgactctacacccaggaaccaggataacgattttgtctaacgaccaacttaacatggtgagagagggtagttttctcagaaatgaggatgacatacccaccaatattggcccaataccttttgtcatgctttataagcgactcggaccgatg

SEQ ID NO: 8112 - DNA, 203 bp, Homo sapiens
  source 1..203: mol_type = other DNA
ggcgcgccagtcctgcttcctcttactttggtatgtgtggttctgctgttgtgaccagaattggtgattgtcccggaattcttggtctccattgtgctggcggtgggggtgtgtgtgtggcttccagagttacaaaaagaatggtagaaactgtcctaaaatacttttatccacctcaggtacagggacgactcggaccgatg

SEQ ID NO: 8113 - DNA, 203 bp, Homo sapiens
  source 1..203: mol_type = other DNA
ggcgcgccagtccttatgactttgattactcaaactttgatgcttctcattcagagtccatctttgaacttcttaaacagtttgttttcaccaaagacaatggttttgatcacagatgctctctcatgattgattctctggttacctcgacccactgctatgagcaacaaagaatgaccattcgcggccgactcggaccgatg

SEQ ID NO: 8114 - DNA, 203 bp, Homo sapiens
  source 1..203: mol_type = other DNA
ggcgcgccagtccttaccccacccaaggggggagaaagaggtgatagtgggcatacgcgatttaccaaggaaaggtgattgcaggacaggcaatcgcctggggccggtgagtggcttgttcataaagccggggcctattttctatcaggattaccctggtccagtatatcacagagccccccttgagccgactcggaccgatg

SEQ ID NO: 8115 - DNA, 203 bp, Homo sapiens
  source 1..203: mol_type = other DNA
ggcgcgccagtcctgttgtaggctacagaggcatgaatggaacaaacatggctggtgtaattggtataacatagagccttggatatggttgatgaataagacccaagccaacctaaccgaaggcacaccccctaaagaatgtgcagtgacctgcagatatgacaaggatcaggagatcaatgttgtaacgactcggaccgatg

SEQ ID NO: 8116 - DNA, 203 bp, Homo sapiens
  source 1..203: mol_type = other DNA
ggcgcgccagtcctcgcaggccagagacagacccacaaccctgaccgggtgtaagaagggtaagaaattctctttcgcaggtgaagtagtcgatggcccttgcaatttcaacatatctgctgaagacatgctttacgatgaaatagggtgtgcaggcgttttccaggaaatggctcaacacatagttgcgactcggaccgatg

SEQ ID NO: 8117 - DNA, 203 bp, Homo sapiens
  source 1..203: mol_type = other DNA
ggcgcgccagtcctggtatactaacaactgtacccctgcctgcttgcctatgaatactaggattgtgggaccaggcaagtttgataccaacggggacgatggaaaaatcttacacgagatgggtggccacctatctgagctggccatattggcacttgtggtaatgtcagacttcgcacccgaatcagcgactcggaccgatg

SEQ ID NO: 8118 - DNA, 203 bp, Homo sapiens
  source 1..203: mol_type = other DNA
ggcgcgccagtcctcccacaagaacctggacttagccggaatattcctcagtaacgcaccaatcgtgttaatggtgctaaccctgtgggcagatctactgaccctcatcctagtcctaccaacctatgaattaacaaaattgtactacatcagaagggtgaaaaaggatgtagagaggagttggctagcgactcggaccgatg

SEQ ID NO: 8119 - DNA, 203 bp, Homo sapiens
  source 1..203: mol_type = other DNA
ggcgcgccagtcctggaacttggtaatgaaacacaagatcagaaatgaaactattagggcgtggtatgaggaagaagaaatttacggaatgccaaaaatcatcacattgatcaaagctgcctcgctaagtcagagtaaacactgtatcctatgcactgtatgtgagagacgtgattggaagggtggcacgactcggaccgatg

SEQ ID NO: 8120 - DNA, 203 bp, Homo sapiens
  source 1..203: mol_type = other DNA
ggcgcgccagtcctgttgccctaagtgcggtcgttccggcaggcccatatcatgcggaatgactctggctgactttgaagaaaaacattataagaagatcttcataagagagggagaattggacggaccttttaggcaggaagccagaggttatttacagtacatagcaagggggcagcttttcctaacgactcggaccgatg

SEQ ID NO: 8121 - DNA, 203 bp, Homo sapiens
  source 1..203: mol_type = other DNA
ggcgcgccagtcctggaacttaccaatactggcaaccaaagtaaagctattaatggtggggaacctgggatccgaagtaggcgacctcgaacatcttggctgggttttgaggggacctgcggtgtgcaaaaagatcgtatcccacgagaagtgccatactgggatagccgacaaattgacagctttctcgactcggaccgatg

SEQ ID NO: 8122 - DNA, 203 bp, Homo sapiens
  source 1..203: mol_type = other DNA
ggcgcgccagtcctttggaatcatgcccagagggactactcctagagcgccggtcaggttccctacatcactaataaagatcaggagagggttagagacaggatgggcttatacacaccaaggagggataagttcagtagaccatgtaacagcagggaaagacctgttggtctgtgactctatgggcacgactcggaccgatg

SEQ ID NO: 8123 - DNA, 203 bp, Homo sapiens
  source 1..203: mol_type = other DNA
ggcgcgccagtcctttacttgtgtgactgcctcaggtacaccagctttctttgatctgaagaacttaaaaggctggtctgggctgcccatatttgaagcatccagcggcagggttgttggaagagtcaaagttgggaagaatgaggagtctaaacccactaagctcatgagtggaatacaaacagtgtcgactcggaccgatg

SEQ ID NO: 8124 - DNA, 203 bp, Homo sapiens
  source 1..203: mol_type = other DNA
ggcgcgccagtcctctgcggcagagtcagtataccaatacatgaaacaaaagcatcccagtattgccttcaacctcagaataggggagatgaaagaaggagacatggctactgggataacatatgcctcatatgggtacttctgccaaatgccccaaccaaaattgagagcagcgatggtggaatactcgactcggaccgatg

SEQ ID NO: 8125 - DNA, 203 bp, Homo sapiens
  source 1..203: mol_type = other DNA
ggcgcgccagtccttgatgaagggggaagacctgggatcaaacttcctggatatagctggacttaagataccaacagaagagatgaagggaaatatgttggtgttcgtacccactaggaatatggctgtggaggtggcaaagaagttgaaggctaagggttacaactcaggctattattatagtggagcgactcggaccgatg

SEQ ID NO: 8126 - DNA, 203 bp, Homo sapiens
  source 1..203: mol_type = other DNA
ggcgcgccagtccttaaagaggatggcagtgactgcaggtgagcaggcacagaggcggggtagagtaggacgggtaaaacctggcaggttctacaggagtcaggaagctgcatccggttcgaaagactaccactacgacttgctgcaagctcaacgctacggaatagaagatggcataaacataacaacgactcggaccgatg

SEQ ID NO: 8127 - DNA, 203 bp, Homo sapiens
  source 1..203: mol_type = other DNA
ggcgcgccagtcctagtcctttagggaaatgaattacgattggagcctctatgaggaagacagcttgttaataacccaattggaagtcctcaacaatctcctgatatcagatgacctcccggctgcagtgaagaacattatggccaggactgaccacccagaacccatacagctagcttataatagctcgactcggaccgatg

SEQ ID NO: 8128 - DNA, 203 bp, Homo sapiens
  source 1..203: mol_type = other DNA
ggcgcgccagtcctaccctggtagtcaacagaccagcgagacaggaaaagccctaaaacaggtatcaggtttatccacagctgaaaacgccctcctagtagccctgttttcatacgtgggctaccaagcgttgtctaagaggcacatacccgtggtcacagacatatacaccatagaagaccaaagaccgactcggaccgatg

SEQ ID NO: 8129 - DNA, 203 bp, Homo sapiens
  source 1..203: mol_type = other DNA
ggcgcgccagtcctgtgatggcttaatggggacaggcttgagtgcagccatggaaatgatgtcccaaaacccagtctcggtgggaatagctgtgatgctgggggtgggagctgtagcagcccataatgcaattgaatcaagtgaacaaaagaggacactattaatgaaagtgtttgtaaaaaatttttcgactcggaccgatg

SEQ ID NO: 8130 - DNA, 203 bp, Homo sapiens
  source 1..203: mol_type = other DNA
ggcgcgccagtcctatggaaacctaagagtgaccaggtactatgataaagatggtgcagagttgaaaccggtaattaaactggaaaaacaggctgagctgtactacaaaggggccacactaagagtagactttagcaacggaaagagtgtaactgcaactgacaagtgggaggtggaccatgcaacgacgactcggaccgatg

SEQ ID NO: 8131 - DNA, 203 bp, Homo sapiens
  source 1..203: mol_type = other DNA
ggcgcgccagtcctacttgaagagactaattgaactagtccacaagaacaaattggaggaaaaggcaataccccaagctacagtaacaacctggctagcatacacctttgtcaacgaggatgttggaacgataaggccatcttttggggaaagagtgttgcctgaaagcccgggtgacccgagtttgccgactcggaccgatg

SEQ ID NO: 8132 - DNA, 203 bp, Homo sapiens
  source 1..203: mol_type = other DNA
ggcgcgccagtcctgcagctggatctaccaaaacacagtaaaggagaatgatttgagacccttatttgaggaactgttactgcagtgcccccctggtggtagacaaaccaaaggacatgtagcatctgcataccaactagcacaagggaactgggagcctataagttgcaatgtaaatatgggtacaacgactcggaccgatg

SEQ ID NO: 8133 - DNA, 203 bp, Homo sapiens
  source 1..203: mol_type = other DNA
ggcgcgccagtccttaccagcaagaagggtcaaaacacatccttatgaagcatacttgaaattaaaagatcttttaaatgagcataagatgagggtggaaactggctgtgctgacttaaaagaccataataggtggatactaaggaaagtgaagcaccaagggaacttaagaacgaggtacatcttaacgactcggaccgatg

SEQ ID NO: 8134 - DNA, 203 bp, Homo sapiens
  source 1..203: mol_type = other DNA
ggcgcgccagtcctatgctaaagtcagattggcaatcaccaaagtgatgtacaaatgggtcaagcaaaaacctgtggtgataccggggtacgaaggaaaaaccccactttttcaaatcttcgataaagtaaagaaggagtgggatggcttcaacgacccggtagcagtgagttttgacacaaaggcttcgactcggaccgatg

SEQ ID NO: 8135 - DNA, 203 bp, Homo sapiens
  source 1..203: mol_type = other DNA
ggcgcgccagtcctaaggagcgcagatattgtatgaatctggcaaaccacagaaaatactagaaggagaccaaatgaaggtggcttacagatttgaagacatagagttttgttcccacacaccaatccccgttagatggtcagacaatagtagtggttacatggccggcaggaacaccgccacggtaccgactcggaccgatg

SEQ ID NO: 8136 - DNA, 203 bp, Homo sapiens
  source 1..203: mol_type = other DNA
ggcgcgccagtcctttgcaaaaatggccactaggctagactcaagtggggagaggggcactgccgcatatgagaaggcagtggcattcagcttcctcctaatgtattcctggaaccctttaattaggaggatatgtctgttgaccttatcgtcaaaaccagaggtagacccctctaaacaagccacttcgactcggaccgatg

SEQ ID NO: 8137 - DNA, 203 bp, Homo sapiens
  source 1..203: mol_type = other DNA
ggcgcgccagtcctggaaggaagaaggtaactggcttgtcaatgccgaccggctagtttctagcaagactggcaaaatgtatatccccgatgaagggcacaccttgcaaggcaagtattatgaagaactgagactaactaggccagggggacccactataagggtgggaatagacagataccgtcttgcgactcggaccgatg

SEQ ID NO: 8138 - DNA, 203 bp, Homo sapiens
  source 1..203: mol_type = other DNA
ggcgcgccagtcctctgaccctggaaacggaagacggtactgctattgattctatcaattataaacttccggctgacgcttgcctcgtaggacttccgattgagaaacactgcccgctcgtgagcaagctcgccgacctggacaacattgactgtggctcaacgactgaagagtttaggctgaaataccgactcggaccgatg

SEQ ID NO: 8139 - DNA, 203 bp, Homo sapiens
  source 1..203: mol_type = other DNA
ggcgcgccagtcctaatagatgtcaagtcacgcccagaaagcgtaggagctctcaaccacggccggcttcgcacactggcctaatcgaagaagttgagctcttgaccttcaaatttatgcgtgagcacatgcctattttcgtcgtttgccttctcgttgtctccgttgctcggaaatggcccatgtggcgactcggaccgatg

SEQ ID NO: 8140 - DNA, 203 bp, Homo sapiens
  source 1..203: mol_type = other DNA
ggcgcgccagtcctgaatggggactaggacaagttgccacgtgcgttgaagtccaatgcctgaccatggtaaatgtatctgtgctcgttgactcagttattcaggccactgccagtatggaactccatgggcaccaagactcaagagccgtgttgcgtgatgttcccacggtatttcatttcggggaccgactcggaccgatg

SEQ ID NO: 8141 - DNA, 203 bp, Homo sapiens
  source 1..203: mol_type = other DNA
ggcgcgccagtcctggccacgtagaactcgcggacagtgtcgtccctgttgactgtctcgtcacaccggtagcccaggcttggaggcttatgactcatgtggccggtcgatactcaaaacatggcatggctggtatcggaagcgtctgggaggacctggtgcggaactttcacttttcgtggagttggcgactcggaccgatg

SEQ ID NO: 8142 - DNA, 203 bp, Homo sapiens
  source 1..203: mol_type = other DNA
ggcgcgccagtcctggagccttcgtgtggaagcagcttggcagtggcccaatgaaagatcactccgttgagctcgacgactatgctttcaccaacttgtacattcgcgacatgttcgatggtacaaacaaaccttgtttgatatgcgaggacacattgcagtgcgccgccctgagacgagccgcagtccgactcggaccgatg

SEQ ID NO: 8143 - DNA, 203 bp, Homo sapiens
  source 1..203: mol_type = other DNA
ggcgcgccagtcctgccgcaagaattgctatgcatccaggggtgatgtatgtgaacaccactctatcgtacaacagaacttttgttgaaacgcgaaaacgggttttgacagtgacgctggaatctttggagtataaagtaggatcctacgtcacacatggtcgtcttgagggggacatgggatatctgcgactcggaccgatg

SEQ ID NO: 8144 - DNA, 203 bp, Homo sapiens
  source 1..203: mol_type = other DNA
ggcgcgccagtcctgcccgcacacgagcgacgacgtggtcacggttgattcttacaactgtcgcgatgcttacttttggcctacccaacattttttcctcggtgggcttgtcggcatgggtgttgttagttgcgtcatcggcatatcaacctatcgacgtcgtcatgaacctctggataatcctccagcgactcggaccgatg

SEQ ID NO: 8145 - DNA, 203 bp, Homo sapiens
  source 1..203: mol_type = other DNA
ggcgcgccagtcctattggggcctatcgtgggatgactcaggaccttccaccagagatcctcacgttttgcttgataatgggatggaaaacggcattggcgctaggtaccgttgccttactgacgcaaggtacgagcgctttttacaagtggacgcagaaatcactagagtccaaaagctcctacaggcgactcggaccgatg

SEQ ID NO: 8146 - DNA, 203 bp, Homo sapiens
  source 1..203: mol_type = other DNA
ggcgcgccagtcctacgggggacgtgcctgacgggatcgcccttgaagaagatgaagggggaaacttccgtgaccttcgaggaacatatagcgatgaggggatcactattggccaagacatggggtctgcccagatcccagagaccatggtcatcatattgattggttgtgccctcacgtctgcttctcgactcggaccgatg

SEQ ID NO: 8147 - DNA, 203 bp, Homo sapiens
  source 1..203: mol_type = other DNA
ggcgcgccagtcctatctatcgaattaatgtacgtagcttcatggaaaaccgacagcgtggagtaggtgtggcaaaaaacggagttttccacacgttaatgcatgtcactcgtggagagcccctcaaatggcgagaaaagctagtgtccttacattcgggaagtgctttacgagatgtagtgtcgtatcgactcggaccgatg

SEQ ID NO: 8148 - DNA, 203 bp, Homo sapiens
  source 1..203: mol_type = other DNA
ggcgcgccagtcctatcgtttcggaagtcaaagcaaattttgacgcggggttgaggaccataatcctgacacccactcgggttgtcatggctgaagttatggaagccctcgggcaagccggaataacgtgtgaccggaaccttatgtattgtcgcagaaatttggtgacagttgcctgtcacgccacgcgactcggaccgatg

SEQ ID NO: 8149 - DNA, 203 bp, Homo sapiens
  source 1..203: mol_type = other DNA
ggcgcgccagtcctttcacaaaatttgtgttgtcgcatggcgtaaagaaaattggggtggcgctcattgtcatggatgagtgtcacttcatggatcccatgtcaatagctgcccggggagtaatggagcatctacatgagaagggaacgaaactcatgtatttgagtgccaccccccctggacactcccgactcggaccgatg

SEQ ID NO: 8150 - DNA, 203 bp, Homo sapiens
  source 1..203: mol_type = other DNA
ggcgcgccagtcctccccttcatcgcgcaaacttcacagctaattacgctcgggctagtagcgacgaaacctctctggttgtttccactgacatttcggaaatgggggccaatttgggtgttgatatggttatcgacacccgcaaggttctccggcccctcgtagcatccgagaatagaatcaagttgcgactcggaccgatg

SEQ ID NO: 8151 - DNA, 203 bp, Homo sapiens
  source 1..203: mol_type = other DNA
ggcgcgccagtcctcccgaagaggccatgtacagccaaccccctgggcgctataccttagttggggaagacctgctccgctttatgaagttcctggacaaagacgatattcctacctggctcgcttggcattgggcagaggcggccgaccgcagacattctgccctcttccagggtaatagcactggccgactcggaccgatg

SEQ ID NO: 8152 - DNA, 203 bp, Homo sapiens
  source 1..203: mol_type = other DNA
ggcgcgccagtcctaatccccggtcgcacatccacgacgtaatggatttcggatcaatgctgtcggccattggattgattgacatgaacttcctgttttataagtttttgcatattgccatgcgagccctcggagctatggcccctttcagtaaatttcgcgccctagaaaagtccaccacgataggtcgactcggaccgatg

SEQ ID NO: 8153 - DNA, 203 bp, Homo sapiens
  source 1..203: mol_type = other DNA
ggcgcgccagtcctcttggctgtggacgtggcggctggagccaaagagtggttatggaggagacagtgacgtccgttcatgggttcacaattggtggcaatgacaaggaaaacccccagcgatttgtcacacgtggatataatttgaccagcctcaagcccggggtggacgtctacaaactggagccacgactcggaccgatg

SEQ ID NO: 8154 - DNA, 203 bp, Homo sapiens
  source 1..203: mol_type = other DNA
ggcgcgccagtcctaagcgatgtgacacaatcatgtgtgacatcggtgaaagtgacccaaatctcaccaaagagcggacaagaacactaaaagtcttacagctattggagacttggttatctatcaaccctgaggcccaatttgtatgcaaggtcctatccccctactcccttgaggtgttgcggaagcgactcggaccgatg

SEQ ID NO: 8155 - DNA, 203 bp, Homo sapiens
  source 1..203: mol_type = other DNA
ggcgcgccagtcctgttgaatccctccagcaaaagtacaaaggtaagctcgtgcgcttggcacacagtaggaatagcacggctgaaatgtattacatatcaggaaataggtccaacgccgtaagggacgcttatatgaccctggctgctttaataggaagattttcgcgacacattgacagtgtattccgactcggaccgatg

SEQ ID NO: 8156 - DNA, 203 bp, Homo sapiens
  source 1..203: mol_type = other DNA
ggcgcgccagtcctctcccggagccaacactaccgcgaggaaccagagctgatccagcagctagcgtgtctgccatgaatgttgatgacatggttgatcgtgtcagaaaggtccaacaggaaaacagcgcgacatggttcattgacccggaacacccgtataaaagctttagatattttgggtcttttcgactcggaccgatg

SEQ ID NO: 8157 - DNA, 203 bp, Homo sapiens
  source 1..203: mol_type = other DNA
ggcgcgccagtcctctggaatttgaggccttggggttcctaaatgctgatcactgggtcagtcgtgaaaactttcctgggggtgtgggtggagtgggtgtcaattactttggcaactacctaaaggaaatttcgctcaaaggcaagtatctctttgctgacgatatagcagggtgggatacgaaggtgcgactcggaccgatg

SEQ ID NO: 8158 - DNA, 203 bp, Homo sapiens
  source 1..203: mol_type = other DNA
ggcgcgccagtcctagttctgaagaccttgaggatgaagagactctcttaaccgaactgactgcaaaccccttccaccgcgccctaatcgccgccacaatgaagttggcttaccggaacatagtggcgatgtttccccgcacccacacgcgatacggtagcggcaccgttatggatgtcgtcgggcgccgactcggaccgatg

SEQ ID NO: 8159 - DNA, 203 bp, Homo sapiens
  source 1..203: mol_type = other DNA
ggcgcgccagtcctgcgggagatgatgttgtagtgtcgacaatgaatcggtcatttgcctcttccttagactacttggagctgacgggaaagacccgtaaaaacgttccacgaggtgccccttcaaaaatggaaagcgactggcaaaaagtcgaattttgctcacatcactaccacgaactttccctccgactcggaccgatg

SEQ ID NO: 8160 - DNA, 203 bp, Homo sapiens
  source 1..203: mol_type = other DNA
ggcgcgccagtcctgccgctatcacctccgccgtcccttccaactggtttccagtcgggcgaacatcctggtcagtacatcaatttcacgaatggatgacgacatccgacatgctccgcgtttggaacgatgtgtggatatacaataacccgtggatcagagtgaaggacccaattggctcatgggatcgactcggaccgatg

SEQ ID NO: 8161 - DNA, 203 bp, Homo sapiens
  source 1..203: mol_type = other DNA
ggcgcgccagtccttatggcaggcgggcttgtggacggcttcggcccacccacagcaagaatgccatcatctgtcctcacccccaattttcccttttcttcccctgcaaccattacgcttactcgcatgtgcattgagtggtgcatgtgttgaacaaacagctacactcacatgggggcgggttttcccgactcggaccgatg

SEQ ID NO: 8162 - DNA, 203 bp, Homo sapiens
  source 1..203: mol_type = other DNA
ggcgcgccagtccttcttctgttcacgatggagggctctaacggattctcgagttcgttggctggcctttcttcatcgcgctcttctctacgcctcctcactcattttctctccctccccaccttacccgttaacatctatctcaatgctcgccgtcactccggctggtatcgctccccccccaccttcgactcggaccgatg

SEQ ID NO: 8163 - DNA, 203 bp, Homo sapiens
  source 1..203: mol_type = other DNA
ggcgcgccagtcctacccgttaacatctatctcaatgaacaatttgacaatctctgcctggcggctttgcgctatccgggccacaaattgtatccctctgtccacactctgttccctgatgtttcacccctcaagattccccactctgtccccgcctttgctcacctcgtccagcgacaggggctgcgcgactcggaccgatg

SEQ ID NO: 8164 - DNA, 203 bp, Homo sapiens
  source 1..203: mol_type = other DNA
ggcgcgccagtcctgcggcaaggaaactccatcaccaacatctacggcaatggcaacgacgtcaccacagacgtcggcgccaatgggatgtccctccccattgccgtaggtgacatgcctaccgcctctacctctgaagcccctcttggttccaacaaaggtggctcttccacttccccaaaatccaccgactcggaccgatg

SEQ ID NO: 8165 - DNA, 203 bp, Homo sapiens
  source 1..203: mol_type = other DNA
ggcgcgccagtcctctctcaaaccacagctcttcttgctcttcccggcaacatcgccggtggtgccccctctgcaacagttaatgccaacaacacttccatctcttcccaagctcttttaccctctgttaatccttacccttccacccctgctgtctcactccccaatcccgacgctcccactcaggtcgactcggaccgatg

SEQ ID NO: 8166 - DNA, 203 bp, Homo sapiens
  source 1..203: mol_type = other DNA
ggcgcgccagtccttggccccgccgccgaccgccagtggctcgtcgacaccctctcttggtctgagacgatcgcaccccttactgtcttctctggacccaaggctctcacccctggcgtctacccccccactattgaacccaacactggtgtctatcctctaccagctgcactctgtgtttcccatcccgactcggaccgatg

SEQ ID NO: 8167 - DNA, 203 bp, Homo sapiens
  source 1..203: mol_type = other DNA
ggcgcgccagtccttgaatctgtcttttccactgcctacaatgctcacgcctacttcaactgtggcttcgatgtcacagtcgtcgtgaacgcttcccagttccacggcggctcgctgatcgtcttggccatggctgaaggtctgggcgacatcaccccagctgattcttccacttggttcaacttccccgactcggaccgatg

SEQ ID NO: 8168 - DNA, 203 bp, Homo sapiens
  source 1..203: mol_type = other DNA
ggcgcgccagtcctcgacgttcgccttccccagtgccccgcccttggtttccaatcgggagccgatggtgcagaagtccaacctgcccccaccagcgacctctctgatggtaaccccaccaccgaccctgcccctcgtgacaactttgactacccccaccaccctgttgatccttccactgacctagccgactcggaccgatg

SEQ ID NO: 8169 - DNA, 203 bp, Homo sapiens
  source 1..203: mol_type = other DNA
ggcgcgccagtcctcaatgtctctgccccttcccaaccctgcactttctacgtcttctatgcccccccgggtgcatctgtcccttctgtgcagactctcgcagaactctctttcttcacccacactgccactcctctcaacctggcagcaccaaccaacatcactgtctccatcccttactcctcccccgactcggaccgatg

SEQ ID NO: 8170 - DNA, 203 bp, Homo sapiens
  source 1..203: mol_type = other DNA
ggcgcgccagtcctccagtctgttctctgtacgtcctttggaggtttcggcctccaaaacggcggagatgcaggtaacctccactccaacacatggggtactctcatcctctatgttgatctcccccaatctgacagtgtctctgtttctgcttacatctccttccgtgactttgaagcgtacgtccccgactcggaccgatg

SEQ ID NO: 8171 - DNA, 203 bp, Homo sapiens
  source 1..203: mol_type = other DNA
ggcgcgccagtcctccgccagactcctggcgttggccctgtgcccacgagcacctccatcgttcgtgtcgctcggcccacccccaaaccccgcacggctcgccgccaaggcggcaccctcgcggacctcatcctctcccccgaaagccgatgcttcattgtcgcccacactactgcccccttctactccgactcggaccgatg

SEQ ID NO: 8172 - DNA, 203 bp, Homo sapiens
  source 1..203: mol_type = other DNA
ggcgcgccagtcctcatccttctggtcaaccccgacgaggagtatgccatcagcatgttctctcatggcgacgagtcaatcctccagtactcgtcgcgctctggcactcgcctcacccccactgccccagccttcttcctctgtgctgctgcatctgttgacacagtcctcccctactccatctctcacgactcggaccgatg

SEQ ID NO: 8173 - DNA, 203 bp, Homo sapiens
  source 1..203: mol_type = other DNA
ggcgcgccagtcctatcacacctttggcttaccgatctgactggcattcctctccgcgcagtccccccccttactctcttcctctccgcgggagccgccctgtgtgccggcgcacaaacgctgatagccgtcgcacagggtggttctaccccggaaaccccacccactcccaaccgcgctctcctccgcgactcggaccgatg

SEQ ID NO: 8174 - DNA, 203 bp, Homo sapiens
  source 1..203: mol_type = other DNA
ggcgcgccagtccttcgtcagggccttggcgatctcccggatgcggcgaaaggactttccgccgcgctcgagagtgttgccagggtcgctggcgatgccaacattgccacctcctcccaagccattgctacctccattaactctctttccaactccattgatggtgctacttctttcatgcaaaacttcgactcggaccgatg

SEQ ID NO: 8175 - DNA, 203 bp, Homo sapiens
  source 1..203: mol_type = other DNA
ggcgcgccagtcctgcacattcgcctgaatgtgacggcacgtgacggtgtggccttctcagcggcggctgctctccaaccctccaaccccccttctgcaactcgctattgcaaatttgctaaccctctcactcagttttctatgtttaatctggctgtcgattacaaatcagttgtccttcccaacaccgactcggaccgatg

SEQ ID NO: 8176 - DNA, 203 bp, Homo sapiens
  source 1..203: mol_type = other DNA
ggcgcgccagtcctccctctcacctgctttgatgaactggttgactttgttctgagctcccttcgcgaccgggcttcggtgaactcgctcctctctggcatggtgcgcactgacgtcacacgccaaggtgggaacgctgatgcccccgctccttctgcagctcctctcccctctgttatcccatctgtcgactcggaccgatg

SEQ ID NO: 8177 - DNA, 203 bp, Homo sapiens
  source 1..203: mol_type = other DNA
ggcgcgccagtcctcccatcccaggaccccttcacccgtgcggttaacgagaaccgccctgtctctttcctctccaagatctggtcgtggcgagctcccatcttcgccgcctcctctttcctttctctcatcgctgcaactctcaccattgtccgttgtctccgtgacctgcggtccactcagggtgccgactcggaccgatg

SEQ ID NO: 8178 - DNA, 203 bp, Homo sapiens
  source 1..203: mol_type = other DNA
ggcgcgccagtcctatacagtgggactcctgttccgaaaccacggaaaaaggatctcccaaaacaacctgtgtactctgggcctgtccgccggcagggtttcgaccccgccgtcatgaagatcatgggcaatgtggactcttttgtcaccctctcgggtactaaacccatctggactatgtcctgcctcgactcggaccgatg

SEQ ID NO: 8179 - DNA, 203 bp, Homo sapiens
  source 1..203: mol_type = other DNA
ggcgcgccagtcctcggttcgccgatgattgccactgatcctggcggcttgggtatcctcggtatccacgtcgctggggtggctggctacaacggcttctccgcacgcctcacccccgagcgtgtccaagctttcctttcccacctggctacaccccaatctgtcctctactttcacccacccatgggcgactcggaccgatg

SEQ ID NO: 8180 - DNA, 203 bp, Homo sapiens
  source 1..203: mol_type = other DNA
ggcgcgccagtcctcccgcctgcgcacgtctctcgtcgcagccggctccatcccatccctcccgcctttggtgctttccccatcaccaaagaaccagcagccctttctaggaaggaccctcgcctccccgagggcaccgacctggatgccatcaccctcgccaagcacgacaagggcgacatcgcgaccgactcggaccgatg

SEQ ID NO: 8181 - DNA, 203 bp, Homo sapiens
  source 1..203: mol_type = other DNA
ggcgcgccagtcctgccctggccttgcatggaggaggcggctgactggtacttctcccagcttcctgataacctccctgtcctctcccaggaagatgccattcgtggtctcgaccacatggatgccatcgacctctcccaatctcctggctacccttggacgacacagggccggtcccgccggtccctcgactcggaccgatg

SEQ ID NO: 8182 - DNA, 203 bp, Homo sapiens
  source 1..203: mol_type = other DNA
ggcgcgccagtcctgttcgacgaggatggcaaccctctccctgagctccaggaagccatcgattccgtctgggacggtggctcctacatctatcaatctttcctcaaggatgagttgcgccccacggcaaaagccagagctggaaaaacccggattgtggaggcggctccgatacaagcaattgtagtcgactcggaccgatg

SEQ ID NO: 8183 - DNA, 203 bp, Homo sapiens
  source 1..203: mol_type = other DNA
ggcgcgccagtccttggacgtcgcctccttggttctctcatcaaccacctccagggtaaccctctccagcatggcagtgccgttgggtgcaatcctgacatccactggactcaaatcttccactcactcacctctttctctaatgtctggtctattgattactcttgctttgatgccactatcccctccgactcggaccgatg

SEQ ID NO: 8184 - DNA, 203 bp, Homo sapiens
  source 1..203: mol_type = other DNA
ggcgcgccagtccttgctgacaaggcttctgactttcctgactcttcttccatctttgacatcactttccttaaacgctattttgtccctgatgatatccacccccacctcatccatcctgtgatggatgagcaaaccctcaccaactcaatcatgtggttgcgtggcggggagtttgaggaggtgttcgactcggaccgatg

SEQ ID NO: 8185 - DNA, 203 bp, Homo sapiens
  source 1..203: mol_type = other DNA
ggcgcgccagtcctgcggtcactcgagactcttgcctttcactcgggaccgaagaactactcggcttggtgtgagaaaatcaaggctaagattcgagagaacggctgtgacgccactttcactccctactccgtcctccaacgtggttgggtttccacctgcatgactggaccctaccccctcaccggcgactcggaccgatg

SEQ ID NO: 8186 - DNA, 203 bp, Homo sapiens
  source 1..203: mol_type = other DNA
ggcgcgccagtccttttcgaccgccttatggcaggcgggcttgtggacggcttcggcccacccacagcaagaatgccatcatctgtcctcacccccatttctcccctccttcccctgcaaccattacgcttactcgcatgtgcattgagtggtgcacgtgttgaacaaacagctacactcacgtggggcgactcggaccgatg

SEQ ID NO: 8187 - DNA, 203 bp, Homo sapiens
  source 1..203: mol_type = other DNA
ggcgcgccagtcctgcgggttttcccgcccttcggcctctcgcgaggcccacccttccccttcctcccataactacagtgctttggtaggtaagcatcctgatcccccgcggaagctgctcgcgtggcaactgtggggacccagacaggttatcaaaggcacccggtctttccgcctccaggagtatccgactcggaccgatg

SEQ ID NO: 8188 - DNA, 203 bp, Homo sapiens
  source 1..203: mol_type = other DNA
ggcgcgccagtcctcgtagtcgtcttccggcttgtccggcgcatgtttggtgaaccggtggggtaaggttggtgtgcccaacgcccgtactttggtgacaactcaagaccacccaggaatgccagggaggtaccccgcctcacggcgggatctgaccctgggctaattgtctacggtggttcttcttgcgactcggaccgatg

SEQ ID NO: 8189 - DNA, 203 bp, Homo sapiens
  source 1..203: mol_type = other DNA
ggcgcgccagtcctcttccatttctttcttctgttcatgatggagggctctaacggattttcgagttcgttggctggcctttcctcatcacgctcttcacttcgcctcctcactcatcttctttccctcccccccccgaatcgcgacgcccgccgccactctggctggtaccgctccccccccaccctcgactcggaccgatg

SEQ ID NO: 8190 - DNA, 203 bp, Homo sapiens
  source 1..203: mol_type = other DNA
ggcgcgccagtcctccccgtcaatgtctacctcaatgaacaatttgacaatctttgcctggcggctttgcgctacccaggctgcaaattatacccctctgtttacactctatttccagatgtctcacccttcaagatcccccaatccatccccgcctttgcccaccttgtccagcgacaggggttgcgcgactcggaccgatg

SEQ ID NO: 8191 - DNA, 203 bp, Homo sapiens
  source 1..203: mol_type = other DNA
ggcgcgccagtcctatccaacggcaacgttgttcgcggatcccgctactccaagtggtgggagcccgcggccgcacgcgccttggatcgtgctcttgaccatgctgttgacgcgactgacgcagttgctggcgccgcctccaagggcatcaaggctggagccaccaagctctccaacaagcttgctggcgactcggaccgatg

SEQ ID NO: 8192 - DNA, 203 bp, Homo sapiens
  source 1..203: mol_type = other DNA
ggcgcgccagtcctccacgcaatcatcaatctggctaattctaattctgctaccctcaaacttccttacattggagtcactccaaacacctccactgaaggacttcacaactattggaccattctctttgcccctctgactcctcttgctgtcccgaccggctcccccacctctgtcaaagtctccctcgactcggaccgatg

SEQ ID NO: 8193 - DNA, 203 bp, Homo sapiens
  source 1..203: mol_type = other DNA
ggcgcgccagtcctccaatggcgtggctctctacagatctctctcatcttcactggtcctgctcagtgctacggccgccttcttcttgcttacacccctccctccgccaatcctcccaccaccatcgaggaagccaacaacggcacctacgatgtctgggatgtgaatggcgactccacctacactttcgactcggaccgatg

SEQ ID NO: 8194 - DNA, 203 bp, Homo sapiens
  source 1..203: mol_type = other DNA
ggcgcgccagtccttgacgtccgcctcccacagtgtcctgcccttggcttccagtcgggagctgatggcgcagaagtccaacctgcccccaccagtgacctctctgatggtaaccccaccactgaccccgctcctcgtgacaactttgactaccctcaccaccctgttgatccttccactgacctagccgactcggaccgatg

SEQ ID NO: 8195 - DNA, 203 bp, Homo sapiens
  source 1..203: mol_type = other DNA
ggcgcgccagtcctcaacgtctctgctcctcttcaagcttgcaccttctacatcttttatgcccctcccggtgcatctgtcccttctacgcagacccttgcagaactctctttcttcactcatactgccacccctctcaacttagctgctccaactaacatcactgtctctatcccttatgcctctcccgactcggaccgatg

SEQ ID NO: 8196 - DNA, 203 bp, Homo sapiens
  source 1..203: mol_type = other DNA
ggcgcgccagtccttcggcaaacccctggtgtcggtcccatccccacgagcacctccatcgttcgtgtcgcccggcccactcccaaaccccgcagggtccgccgtcaaggtggtactcttgcagacctcatccttacccccgagagtcgttgcttcattgttgcacatactactgccccctactactccgactcggaccgatg

SEQ ID NO: 8197 - DNA, 203 bp, Homo sapiens
  source 1..203: mol_type = other DNA
ggcgcgccagtcctcttctctggccttgccccgaagaaccccacctctcctctccaacacctctttgccaagctcatcaaatgggtgaccaaaatcatcggttcactcatcatcatctgcaacaaccccaccccctcagcactcattggtgtttccctcatgctctgcggtgacctcgccgaggacatcgactcggaccgatg

SEQ ID NO: 8198 - DNA, 203 bp, Homo sapiens
  source 1..203: mol_type = other DNA
ggcgcgccagtcctcgagaagattatgtcccacatcaagaatcttctcgagtggcttggggtcctcgtcaaagatgaccccaggaccaaactcaactcgcagcatgagaaaattctggaactctacactgactctgttactgcttcttcaactcccccctctgagctttctgcggacgccattgggtccgactcggaccgatg

SEQ ID NO: 8199 - DNA, 203 bp, Homo sapiens
  source 1..203: mol_type = other DNA
ggcgcgccagtcctcaacctggacctggccaagcaacttctcactctctcgcatgctgccaactctgtcacccacatccagttgtgcacacgcgctatcaccaactactctacagctctctctgccatctcccttgtcggtacacctggcacgcggccagagccactggtcgtgtacctgtacggacccgactcggaccgatg

SEQ ID NO: 8200 - DNA, 203 bp, Homo sapiens
  source 1..203: mol_type = other DNA
ggcgcgccagtcctccctgggactggcaaatccctcctcgcttctctcctcgcttctactcttgctcaggccctctctggtgaccccaacaattactactcaccttcttcccctgactgcaaattctacgatggttactctggccagcctgtccactacatcgacgacatcgggcaagaccccgatggcgactcggaccgatg

SEQ ID NO: 8201 - DNA, 203 bp, Homo sapiens
  source 1..203: mol_type = other DNA
ggcgcgccagtcctcccactctcctgcttcgatgaactgattgactttatcttgggctctcttcgcgatcgggcctcggtgaactcccttctctctggcatggtgcgcaccgacgtagcacgccagggcgggaacgctgacgcccccgctccctctgcagctcctctcccctctgtcctcccctctgtcgactcggaccgatg

SEQ ID NO: 8202 - DNA, 203 bp, Homo sapiens
  source 1..203: mol_type = other DNA
ggcgcgccagtccttccttcccaggaccctttcgtccgtgcggtgaacgagaaccgcccggtctctttcctctccaagatctggtcgtggcgtgctcctatcttcgccgcctcctctttcctttccctcattgctgcaaccctcaccattgtccgctgtctccgtgacctgcggtccacccagggtgccgactcggaccgatg

SEQ ID NO: 8203 - DNA, 203 bp, Homo sapiens
  source 1..203: mol_type = other DNA
ggcgcgccagtcctctggccttgcatggaagaggcggctgactggtacttctcccagctccctgacagcctcccagtcctctctcaggaagatgccattcgtggtctcgaccacatggatgccatcgacctctctcagtctcctggctatccttggacaacacagggccggtcccgccggtctctgttcgactcggaccgatg

SEQ ID NO: 8204 - DNA, 203 bp, Homo sapiens
  source 1..203: mol_type = other DNA
ggcgcgccagtcctgcgtcgtcttcttggttctctcatcaaccacctccagggtaaccctctccagtatggcagcgccgttggatgcaaccctgacatccactggactcaaatcttccactctctcactcccttctctaatgtctggtctattgattactcttgctttgacgccaccatcccctctgtcgactcggaccgatg

SEQ ID NO: 8205 - DNA, 203 bp, Homo sapiens
  source 1..203: mol_type = other DNA
ggcgcgccagtcctaagtcctaaaaacccttaacttggtcatactactcaactcagcaaaatgggagctcaggtatcaacacaaaagactggtgcgcatgagacgggtctaaatgcgagcggcaattcggttatacattacactaacatcaatttttacaaagactctgcatcaaactccctgaacagcgactcggaccgatg

SEQ ID NO: 8206 - DNA, 203 bp, Homo sapiens
  source 1..203: mol_type = other DNA
ggcgcgccagtcctactattcggacagaacatgctgtaccattatttaggtagaacgggctacactgttcacgttcaatgcaacgcctcaaagttccaccaagggtgtctcctggtagtgtgcgtgcccgaagccgaaatggggtgtgccacagttgataggacggttactgaggagtatttatcaaacgactcggaccgatg

SEQ ID NO: 8207 - DNA, 203 bp, Homo sapiens
  source 1..203: mol_type = other DNA
ggcgcgccagtcctggtgctatgtacaccggggagtaaccaattcctgacatcagatgactttcaatccccctctgcaatgccgcagttcgacgcaaccccccaaatgcacataccaggacaagtgagaaatctaatggaaatcgctgaggtggattcagtagtgccagtgaataacttatcacgctacgactcggaccgatg

SEQ ID NO: 8208 - DNA, 203 bp, Homo sapiens
  source 1..203: mol_type = other DNA
ggcgcgccagtccttcgcttcgtccacgacgatgtgtataccagtgcagggtacattactgcttggtaccaaaccaccatagttgtccccccaaaaactccgacagattgcaagctgatgtgtttcgtgtcggcctgcaatgacttctcggtgcgtatgttgagagacacccctcacatagaacaggacgactcggaccgatg

SEQ ID NO: 8209 - DNA, 203 bp, Homo sapiens
  source 1..203: mol_type = other DNA
ggcgcgccagtcctgcacacacacggtgccttcggccagcagtccggtgctgtgtatgtcggtaactatagagtggtaaatagacacttggccacgcataatgattggcaaaattgcgtgtgggaagactacaacagagaccttctcgtgagcacaacgactgcccatggttgtgataccattgccagcgactcggaccgatg

SEQ ID NO: 8210 - DNA, 203 bp, Homo sapiens
  source 1..203: mol_type = other DNA
ggcgcgccagtcctatgtgagcaagtcaacctgctcaaggagacgctggttggtcaagactccattctagagaaatccctcaaagccctggtcaaaattatatcagccttggttatagttgtaaggaatcacgacgacctcgtaacagtgacagccaccctagcactcattgggtgctctgcatcgcccgactcggaccgatg

SEQ ID NO: 8211 - DNA, 203 bp, Homo sapiens
  source 1..203: mol_type = other DNA
ggcgcgccagtccttgacgagtgctgtcctgtcaatttcaagaagtgctgcccactagtgtgtggtaaagccatccagtttatcgacagaagaacacaaatgaggtattcgttggacatgcttgtgaccgagatgttcagagaatacaaccacagacatagtgtgggggcgacacttgaggcactcttcgactcggaccgatg

SEQ ID NO: 8212 - DNA, 203 bp, Homo sapiens
  source 1..203: mol_type = other DNA
ggcgcgccagtcctagactacggcttcctcaatctgggtggaacacccaccaagcgcatgctaatgtacaacttccccacgcgtgcagggcagtgtggtggtgtcctgatgtcaacgggtaaagtccttgggatacacgtcggcggaaatgggcaccagggtttttcagcagccctgttacgccattacgactcggaccgatg

SEQ ID NO: 8213 - DNA, 203 bp, Homo sapiens
  source 1..203: mol_type = other DNA
ggcgcgccagtccttttaaccacaagtgcaggttatccttatgttgcccttggtatcaagaagagagatattttatctaagaagaccaaggatctgacaaagctgaaggagtgtatggacaagtatgggctgaatctccctatggtcacatatgttaaggatgagctgagatcggcagaaaaggtggccgactcggaccgatg

SEQ ID NO: 8214 - DNA, 203 bp, Homo sapiens
  source 1..203: mol_type = other DNA
ggcgcgccagtccttaaaggtaagtccaggttaattgaggcatcaagtctaaatgattcagtagctatgaggcaaaccttcgggaacttgtacaaaacattccatctgaacccaggtatagtgacaggcagcgcagttggttgtgatcccgacttgttttggagtaaaatcccagtcatgcttgacggcgactcggaccgatg

SEQ ID NO: 8215 - DNA, 203 bp, Homo sapiens
  source 1..203: mol_type = other DNA
ggcgcgccagtcctaattaggtggaccaaagaccccaaaaacacccaggatcatgtgcgatccttatgcctattggcttggcataatggggagcaagaatatgaagagtttgtgtccaaaatcaggagcgttccagtgggacgctgcctgaccctgccagcgttctcaactttgcgcaggaggtggctcgactcggaccgatg

SEQ ID NO: 8216 - DNA, 203 bp, Homo sapiens
  source 1..203: mol_type = other DNA
ggcgcgccagtcctaaggtcttagaaactctcaactttattttgacactcaatacagcaaaatgggagctcaagtatcaacgcagaagactggggcacatgagactagcttgaacgccaacgggagttcggtcattcactacaccaacatcaactactacaaggatgcagcctcaaattcagcaaacacgactcggaccgatg

SEQ ID NO: 8217 - DNA, 203 bp, Homo sapiens
  source 1..203: mol_type = other DNA
ggcgcgccagtccttggtaggttacggtgtgtggccagagtacttgtctgacaaggaggcgacagcggaggatcaaccaacacaaccagatgttgcaacatgcagattctacaccttagattcagtgcagtgggaaaagaactctgcaggatggtggtggaaattccctgaggctttaagtgatatggcgactcggaccgatg

SEQ ID NO: 8218 - DNA, 203 bp, Homo sapiens
  source 1..203: mol_type = other DNA
ggcgcgccagtcctgcctattcggtcaaaatatgatgtaccattacttaggacgggcaggttacacgattcacgtgcaatgcaatgcttcaaagttccatcaagggtgtttgcttgtggtctgcgttcctgaggcggagatgggtggtgctaaagtcggacaggcattcgaggcagatgcactagccacgactcggaccgatg

SEQ ID NO: 8219 - DNA, 203 bp, Homo sapiens
  source 1..203: mol_type = other DNA
ggcgcgccagtcctcactgaacacacctggcagtagtcagttcctgacgtctgatgacttccagtccccttgtgcactaccgcaatttgatgtcacaccacccatgaaaattcccggtgaagtccacaatttaatggagatagcagaggttgactcggtcgtgccggtaaacaacgttaacggcactacgactcggaccgatg

SEQ ID NO: 8220 - DNA, 203 bp, Homo sapiens
  source 1..203: mol_type = other DNA
ggcgcgccagtcctctgaccaaatggacatgttcagaatcccagtgacaatagggaacaagacccaagatcaagtatttggagtgagattgcagcctggactagacagtgtcttcaaacacacactacttggagagatcctgaattattatgctcattggtccgggagcataaaactaacattcatgtcgactcggaccgatg

SEQ ID NO: 8221 - DNA, 203 bp, Homo sapiens
  source 1..203: mol_type = other DNA
ggcgcgccagtccttctgcggatccgcgatggcaactggcaagttccttattgcgtactcccctccgggtgcggacccaccgactaacagaaaaggggccatgctgggcaaaaatatagtatgggacatcggactgcaatccagttgcgtactgtgtatgccgtggatcagccaaactcattatagaccgactcggaccgatg

SEQ ID NO: 8222 - DNA, 203 bp, Homo sapiens
  source 1..203: mol_type = other DNA
ggcgcgccagtccttactgcaaggtgacgtagaggaagcagtgagaaaagccattgtccacgtggctgacaccatacgcagtggcccaagtaactccgaaagtgtgccagccctgacggcagctgagaccggacacacctcgcaggtgactcctagtgacaacatacaaactaggcatgttaagaactcgactcggaccgatg

SEQ ID NO: 8223 - DNA, 203 bp, Homo sapiens
  source 1..203: mol_type = other DNA
ggcgcgccagtcctaccactccagatcagaatcatccatagaaaatttcctggggagatcggcatgtgtgtacatgaaggactataagaacaaagataatgacatgacaaacaaatacgtcgcatggacaatcaacacaagacagatggtacaaatgaggcgtaagttggagatgttcacgtatgtgccgactcggaccgatg

SEQ ID NO: 8224 - DNA, 203 bp, Homo sapiens
  source 1..203: mol_type = other DNA
ggcgcgccagtcctctccaatcactagcacaatacgtgtttatttcaagcctaaacacgtaagggtatggatcccgcgagcacctaggctatgtccctacgagaaagcagggagcgtggactttaaaccgactgcaattacctcaaccagagcaaccatcaacactgttcacagcaccactcgacccacgactcggaccgatg

SEQ ID NO: 8225 - DNA, 203 bp, Homo sapiens
  source 1..203: mol_type = other DNA
ggcgcgccagtccttgcacacatatgggccgtttggtcaacaatcaggtgcagtgtatgtgggcaattacagagtggtcaacaggcacctggcaacccattctgattggcaaaattgcgtgtgggaggattccaacagggacctcttggttagtacaacaacggcgcacggctgtgacaccattgccacgactcggaccgatg

SEQ ID NO: 8226 - DNA, 203 bp, Homo sapiens
  source 1..203: mol_type = other DNA
ggcgcgccagtcctggtgccaatgcactacaggggtgtacttttgtgcttcaaaaaacaagcactatccagtcgtttttgagggaccgggacttgtagaagtccaggagagtgagtactaccccagaagataccagtcccatgtactcctcgcagcaggcttttccgagcccggggattgtggtggaacgactcggaccgatg

SEQ ID NO: 8227 - DNA, 203 bp, Homo sapiens
  source 1..203: mol_type = other DNA
ggcgcgccagtccttcttgaggtgcgaacatggagtcatcggcatcgtgaccatgggtggtgaaggtgttgttggtttcgctgatgtaagggaccttttgtggttagaggatgatgccatggagcaaggggttagagattatgttgagcaacttggcaacgcctttggttcgggcttcaccaatcaaacgactcggaccgatg

SEQ ID NO: 8228 - DNA, 203 bp, Homo sapiens
  source 1..203: mol_type = other DNA
ggcgcgccagtccttttgtgaacaggttaacctattgaaagagtcattggttggtcaagactccatcctggaaaagtcacttaaagctttggtgaaaatcatatcagcactggtcatcgtagtaagaaaccatgatgatctcatcacagtaaccgcaaccctagctctgattggttgcaccacctctccgactcggaccgatg

SEQ ID NO: 8229 - DNA, 203 bp, Homo sapiens
  source 1..203: mol_type = other DNA
ggcgcgccagtcctcagaggtgagagaaaaacacgaattcttaaacaggctgaaacaactgcccctgttggaaagccagattgccaccattgaacaaagcgccccttcacagagtgatcaagagcaactgttctccaatgtgcagtacttcgcacactactgtaggaagtacgcccccctgtatgctgcgactcggaccgatg

SEQ ID NO: 8230 - DNA, 203 bp, Homo sapiens
  source 1..203: mol_type = other DNA
ggcgcgccagtcctttcaaggtccaccagtatacaaagagatcaaaattagcgtggcaccagaaacccccccccccccggccatagcagacctgttgaagtcagtagacagtgaggcggttagagagtactgcaaggaaaagggatggttggtacctgagattcactccaccctgcaaattgaaaagccgactcggaccgatg

SEQ ID NO: 8231 - DNA, 203 bp, Homo sapiens
  source 1..203: mol_type = other DNA
ggcgcgccagtcctacttcaatgatgaacagggtgaaatcgagtttatcgagagctccaaggaggctggtttcccagttattaacacccccagcaaaacaaagcttgaacccagtgtattccatcacgtatttgagggaaataaggagccagcagtgttgaggaatggggaccccagattgaaggccacgactcggaccgatg

SEQ ID NO: 8232 - DNA, 203 bp, Homo sapiens
  source 1..203: mol_type = other DNA
ggcgcgccagtcctactttgaggaagccatcttttctaaatacattggaaatgtgaacacgaacgtggatgagtacatgatggaagccgttgaccattatgctggacagttggcaactttggacatcagcacagaaccaatgaagctcgaggacgccgtctatggcactgaaggtctggaagcactggcgactcggaccgatg

SEQ ID NO: 8233 - DNA, 203 bp, Homo sapiens
  source 1..203: mol_type = other DNA
ggcgcgccagtcctatctctctactagtgcagggtacccctatgttgcacttggtatcaaaaagagagacattttgtccaagaaaaccaaggacctgacaaagctgaagggatgtatggacaagtacgggctaaatctcccgatggtcacctatgtgaaggatgagctgagatcagcagagaaggttgcgactcggaccgatg

SEQ ID NO: 8234 - DNA, 203 bp, Homo sapiens
  source 1..203: mol_type = other DNA
ggcgcgccagtcctccaagggtaaatccaggctaattgaggcatcaagtctgaatgattcagtggccatgaggcagacctttggaaacctgtacaaaacatttcacctaaaccctggcatagtgacaggcagtgcagttggctgtgaccccgatctgttctggagcaagattccagtcatgcttgacgcgactcggaccgatg

SEQ ID NO: 8235 - DNA, 203 bp, Homo sapiens
  source 1..203: mol_type = other DNA
ggcgcgccagtcctctatcagatggactaaagatcctaagaacactcaggaccatgtgcgatctttgtgcttattggcctggcacaatggagagcaagaatatgaagaatttgtgtcaaaaatcaggagcgtcccagtagggcgctgcttgaccttgcctgcgttctccactctacgcaggaaatggccgactcggaccgatg

SEQ ID NO: 8236 - DNA, 203 bp, Homo sapiens
  source 1..203: mol_type = other DNA
ggcgcgccagtcctatttttcacaagatccctcaaaattcacaaagcccgtagtagatgctctcaccgaagctgctgttcctttgaaatcaccatcagcagaagcttgcggttatagtgaccgcgtgttacaattgacactaggcaattctactattaccacacaggaagctgctaacattgtggtggcgactcggaccgatg

SEQ ID NO: 8237 - DNA, 203 bp, Homo sapiens
  source 1..203: mol_type = other DNA
ggcgcgccagtcctccatgcctggagaagatggctctgaattcatagacccgctgttcttggacaacggtacgatgttgcaacaggcaactgttttcccccaccagtggataaatttgagaactaacaacagcgcaaccattatagttccatatatcaacaacataccagcagactcccctgttcgaccgactcggaccgatg

SEQ ID NO: 8238 - DNA, 203 bp, Homo sapiens
  source 1..203: mol_type = other DNA
ggcgcgccagtcctttttaactacctctgatgactgttctgaaggtttgttaccaaattttcattctactcccgaaattttcatccctggtcaagtgaataatttactcgaattagtgcaaattgagacaatgatgacagtcaataatacagcaacccaggcttcaggagtgggtagaatcacgattccgactcggaccgatg

SEQ ID NO: 8239 - DNA, 203 bp, Homo sapiens
  source 1..203: mol_type = other DNA
ggcgcgccagtcctctgtttcagtgcaaagtgatgtggacactcaaattgcaggtttcacaattaatcctggtagtgatggagtgtttcagtcaacataccttgggcaaatttgcagatacttcaacaactggtcagggagcattgaaatcactttcatgttctgtggatccttcatggcaacaggcacgactcggaccgatg

SEQ ID NO: 8240 - DNA, 203 bp, Homo sapiens
  source 1..203: mol_type = other DNA
ggcgcgccagtcctcaatcccctttatgtccacatgtgcagcttatgcttggttttacgatggttatccaagatcatatggaccagatgccgaagcattaaataaatcatatggcatattaccagcaaatcaatttggcaccttttgcatgagattacttggtagtgctctgaagactacattgacagcgactcggaccgatg

SEQ ID NO: 8241 - DNA, 203 bp, Homo sapiens
  source 1..203: mol_type = other DNA
ggcgcgccagtcctttagaatctacatgaggccaaagcatatcaaatgttgggcacccagaccatttaggatgttgccatatgttgaaaagaatagaccatcctacaaatcaccccctacagatccaatcaagaatcggactagtatcaccacaacgggagcatttggacaacaaagtggagctgtctcgactcggaccgatg

SEQ ID NO: 8242 - DNA, 203 bp, Homo sapiens
  source 1..203: mol_type = other DNA
ggcgcgccagtcctacaaacacttcccagtgtgtttccagggtccgggtctcacatttattgaggccaatgagtactacccagcgcgatatcagtcccacgtgcttctagccgttggccatgcgcaaccaggcgattgtggtggcattttacgatgtgaacatggagtggtgggaatcctaacagcagcgactcggaccgatg

SEQ ID NO: 8243 - DNA, 203 bp, Homo sapiens
  source 1..203: mol_type = other DNA
ggcgcgccagtcctcagaagaagtaccaccaccaccagccattgcagaccttttaaagtcagtggactcagaggaggtcagaaactattgtgaatcaaaaggatggatagtacctgccatggaaattaatgttgagagacacatcaatagagcaatgactattctccaagctgtgtccacctttgttgcgactcggaccgatg

SEQ ID NO: 8244 - DNA, 203 bp, Homo sapiens
  source 1..203: mol_type = other DNA
ggcgcgccagtccttaatgtacaacttcccaaccaaatcaggacaatgcggaggcatactcatggctacaggtaaggtgttaggaatccatgttggtggcaatgggcaccagggctttgctgcaactcttttgagatcatatttcagtgaagagcaaggtgagattgaatggatggagaccaacaaggcgactcggaccgatg

SEQ ID NO: 8245 - DNA, 203 bp, Homo sapiens
  source 1..203: mol_type = other DNA
ggcgcgccagtcctagtcaggttatcccataatcaatgcaccaaccaagacaaaactagaacccagcgtctttcatgatgtttttgagggaaagaaggagcctgctgtgttgaacccccgtgatcccaggttgagagttgattttgaagaagctatcttctccaaatatgtgggtaatgttaacacaccgactcggaccgatg

SEQ ID NO: 8246 - DNA, 203 bp, Homo sapiens
  source 1..203: mol_type = other DNA
ggcgcgccagtcctcggtctggttcgcagctctaaaaatattgctggagaaaattggatacaccaacaatgagaccaagtacattgattatttgtgtaactcctatcacctttacaaaaataaacattattttgttagagggggcatgccatctggttgctcagggacttccatcttcaacagtatgacgactcggaccgatg

SEQ ID NO: 8247 - DNA, 203 bp, Homo sapiens
  source 1..203: mol_type = other DNA
ggcgcgccagtcctccagtgggtcgatgccttttgcttccggcttattcgacacttagacggaaatggcttgactctttctaaattatatacaatcaatttaaatgattaggctaattggctaaccctgtcacgtatctggacgtgacaaaacgtgacaggggtaaatttagcacatccagagtgcttcgactcggaccgatg

SEQ ID NO: 8248 - DNA, 203 bp, Homo sapiens
  source 1..203: mol_type = other DNA
ggcgcgccagtccttgttttcttgttttgccgtgcatttagaataagagacaacttaaacctccgattcggcaacacagggaataatctcaccagacccggcagtgtcttcaggcttcatagccccaagatggagagtcgggcccacaaagcatggatgacgcacaccgcatcaggtttcgaaacagacgactcggaccgatg

SEQ ID NO: 8249 - DNA, 203 bp, Homo sapiens
  source 1..203: mol_type = other DNA
ggcgcgccagtcctttaccataagattttaacagcaggattgtcagtccaacaaggcattgtgagacaacgggtcattcaagtccaccaggttacaaacctagaagaaatatgccaattgatcattcaagcctttgaagctggtgttgattttcaagagagtgcagacagtttcttgctgatgctatgcgactcggaccgatg

SEQ ID NO: 8250 - DNA, 203 bp, Homo sapiens
  source 1..203: mol_type = other DNA
ggcgcgccagtccttttacatcatgcttatcagggtgactacaagcaattcttggaaagcaatgcagtcaagtaccttgagggtcatggctttcgctttgaggtcaggaaaaaggaaggagtcaagcgactcgaagaattgcttcctgctgcatccagtggcaagagcatcaggagaacactggctgccgactcggaccgatg

SEQ ID NO: 8251 - DNA, 203 bp, Homo sapiens
  source 1..203: mol_type = other DNA
ggcgcgccagtcctcggactgtttcctcagctttctgcaattgccctaggtgtcgcaacggcacacggcagtaccctggcaggagtaaatgtgggggaacagtatcagcaactacgagaagcagccactgaggcagaaaaacaattgcagaaatacgctgaatctcgcgagcttgaccatctaggtctcgactcggaccgatg

SEQ ID NO: 8252 - DNA, 203 bp, Homo sapiens
  source 1..203: mol_type = other DNA
ggcgcgccagtccttcccagaaaccgcacggccgagaatcgatccccagcattcaaaatgcgttattaagaaaaaacatatgatgaagattaaaaccttcatcaacattgcacagactttgatccttaggagtttattctagctatctacaaaacgggtccaaaacggaatgatttccactagggctgcgactcggaccgatg

SEQ ID NO: 8253 - DNA, 203 bp, Homo sapiens
  source 1..203: mol_type = other DNA
ggcgcgccagtcctcttttcaccaactggtccaggtaatttgcaagctaggaaaagacaattctgcattggacattattcatgctgagttccaagccagccttgctgaaggtgattctccccaatgtgccctgatccaaataacaaaacggatccccatcttccaggatgccactccgcccacaattccgactcggaccgatg

SEQ ID NO: 8254 - DNA, 203 bp, Homo sapiens
  source 1..203: mol_type = other DNA
ggcgcgccagtcctctcaccttcagacatcaacgcatggcagtcccaaacaccggtgagggaggcgcccggcgacaacacatgatgataggctgatcttcgggataagagacatgaaaaaccaaaaagccgtttacatccagatccaagatcaagagtggcttggaaataaggggcacttgttctttgcgactcggaccgatg

SEQ ID NO: 8255 - DNA, 203 bp, Homo sapiens
  source 1..203: mol_type = other DNA
ggcgcgccagtccttggtgaatgtaatatctggcccgaaagtgctgatgaagcaaatcccaatctggcttcctctgggtgtctctgaccagaagacatatagctttgattcaaccactgctgccattatgctagcatcatataccatcactcattttggcaaaacctcaaatccccttgtgagaatcacgactcggaccgatg

SEQ ID NO: 8256 - DNA, 203 bp, Homo sapiens
  source 1..203: mol_type = other DNA
ggcgcgccagtcctaaactccagctgtgtcaactggcacgctccgcccagggatctcattccatcccaaattaaggcctatcctgctaccaggaagagctggaaagaagggctccaactccgatctaacatctcctgacaaaatccaggctataatgaatttcctacaagacctcaaaattgtaccaacgactcggaccgatg

SEQ ID NO: 8257 - DNA, 203 bp, Homo sapiens
  source 1..203: mol_type = other DNA
ggcgcgccagtccttcgatccaaccaagaatatcatgggtattgaagtgccagaactcctggttcacaggctgactgggaagaagacaactaccaagaatggtcaaccaatcattccaattctgctaccaaagtacattggtcttgatcctctatctcaaggtgatctcacaatggtgatcactcaggcgactcggaccgatg

SEQ ID NO: 8258 - DNA, 203 bp, Homo sapiens
  source 1..203: mol_type = other DNA
ggcgcgccagtcctaaggcagccaagcagcagcccccgagccgagcccaaacccattacacccgagcccaacacccatccagcaacccacaaccgtcaaacgcacagatggacaagcaaagaacatcaagccaggagcaacacagaccccaagtctaagctgatcaacccctcccgcaatcccaccaacgactcggaccgatg

SEQ ID NO: 8259 - DNA, 203 bp, Homo sapiens
  source 1..203: mol_type = other DNA
ggcgcgccagtcctcgccagcaaaaatcccccaactcgataccaaccccaagcaaatcagctcaaaccgtctatctctccccgcttcactccacaccccagattcagcaaacgatcaacgcacttcttatgccacagcttatattaagaaaaagaacttgatgaagattaaggcaaccagtggtgctacgactcggaccgatg

SEQ ID NO: 8260 - DNA, 203 bp, Homo sapiens
  source 1..203: mol_type = other DNA
ggcgcgccagtccttcttcatctctttgatttgagtcttaagtgaatacacaggttctaatactgttcttctgtccaacggtataattcagccaggcctaagacagtagctaatcacagtcatcatgggagcgtcagggattctgcaattgccccgtgagcgcttcaggaaaacatctttctttgtttcgactcggaccgatg

SEQ ID NO: 8261 - DNA, 203 bp, Homo sapiens
  source 1..203: mol_type = other DNA
ggcgcgccagtcctgggtaataatcctattccataaagtcttttcaatcccgttgggggttgtacacaacaataccctacaagtgagtgatattgacaagtttgtgtgccgagacaaactctcttcaactagccaattgaagtcagtcgggttgaacttggagggcaatggagtagcaactgatgtaccgactcggaccgatg

SEQ ID NO: 8262 - DNA, 203 bp, Homo sapiens
  source 1..203: mol_type = other DNA
ggcgcgccagtccttacacaaagtctcaggaactggaccatgcccaggaggactcgcctttcacaaagaaggagccttcttcctgtatgaccgactcgcatcaacaatcatttatcggggtacaacctttgccgaaggagttattgcatttctgatcttgcctaaggcgcgaaaggattttttccagtcgactcggaccgatg

SEQ ID NO: 8263 - DNA, 203 bp, Homo sapiens
  source 1..203: mol_type = other DNA
ggcgcgccagtcctcagtagaggcacgggaccatccagccccacggtccccaacaccacagaaagccacgccgaacttggcaagacaaccccaaccacactcccagaacagcacactgccgccagtgccattccaagagccgtgcaccccgacgaactcagtggacctggcttcctgacgaacacaatcgactcggaccgatg

SEQ ID NO: 8264 - DNA, 203 bp, Homo sapiens
  source 1..203: mol_type = other DNA
ggcgcgccagtcctacggggggttacaaatctcctgacaggatccagaagaaagcgaagggatgtcactcccaatacacaacccaaatgcaacccaaacctgcactattggacagccttggatgagggtgctgccataggtttagcctggataccatacttcgggccagcagctgagggaatttacaccgactcggaccgatg

SEQ ID NO: 8265 - DNA, 203 bp, Homo sapiens
  source 1..203: mol_type = other DNA
ggcgcgccagtccttgaaggcataatggagaatcaaaatggattgatctgtggattgaggcagctggccaacgaaacgacacaagctcttcaattgttcttaagggcaactactgagttgcgtacattctctatactaaatcggaaagcaatagacttcttgctccaaagatggggaggaacatgtcacgactcggaccgatg

SEQ ID NO: 8266 - DNA, 203 bp, Homo sapiens
  source 1..203: mol_type = other DNA
ggcgcgccagtcctaaatctcaacttagcttgctatgtgaaagccacttacggcgagaaggacttggtcaagaccaatcagagtcagttctggaggtatatcaacgcttacacagcgataaaggtgggaatttcgaggcagcactatggcagcagtgggatcggcaatcattgataatgttcataacacgactcggaccgatg

SEQ ID NO: 8267 - DNA, 203 bp, Homo sapiens
  source 1..203: mol_type = other DNA
ggcgcgccagtcctatgaacaccagaaaaccaggaccagtcaaattctccctcctccatgaatcaaccttgaagacacttgctaaaaaacctgcgacccagatgcaagcactaatcttagaattcaatagttctctcgctatttaactcaactcatcaaaatgctaacttgtgatccttaagctgcaccgactcggaccgatg

SEQ ID NO: 8268 - DNA, 203 bp, Homo sapiens
  source 1..203: mol_type = other DNA
ggcgcgccagtcctcttagacttttgataagaatactaactattgatgattgtctttgacatgaggataagaacactgcccattagatagatggggttcaccattaatacacaattacccaatcatgttaacagcagttagatccctcaagtatatcaagttcattctaccctttgcattgtcactctcgactcggaccgatg

SEQ ID NO: 8269 - DNA, 203 bp, Homo sapiens
  source 1..203: mol_type = other DNA
ggcgcgccagtccttattccgcatactccttaaatccccaactaaagaactgtagactaccgaaacatatataccgactaaaatatgacaccactgttacagagtttttgagtgatgtgccggtagcaacattgccagcggattttttagtacctacatttcttaggactctatcaggaaatggttctcgactcggaccgatg

SEQ ID NO: 8270 - DNA, 203 bp, Homo sapiens
  source 1..203: mol_type = other DNA
ggcgcgccagtcctcaaatgtttcactggtatgatcttgcaattctagcacgtagagggcgactaaatagagggaataatcgctcaacatggtttgcaagtgataatttggtagatatcctaggttatggagattatattttttggaaaataccattatcactactaccagtggatacacaaggcctccgactcggaccgatg

SEQ ID NO: 8271 - DNA, 203 bp, Homo sapiens
  source 1..203: mol_type = other DNA
ggcgcgccagtcctccacatgcagccaaggactggtatcatgaatcggttttcaaggaggctattcaaggccatacacacatcgtgtccatctctacagcagatgtcttaatcatgtgtaaggacataatcacctgtcgatttaatactttactgattgctgctgtggcaaatctagaggattcagttcgactcggaccgatg

SEQ ID NO: 8272 - DNA, 203 bp, Homo sapiens
  source 1..203: mol_type = other DNA
ggcgcgccagtcctcattcagattaccctttaccagaaacagtgtctgacctatacaaagcaggagattatttaatctcattgctaggatcagaaggttacaaagtcataaaattccttgagccgttatgcttagcaaagatccaactctgctcaaattacactgagaggaaaggaagattcctcactcgactcggaccgatg

SEQ ID NO: 8273 - DNA, 203 bp, Homo sapiens
  source 1..203: mol_type = other DNA
ggcgcgccagtcctgcagtttttgaacccaatgttcttggttataacccaccgaataaatttgctacaaaaagggtacctgagcaattccttgaacaggagaatttctcaatagagagtgtcctacattatgctcaacgtctggaatatcttctcccggagtaccggaacttctctttttcactcaagcgactcggaccgatg

SEQ ID NO: 8274 - DNA, 203 bp, Homo sapiens
  source 1..203: mol_type = other DNA
ggcgcgccagtcctgagaaggagttaaacattggacgagcttttgggaaattgccatatccaacacgcaatgttcaaactctgtgcgaagctttgttagcagatggtttggcgaaagcattcccaagcaatatgatggttgtgacagagcgcgagcaaaaagaaagccttttgcatcaagcgtcttggcgactcggaccgatg

SEQ ID NO: 8275 - DNA, 203 bp, Homo sapiens
  source 1..203: mol_type = other DNA
ggcgcgccagtcctccacagtgttatatacatgtgagtgattattataaccccccacatggagtctctctcgaaaaccgagaaaatccaccagaaggtccaagctcttaccgtggtcatctaggcgggattgagggacttcaacaaaaactctggacaagcatctcatgtgcacagatttcattagttcgactcggaccgatg

SEQ ID NO: 8276 - DNA, 203 bp, Homo sapiens
  source 1..203: mol_type = other DNA
ggcgcgccagtcctgaaatcaaaaccggttttaaactgcgatctgcggtaatgggtgacaatcaatgtataactgtactctctgtatttcccctcgaaactgagtctagtgagcaagaattaagttctgaagataatgccgctagagtagctgctagcttagcaaaagtcacaagtgcctgcggcatccgactcggaccgatg

SEQ ID NO: 8277 - DNA, 203 bp, Homo sapiens
  source 1..203: mol_type = other DNA
ggcgcgccagtccttttttaaaacctgatgaaacttttgttcactcaggtttcatttattttggcaaaaaacaatatttgaatggagtacaattacctcaatcactgaaaactgctactagaattgcacccttgtcagatgctatctttgatgatcttcaagggacactagctagcataggcacggctcgactcggaccgatg

SEQ ID NO: 8278 - DNA, 203 bp, Homo sapiens
  source 1..203: mol_type = other DNA
ggcgcgccagtccttgtatactagaacaactaaatgtcatctggctcaaaccatatgagcattgccctaaatgtgcaaagtcagcaaaccctaaaggggaaccttttgtttctattgcaattaaaaaacatgtagtaagtgcttggcctgatcaatcacgacttagttggacaattggagatggcatccgactcggaccgatg

SEQ ID NO: 8279 - DNA, 203 bp, Homo sapiens
  source 1..203: mol_type = other DNA
ggcgcgccagtccttcagcaagagatagtaatattatcttccagaatgtcattaattttgctgttgcactttttgatctacgatttaggaacgtggctacttcttctatacaacatcatcgggctcatcttcatttgtcaaagtgttgcacgcgagaggttccagcccaatatttagtttatacatcacgactcggaccgatg

SEQ ID NO: 8280 - DNA, 203 bp, Homo sapiens
  source 1..203: mol_type = other DNA
ggcgcgccagtcctctagctaaaactgttatccaatctataatttctgacagcaacaattcatcaacggatccaatcagtagtggggaaacacgatcattcaccactcacttcttgacatatcctaagattggactactatatagttttggtgcactcatcagttattatctaggcaacaccattattcgactcggaccgatg

SEQ ID NO: 8281 - DNA, 203 bp, Homo sapiens
  source 1..203: mol_type = other DNA
ggcgcgccagtcctagaaccaaaaaattgactcttaacaacttcatatattacctagctactcaaatacataatttacctcatcgctcgttgagaatccttaaacctactttgaaacacgctagtgttatctcgagattaataagtattgactctcacttctcaatttatattggaggaactgctggtcgactcggaccgatg

SEQ ID NO: 8282 - DNA, 203 bp, Homo sapiens
  source 1..203: mol_type = other DNA
ggcgcgccagtccttataacgaaagaccctctatcagaaagtctgaggggacaacagagattgtaaggcttactcggcagctgagggcaataccagacaccacaatatattgccgcttcacgggaatagtttcttcaatgcactataagctcgatgaagtcctttgggaatttgataattttaagtctcgactcggaccgatg

SEQ ID NO: 8283 - DNA, 203 bp, Homo sapiens
  source 1..203: mol_type = other DNA
ggcgcgccagtcctggacaaataaaagtcactttaaacaattctgcaagccagattaccgatattactaatccaagttggttggcagaccaaaaatctaggatccctaagcaagtagagattataaccatggatgctgaaacaacagaaaacattaatcggtcaaaattgtacgaagcagtccaacagcgactcggaccgatg

SEQ ID NO: 8284 - DNA, 203 bp, Homo sapiens
  source 1..203: mol_type = other DNA
ggcgcgccagtcctataaaaggtcgtattacaaaattggtaaatgattaccttaagttctttctaataatacaagccttaaagcacaattgcacatggcaagaggaactaagagctcttccagatctaattagtgtctgcactcgattctatcatactcgaaactgttcatgtgaaaaccggttcctacgactcggaccgatg

SEQ ID NO: 8285 - DNA, 203 bp, Homo sapiens
  source 1..203: mol_type = other DNA
ggcgcgccagtcctgtacagactttatacttatcacgcatgcaggattcggaaatcaaactaatagatagattgaccggccttcttagtctatgtccaaatggtttttttcggtaaggactcttgacgtacaaactccacatagttatacaatggtaccaggacactatatgtaaattgaccctaagacgactcggaccgatg

SEQ ID NO: 8286 - DNA, 203 bp, Homo sapiens
  source 1..203: mol_type = other DNA
ggcgcgccagtcctaccaagagcaggcccaaagggccattaggccacatctgctgagcctgcagaacacgcaggacttacttagcagaagagagcgcgtgccgaaaccagccaacaaattgacacagctgctcactctgaccctgaattcataaacaatattaagttgacaacagagatactaatccacgactcggaccgatg

SEQ ID NO: 8287 - DNA, 203 bp, Homo sapiens
  source 1..203: mol_type = other DNA
ggcgcgccagtcctcgaggaggaaacaacagaagcaaatgctggacaatttctttcatttgctagtctgtttctcccaaaattggttgtcggagaaaaggcctgtctggagaaggttcaacgacaaatccaagtgcacgcagaacaaggtctgattcaatacccgacatcttggcaatcggtgggacacgactcggaccgatg

SEQ ID NO: 8288 - DNA, 203 bp, Homo sapiens
  source 1..203: mol_type = other DNA
ggcgcgccagtcctcctccaaaaaacagagcacggagttcgcctgcatcccttggcgcgaacagccaaagtcaaaaatgaggtgagctcttttaaggccgctttagcctcactagcacaacatggagaatatgccccgtttgctcgtctgctgaatctatctggggttaataatcttgagcatgggctcgactcggaccgatg

SEQ ID NO: 8289 - DNA, 203 bp, Homo sapiens
  source 1..203: mol_type = other DNA
ggcgcgccagtcctaccttttgatgccatcctttactaccatatgatgaaagaagagcccatcattttcagcactagtgatgggaaggagtatacatatccagactctcttgaagatgagtatccaccctggctcagcgagaaggaagccatgaacgaagacaatagattcataaccatggatggtcacgactcggaccgatg

SEQ ID NO: 8290 - DNA, 203 bp, Homo sapiens
  source 1..203: mol_type = other DNA
ggcgcgccagtcctcggttagtactagtatcaacagtactgccagtggtccgaactttccagcaccggatgtaatgatgagtgatacaccctccaactcactccgaccaattgctgatgataacatcgatcatccaagtcatacaccaaccagtgtttcatcagcctttatactcgaggcaatggtgacgactcggaccgatg

SEQ ID NO: 8291 - DNA, 203 bp, Homo sapiens
  source 1..203: mol_type = other DNA
ggcgcgccagtcctttggtcctgggatccccgatcacccgttgcggcttctaagaataggaaatcaagccttcttgcaagagtttgtgctgcctccagttcaattgccgcagtatttcacttttgacctgacggctctaaagctgatcactcaacctctcccggcagcaacctggacggatgatactccgactcggaccgatg

SEQ ID NO: 8292 - DNA, 203 bp, Homo sapiens
  source 1..203: mol_type = other DNA
ggcgcgccagtcctcgaccggtcctacaggaatacttcgtcctggaatttcctttcatcccaaactgagacctatcctattgccagggaagaccgggaaaagaggatccagctccgatcttacttctcctgataaaatacaagcaataatgaactttctccaagacctcaaactcgtgccgattgatccgactcggaccgatg

SEQ ID NO: 8293 - DNA, 203 bp, Homo sapiens
  source 1..203: mol_type = other DNA
ggcgcgccagtccttccaaccagcaacaccatccatacacaggtatcaattgggctgccgcagcatatagacccaatagcaagctgctgtccagaaaatagttccggaaagtaactcaaccatcgcaagcccaatgcagctttcagaaatccgccagcaacccaactccactgtacccccaatattaacgactcggaccgatg

SEQ ID NO: 8294 - DNA, 203 bp, Homo sapiens
  source 1..203: mol_type = other DNA
ggcgcgccagtcctaggtttctggaacagggccgtgccctgaaggttacgctttccacaaagaaggcgctttcttcctgtatgatcgactggcatcaacaatcatctatcgaagcaccacgttttcagaaggtgttgtggctttcttgatcctccccgaaactaaaaaggactttttccaatcgccaccgactcggaccgatg

SEQ ID NO: 8295 - DNA, 203 bp, Homo sapiens
  source 1..203: mol_type = other DNA
ggcgcgccagtcctccaggatccaggcagcaaccagaagacgaaggtcactcccaccagcttcgccaacaaccaaacctccaagaaccacgaagacttggttccagaggatcccgcttcagtggttcaagtgcgagacctccagagggaaaacacagtgccgaccccacccccagacacagtccccaccgactcggaccgatg

SEQ ID NO: 8296 - DNA, 203 bp, Homo sapiens
  source 1..203: mol_type = other DNA
ggcgcgccagtcctgataatgcacaatcaaaatgggctaatttgcgggttgaggcagctagcaaatgagacgactcaagccctacagttattcttgcgtgctaccacggaattgcgcactttctctatattgaatcgaaaagccatcgactttttactccaaagatggggaggaacgtgccacatcttcgactcggaccgatg

SEQ ID NO: 8297 - DNA, 203 bp, Homo sapiens
  source 1..203: mol_type = other DNA
ggcgcgccagtcctagcttagtctattgtgtgagagtcatctacgacgagaagggctaggacaggatcaatcagaatctgttcttgaagtgtatcagcgcttacatagcgacaaaggcggaaattttgaggcagccctatggcaacaatgggaccgacagtccttgatcatgtttataacagcatttccgactcggaccgatg

SEQ ID NO: 8298 - DNA, 203 bp, Homo sapiens
  source 1..203: mol_type = other DNA
ggcgcgccagtcctgctacatagcgagaaggctattcagaaagtaaagaaacatgcaaccgtaataaaagcattgcgtcccgtaatcatctttgagacatattgtgtgttcaagtacagcattgccaaacattattttgatagccaagggtcatggtatagtgtaatctcagataaacatctaacacccgactcggaccgatg

SEQ ID NO: 8299 - DNA, 203 bp, Homo sapiens
  source 1..203: mol_type = other DNA
ggcgcgccagtccttgcagttttcgagcctaatgttcttggatatagtcctccaaacaagttctcaactaagagggttcctgaacagtttcttgaacaagaaaatttctcgattgatagtgttctcacttatgcccagcgcctggattatctacttccacaataccggaatttttctttctcacttaacgactcggaccgatg

SEQ ID NO: 8300 - DNA, 203 bp, Homo sapiens
  source 1..203: mol_type = other DNA
ggcgcgccagtcctctgtagtgcaattgactttgtactcaacccaagcggattgaatgtccctgggtcacaagacctaacatcttttttacgtcagatagtgcgtagaacaatcacattgagtgcaaaaaataagctaataaacacattgtttcactcctcagccgatttagaagatgagatggtatgcgactcggaccgatg

SEQ ID NO: 8301 - DNA, 203 bp, Homo sapiens
  source 1..203: mol_type = other DNA
ggcgcgccagtcctcctgagtgtgcaggagatccttcaaatgacgccttctcattattcagggaacatcgtacatcggtataatgaccaatacagccctcattctttcatggcaaatagaatgagtaattccgcgacgagattggtggtgtcgacaaatactctcggggagttctcaggtggggggcacgactcggaccgatg

SEQ ID NO: 8302 - DNA, 203 bp, Homo sapiens
  source 1..203: mol_type = other DNA
ggcgcgccagtccttaggaccaaaaagctagacctcagtcattttatgtattacttaacaactcaaatccataatttgccacatcgctcgttgaggatacttaagcccacctttaaacatgttagtgtgatatcaagactaatgagtattgatcctcatttttcaatctacatcgggggtacggcaggcgactcggaccgatg

SEQ ID NO: 8303 - DNA, 203 bp, Homo sapiens
  source 1..203: mol_type = other DNA
ggcgcgccagtccttgatcgagggctttcggatgctaccagactattccttcgagtggccatttcttccttccttcaatttatcaaaaaatggatcgtggaatacaagacagctattcctctgtgggttatataccctttggagggacaaaatccagatccaattaatagctttctacatctgattatcgactcggaccgatg

SEQ ID NO: 8304 - DNA, 203 bp, Homo sapiens
  source 1..203: mol_type = other DNA
ggcgcgccagtcctagccttactgcaaaatgaatcccctcaaaacaacatccaattccaagaagacagaaataatcaacagttgtccgataatctagtttacatgtgcaagagcactgccagtaatttcttccatgcatcacttgcctattggaggagccggcacaaaggacggcccaaaaatcgatccgactcggaccgatg

SEQ ID NO: 8305 - DNA, 203 bp, Homo sapiens
  source 1..203: mol_type = other DNA
ggcgcgccagtcctaattcaaactctttacttaacccgtatgcaagactcagaagcaaaattaatggagagattaaccgggtttctaggattgtatcctaatggtattaacgcttaagatccccttagaggcatcgcaatatgactccaaacattaaatgatattgctgtcaatacatctacctgacccgactcggaccgatg

SEQ ID NO: 8306 - DNA, 203 bp, Homo sapiens
  source 1..203: mol_type = other DNA
ggcgcgccagtcctgagagcaaggtttattataaaaaacctatacacatgactgcaatgcgtaatttataccgaaacacagtgagggctgcacatgcaggttcctgttgagctttaaaagatcatgcaatataaaatgatatttgtatactaatcatgttagtactaactaacagtactcactgcatacgactcggaccgatg

SEQ ID NO: 8307 - DNA, 203 bp, Homo sapiens
  source 1..203: mol_type = other DNA
ggcgcgccagtcctcgtcatagaggacgatgccaagttccttctggagaacggctctctcccgtttggctccacccttgccatggcgcaccgctcccgcccctttcctgctgaccccaaaaccgaaacccaaatcctaaaccatctccactttgctatcaccactctccaccgtgaccccaactacaccgactcggaccgatg

SEQ ID NO: 8308 - DNA, 203 bp, Homo sapiens
  source 1..203: mol_type = other DNA
ggcgcgccagtcctccccccctgcacaacccgcctccccgtccgcattcacaaagctgcctgggccttccacgcgttcggctaccgctgcacgctggttggttttgaaccctccactccgtggactctcaaagaagtgaaacaggttctacctgagacacttttccaggaagaatgccatgctttccccgactcggaccgatg

SEQ ID NO: 8309 - DNA, 203 bp, Homo sapiens
  source 1..203: mol_type = other DNA
ggcgcgccagtcctcctcccaagccccaccatccaaggcttcacctacctcactcccgaccctatcttcgctgatgtcctacgccgcgtccgaagtggggacttcacagtcttccaatcggacaacgctaaggtttccggcgtcgatgatgactacaccctcatctactcctttggcccccacaccgccgactcggaccgatg

SEQ ID NO: 8310 - DNA, 203 bp, Homo sapiens
  source 1..203: mol_type = other DNA
ggcgcgccagtcctatccactaacactggatcgccagccccccagaatcccaatgggccttccaactcctcccgccccaacaaaccccgtatgtccacccttggtcgtgtcaacgatcagctcgcccaagagcgcatccgcactcttcgggccggctccattggcatggacatcccctcccaagcccccgactcggaccgatg

SEQ ID NO: 8311 - DNA, 203 bp, Homo sapiens
  source 1..203: mol_type = other DNA
ggcgcgccagtcctcccctgcaccaaacatgctaactttggctctggaacccacctcaacttcccttactccatcctcaattcccaacctggcactgctatctccaacgctttcagcacccattcctattggcgcggagacgccctcattcaggttaccgtcaacagttcaccacaagccagtggtgtcgactcggaccgatg

SEQ ID NO: 8312 - DNA, 203 bp, Homo sapiens
  source 1..203: mol_type = other DNA
ggcgcgccagtcctgctgcttgttgctgcaatacctgaaggcgtcgatgtgttgacccctcaatccgcaacccactaccccttcaccctgctgaacctcgctaccaccaattgctgtgcccttctccttcccttcctgtcccctaatcccgtggacccctgcggcctccactttcagtggaacgtcgtcgactcggaccgatg

SEQ ID NO: 8313 - DNA, 203 bp, Homo sapiens
  source 1..203: mol_type = other DNA
ggcgcgccagtcctagccctccccatcaccccccttcgcgtccctgccggaaccccctctttcctggacgtctcgtgcatgatggctcctcaggactctgagttctttgcgatgaagacccctgcccaacaaggtgtcaaagtccgcgaaacctcagctactgggaacgcctatgtcacgagctgctccgactcggaccgatg

SEQ ID NO: 8314 - DNA, 203 bp, Homo sapiens
  source 1..203: mol_type = other DNA
ggcgcgccagtcctccccatctctctcaccaccccgatctctgggaccctaacccccctaggccaaacccttacccacttctcccaatggcgaggaaccctggatattgatctggtcttctccggatcacagcagaacactggccgcatcctggtgtccaccacacctccagtggctggatgccccgccgactcggaccgatg

SEQ ID NO: 8315 - DNA, 203 bp, Homo sapiens
  source 1..203: mol_type = other DNA
ggcgcgccagtcctgaccatggaagctgctatgcgcaacacctgctacatctgggacctcaccacctccgcctccatctccatcaccatcccctacttttcctccaccccatggaaaaccctctcccgctccacttccctatccctctcggtcaaccagctggctggttggctggggctctatgtctacgactcggaccgatg

SEQ ID NO: 8316 - DNA, 203 bp, Homo sapiens
  source 1..203: mol_type = other DNA
ggcgcgccagtcctctcccccctttcctgccctgctttcaaccctgatcaggcaaccattgccgtgttcatccgcggtggtgccgatttcgaggccagaattccgtctggtctcgcgaccgccaccatccagggtgatgaggaggtccccgcctcctcaaacgacggtctgaacaccttggagctcagcgactcggaccgatg

SEQ ID NO: 8317 - DNA, 203 bp, Homo sapiens
  source 1..203: mol_type = other DNA
ggcgcgccagtcctcctctccggcttcccctccgctggctggagggaaatgacggaggatcgtgctcacgtcaccctctccgttcccttctctgctgaaaatcccgtgattgcctcccgctatctaggtttcccctcttacgaatcatcccaatcccttgccacttccctctactcctttggcaccctcgactcggaccgatg

SEQ ID NO: 8318 - DNA, 203 bp, Homo sapiens
  source 1..203: mol_type = other DNA
ggcgcgccagtcctgatcctgcgcacttcacctgaaccgtgcttcgttatccgcaaccagcggctaacgtatgtacactgggccctccgctccggaaacaagcaggtctcaatccagagatctggcttgggcgggcttacgcccgtcatcggctatgaggacctagaaggtgaggtctacgcagaggtcgactcggaccgatg

SEQ ID NO: 8319 - DNA, 203 bp, Homo sapiens
  source 1..203: mol_type = other DNA
ggcgcgccagtcctcccccctcacatcttcgccctggctgaagcgcaagttggaagcgagtacccctactccgcaaccaacaactgcaccacctgggtggagaccctgaccaacctctccctccccaacaccggcaattcgcttgccctcggattgggcgccatcggcgtgggagccgctgctgccttcgactcggaccgatg

SEQ ID NO: 8320 - DNA, 203 bp, Homo sapiens
  source 1..203: mol_type = other DNA
ggcgcgccagtcctgttcggtagccccacccctctctccgttgccggtctccttgtcgtgatcgcctccgactttgctcctgccgtagtccagtatttcaagaacgtcgggaatccactcgccgctctctactactggattgcacgcaagctaggtctggaaagcgtgaccgccaaggacgccgtcgacgactcggaccgatg

SEQ ID NO: 8321 - DNA, 203 bp, Homo sapiens
  source 1..203: mol_type = other DNA
ggcgcgccagtccttgttcgcgctaagagtgaaccctccgcccaactggcccagagtcacgacaccatcatggctctgttccaggactccatctccgccacctcggccccctccctggaccttcctgctgcccgttccaacctcgccaaagcccaatccctgcttcccctggccaccgcagcaaaatccgactcggaccgatg

SEQ ID NO: 8322 - DNA, 203 bp, Homo sapiens
  source 1..203: mol_type = other DNA
ggcgcgccagtcctggtgaagaattccgggggcattagcaatgccctggccgcgctgatcccgggcgtcaagccgcttgcacgccagcaagctggtgacgaagtccccatcagcaaggcccccacctgcttcaccaacccttcttacattcccggatctactgaagatctgagttgggacccgaccgacgactcggaccgatg

SEQ ID NO: 8323 - DNA, 203 bp, Homo sapiens
  source 1..203: mol_type = other DNA
ggcgcgccagtcctgatcgctgccgtctatgctccaaagatgccccaggtgcgtgacatccgtcgctttatccgggctccaaggatgcatcatgtcggtaccgtgattgccaactccacctctggccctgtgttcatgttggccaacaacgtgaagcacggtgacacaccctaccctgaccttaccggcgactcggaccgatg

SEQ ID NO: 8324 - DNA, 203 bp, Homo sapiens
  source 1..203: mol_type = other DNA
ggcgcgccagtcctcgcattctcgaagcagaacaggggtgacctcgacaagccctggcccaccctccccgttgctgttgatctttacttttcccagtgtgatttccccaagctacgcatgctgtcgatggacgaggctatcaacggaactccactccttgacggtctcgatatgaagcagtctgctggcgactcggaccgatg

SEQ ID NO: 8325 - DNA, 203 bp, Homo sapiens
  source 1..203: mol_type = other DNA
ggcgcgccagtcctggctggcaaaactcgtctgatcgaggctgcgcccatccatgcgatcatcgctggacgcatgctgctcggaggtctcttcgaacacatgcacgcgcgccctggccagtacgggtctgctgtcggctgtgatcccgactaccattggactccgttcttccactcctttgaccggttcgactcggaccgatg

SEQ ID NO: 8326 - DNA, 203 bp, Homo sapiens
  source 1..203: mol_type = other DNA
ggcgcgccagtccttgcagaagtttgggctctggactactcctgtttcgactctactctcccctcctgcgctttcgacctaatcgctgctaaactctctcaaatcatcactcctctccccggcattgccgaggatgccatcgtgaagtacatccggtccattagcgtgtccaagcacgtttttggcgacgactcggaccgatg

SEQ ID NO: 8327 - DNA, 203 bp, Homo sapiens
  source 1..203: mol_type = other DNA
ggcgcgccagtccttcgggcgtatctgatgaccggtggcaacccctctggctgtgttggaacctcaatcctcaactccatgattaataactctgtcctgatctctgctttcctcacccacccccagttcaaccctgcggagatgcgcatcctcacctacggtgacgacgtgctctacgccaccacccccgactcggaccgatg

SEQ ID NO: 8328 - DNA, 203 bp, Homo sapiens
  source 1..203: mol_type = other DNA
ggcgcgccagtcctcaccatccacccttccttcgtcaaatccttcttcgatcagaacaccaccctaatcgtgacccctgccactaaggccggtgacttcccggatcactccacgatctgggacgttaccttcctgaagcgctggttcgtccccgacgaagagcgcccgtggtacatccaccccgtgatcgactcggaccgatg

SEQ ID NO: 8329 - DNA, 203 bp, Homo sapiens
  source 1..203: mol_type = other DNA
ggcgcgccagtcctctactcctatctccaccaccgctggctccagctggtggtctcttaagtctgtgccttccaagcgtgttggaagtaaagccacgccggctcgcccccgtcatagggcaacccccgagtaccggtggtctcgggtctgctgctaaacccagtgggctcgttgccgtcccccattgccgactcggaccgatg

SEQ ID NO: 8330 - DNA, 203 bp, Homo sapiens
  source 1..203: mol_type = other DNA
ggcgcgccagtcctgtaccgcaaggatagcaaggtatgaacacttgtggacgaaatggtaagtgatcaattcactttcatggccggaaggtcacgtggcaatcatgccacccaggtaccctcctctgggaggatctgagggtgggctaagcagaccctgccatgtggctgaacttttcccttattgttcgactcggaccgatg

SEQ ID NO: 8331 - DNA, 203 bp, Homo sapiens
  source 1..203: mol_type = other DNA
ggcgcgccagtcctacagtgccagtgaattcaaccttttctggagaggttgtggctcgaagttctcggggttctaatcccccccctcccgctccgaaccacaaagagaagaaacccaaagagggtcgtagcaaggcctgggatttcgtgaagaagcttctcccggatccttcaaatgaggtctcgcttcgactcggaccgatg

SEQ ID NO: 8332 - DNA, 203 bp, Homo sapiens
  source 1..203: mol_type = other DNA
ggcgcgccagtcctgttccccgcctcctggcgcagtccgatgaccagatcacaaatctggaaaccggaattgcgacagaatttctcccagcccaaattcccatgggcaaccttgatcaatctgaactatctgatttgtttgctatctacaggcctttctggaccggtgaggatttctctcaatctgtccgactcggaccgatg

SEQ ID NO: 8333 - DNA, 203 bp, Homo sapiens
  source 1..203: mol_type = other DNA
ggcgcgccagtcctgctgttgcttacattccccccggtggccctatgggtcccgacctgaaacaggcactaaatttccccctggttcagattgatatttccagctatactatcaaagaaattcccataaacattcctcaatcctgtgtgactgaagcaatcccgaccagctattctggttttgctgatcgactcggaccgatg

SEQ ID NO: 8334 - DNA, 203 bp, Homo sapiens
  source 1..203: mol_type = other DNA
ggcgcgccagtcctcttacccgtggaacctggggtcgcttatctggctccgggtggggtaccctggtggtagctgctttaccccgtggcggtaaatccctgaggatggcctggtggatggacgcgcgtattactcaagcccgcgtttacatgccccgagttattggtcgcgtaggcggcctgcagagtcgactcggaccgatg

SEQ ID NO: 8335 - DNA, 203 bp, Homo sapiens
  source 1..203: mol_type = other DNA
ggcgcgccagtcctctattgaatattgatggttgctcccctcaaacacagttaggagtccttgattttccaccaaccgggcagtgtgttggtcagggtatcattgagaacacgagaattgcagctgagtcggtcagttatgcttcaatgaaccttgagagagcgttgacccaggaacggttagataagcgactcggaccgatg

SEQ ID NO: 8336 - DNA, 203 bp, Homo sapiens
  source 1..203: mol_type = other DNA
ggcgcgccagtcctattttggtgcttttggtgtcaaattttaatttgtctactttgactggagttttccttatcctgagtgcagattttattactaaagtcacctttgaagccttcaaggacaatcccttccagttcattggcaaatggatcagtgagaagctggacctgggagttgacgtggatattcgactcggaccgatg

SEQ ID NO: 8337 - DNA, 203 bp, Homo sapiens
  source 1..203: mol_type = other DNA
ggcgcgccagtcctgaaccaattctctacgtcaaggaagaagaagaccctgaggaaggtcctagtgggcaggcttttaagccgaaagatttcaatgattgggccaactttttcaaaaatattgattgggctgtgactcgattggtagttttaattgagaagttgatcaaacaaattcaggccgcaaagcgactcggaccgatg

SEQ ID NO: 8338 - DNA, 203 bp, Homo sapiens
  source 1..203: mol_type = other DNA
ggcgcgccagtcctactctcctgaaacaagctctcagcaattacacccaggcacaaaattctttgcagcgcactatttttgctgtacgcccagagcctgttgtggtttacatctacggcggtcctgggtctggtaaatctgtcctggctggcctcttagcgcgtgccatttctaaggctctttctggccgactcggaccgatg

SEQ ID NO: 8339 - DNA, 203 bp, Homo sapiens
  source 1..203: mol_type = other DNA
ggcgcgccagtcctgaggagaagggaatgtattataccagcaaagtgataattgtaactgctaattttaatcttccaaattatgcttctgctcgtgagcccaaagccctggagcgtcggctgcatttcaagatgtttatgggtggttcccttaatgtagactttgcttgtgcacctgatggcattccacgactcggaccgatg

SEQ ID NO: 8340 - DNA, 203 bp, Homo sapiens
  source 1..203: mol_type = other DNA
ggcgcgccagtcctttggaacccgctgttttgcgccggagtgatgggcgtttgttagatggtgttgtgttagatgaggcaatattttctaagcatgataagggtgacatgactgaaccctggaagaatttaccccaagctttttctgtgtattttaatcagttccagaataaggagattaggactttacgactcggaccgatg

SEQ ID NO: 8341 - DNA, 203 bp, Homo sapiens
  source 1..203: mol_type = other DNA
ggcgcgccagtcctgaaaatccccaggaatttatttacaccacattcttgaaggatgagctgaggaaagttgagaaagttgagaatggactgacccgggttattgaggctgcccccctgccagtaattctggctggacgcatgcttctcggaggtctgttcgaggagatgcagtcccaacctggtaagcgactcggaccgatg

SEQ ID NO: 8342 - DNA, 203 bp, Homo sapiens
  source 1..203: mol_type = other DNA
ggcgcgccagtcctattagcaagtatatatccagcattgcatcttcccgccatgtgtatggaaacaagatttatctgatgcttggtggcatgccttctggctgtgtaggcacttcaatcctgaacacaatttgtaataactgctttgtgctttctgcccttttagagcataaggattttgacataaatcgactcggaccgatg

SEQ ID NO: 8343 - DNA, 203 bp, Homo sapiens
  source 1..203: mol_type = other DNA
ggcgcgccagtcctgaaagggggcccggcggggcaacacccgtcggtccctctttccgtccaagccgcggacgttaaactgtggcacggttgtgcctaggtgcaaccctgctactaatggcggtacccctgcccttagtatgcatgtttgtatgaatggaatctgtagtgatgccctgctttggggtccgactcggaccgatg

SEQ ID NO: 8344 - DNA, 203 bp, Homo sapiens
  source 1..203: mol_type = other DNA
ggcgcgccagtccttaactcacttgagactaaccagggtgcaaatgggcttactgcgacagttccggtcaactcaaccttttcgggtgaggttactgctagggctcctcgcaatcctccagccctgccccaaccgccgccggcccataaggagaagaaaccgaagactactgatgggaaaaagccttgcgactcggaccgatg

SEQ ID NO: 8345 - DNA, 203 bp, Homo sapiens
  source 1..203: mol_type = other DNA
ggcgcgccagtcctattagccttcacaaaggcttttcaaaccaacgcctactacagatgtggctgggaagtgttaatggaagtcaatggcacattctttcatcagggggctatagctgtggttgcaattccagaggttcagacaactgctgcgttcactggtagtctaggccgcactcttgcgtaccccgactcggaccgatg

SEQ ID NO: 8346 - DNA, 203 bp, Homo sapiens
  source 1..203: mol_type = other DNA
ggcgcgccagtcctgcatgctattctcaacatcagaacttctaaccaagccagactgctcttgccatatgcttctgccaatcgcttcgacccgaccactggtgctgttttcaagagtgattcagggcttcctgggcttggcaccctttcttaccaccaacaatgggtgctagtcgtgtgggttatttccgactcggaccgatg

SEQ ID NO: 8347 - DNA, 203 bp, Homo sapiens
  source 1..203: mol_type = other DNA
ggcgcgccagtcctaccactgcaagtgctgtcaaatgaatccaatcttactgtgaatttgctggtccgtcctctccaagctgaattcatgggtcctcactatgcttatggacaaccctttgttgtcagggaggttgtgggttcttctggatttgctaatacccaacccatgcaggagtttaatgcaatcgactcggaccgatg

SEQ ID NO: 8348 - DNA, 203 bp, Homo sapiens
  source 1..203: mol_type = other DNA
ggcgcgccagtccttaccatttgggacatcggtctaaattcaactctgtcctttgtgattcctttttgcagctcaacttcttggaaatccattggtgcttcttcaggccttgaattctcacaggcgcttggcatgctgtatatagctgtctataaccctctggtaacgccatatggggcacccaatgccgactcggaccgatg

SEQ ID NO: 8349 - DNA, 203 bp, Homo sapiens
  source 1..203: mol_type = other DNA
ggcgcgccagtcctctctcttgtaggggtgacccttgttacaacaagagctgagttcctggatatgttattagatagtgaaggctactccgcccaaacacagataggagtccttgattacccccccagtgcccagtgcacgggacaggggatcattgagaataccagaattgcagctgagtctgttagcgactcggaccgatg

SEQ ID NO: 8350 - DNA, 203 bp, Homo sapiens
  source 1..203: mol_type = other DNA
ggcgcgccagtcctttatgcctccatgaacctggagagagtgctgactcaagagaagctggaccgcatctctgagatttctaaatctttcatgctggccagcgagaatgtccaccaggcagttgagggaatcaacaccgccctcaatgcaattactcccatcttatccacctccccgcttattgaagtcgactcggaccgatg

SEQ ID NO: 8351 - DNA, 203 bp, Homo sapiens
  source 1..203: mol_type = other DNA
ggcgcgccagtccttggtttgctggctcgtgcaatttcaaaggcactgactgggaaggtcgatgacatctatgcaccctcatcatttggaactgagcatttcgatggttaccaccaacagacggtccatatgattgatgatcttggtcaagctgtggatgggtcagactgggcaaatttctgcaatatcgactcggaccgatg

SEQ ID NO: 8352 - DNA, 203 bp, Homo sapiens
  source 1..203: mol_type = other DNA
ggcgcgccagtcctattaaatgtggattttgcttgtgctcctgatggcacacctatgagacatttcaaatctggatgccctcttctgaggaactcggcaggattgctgaaagattctgggtccattctgccctgcaagttcaaggatgctgatgatttggttgacttggtggtggctgaggtgcgaagcgactcggaccgatg

SEQ ID NO: 8353 - DNA, 203 bp, Homo sapiens
  source 1..203: mol_type = other DNA
ggcgcgccagtccttacttcttttaaaattgggaatgttatgtatgttaaggatgatgtgaagatgacccgcattggcgaagctgttctcttctacctgcctaatgtgccacaagggaaaaacctcctcaggtttgtcaaggctcgctcaattaagggagtcaaggctggcttcctggctggcaacatcgactcggaccgatg

SEQ ID NO: 8354 - DNA, 203 bp, Homo sapiens
  source 1..203: mol_type = other DNA
ggcgcgccagtcctggatggcgtaccaaacatggtgcgagtgtgggagttaaccacgttccgtggaattgaaacccaggatggaatcttcaatgagcattgcttgggctatcgctgtgcttcttatgcaggcctgtgtggggctcctttggtcctggaggatcctgctgactatagaattgctggaatcgactcggaccgatg

SEQ ID NO: 8355 - DNA, 203 bp, Homo sapiens
  source 1..203: mol_type = other DNA
ggcgcgccagtccttaaggaaattaggaccctctctcttcatgaggcaattaatgggactcccctgctggatggtattgacatgaatcagtctccaggctatccatatataacacaggggcggtcaaggcggtccctgtttacctggaatgaagaagggttttgggagcccactgatgaactgaaggtcgactcggaccgatg

SEQ ID NO: 8356 - DNA, 203 bp, Homo sapiens
  source 1..203: mol_type = other DNA
ggcgcgccagtccttcctgattttgatttggactcttactatgtgatagcatatggtgatgatgtagtttatgcaactaatcctccaattagtccaagctttgtgaagaaattttatgatgagcatacccccctaaaagttactcctgctgataaaggctcaaccttcaatgaaaactctacaatattcgactcggaccgatg

SEQ ID NO: 8357 - DNA, 203 bp, Homo sapiens
  source 1..203: mol_type = other DNA
ggcgcgccagtcctcttctttgaggatatgatggagcgcgctccaacattagatggagttcgcaaatctgctgcttctgtatatgattctgttggaactggtatgtgtattgctttatctggtattttgtcatttgttgctatagtatgtttaggtattacagatttgtcaactgcttctttcaataacgactcggaccgatg

SEQ ID NO: 8358 - DNA, 203 bp, Homo sapiens
  source 1..203: mol_type = other DNA
ggcgcgccagtccttgatgtcaaaggcaagagtgacacatatattgcaccttcatttgtcattgctacttctaatgttgaccctttcacttttgagcctaagtctattcattctgttgatgcctttgtgcgtagattaaatatagtagtggaagtagatatagatgataattttgctaagtatgttcacgactcggaccgatg

SEQ ID NO: 8359 - DNA, 203 bp, Homo sapiens
  source 1..203: mol_type = other DNA
ggcgcgccagtcctccgggtattctctacaacctggcttggtccttatgataaccctattgctgcttgtgcttatttaaatgctacattgcctgcccgcttttgtacttataatgctcaatttgctgattgttatgtgtctgatgctattattgatgattgcctacaccgttattattctgaagaggacgactcggaccgatg

SEQ ID NO: 8360 - DNA, 203 bp, Homo sapiens
  source 1..203: mol_type = other DNA
ggcgcgccagtcctgaaatatgtggtgcaagatgaaggcaatgatgttgtgactatgttagaatcccatcaggattatgccattaagaagcctttagtggaatctcatcaagatgctaaattaattaaacctatcgtagagtcacaccaggaggttaaattaattaagccacttgtcgagtcccaccacgactcggaccgatg

SEQ ID NO: 8361 - DNA, 203 bp, Homo sapiens
  source 1..203: mol_type = other DNA
ggcgcgccagtcctgtcaggttatagtatagattggacagatatcattgctgagtcatcaaatgatcataatgcccaggatattagtaagtcaattttgtctaaaaatttagttaggattatgaagcctgattcttcttactacacacatggattgtttgttaaaggacgaatgttgttgatgcctaacgactcggaccgatg

SEQ ID NO: 8362 - DNA, 203 bp, Homo sapiens
  source 1..203: mol_type = other DNA
ggcgcgccagtcctgaaggaacacgtcgagctcattatcagcaaagctcgtaagggcattgttgatactgagctcggggtgttcacggcgaccctgaaggatgagcggagacctttggctaaagtggaggcgaacaaaacgcgagtgttcgctgctaccaatcaggctttagcattagctcagcgtagcgactcggaccgatg

SEQ ID NO: 8363 - DNA, 203 bp, Homo sapiens
  source 1..203: mol_type = other DNA
ggcgcgccagtcctgtattttcttagttatcttgaacatgtaatgcttaatcgcgtagacaatgagataggtttgggtgtgaatgtgtattcgtatgattggtctagaatagtcaataaattgcatcatgtaggttctaaggttattgctggggatttttccaattttgatggttcactcaactcccacgactcggaccgatg

SEQ ID NO: 8364 - DNA, 203 bp, Homo sapiens
  source 1..203: mol_type = other DNA
ggcgcgccagtcctaaattgcatgtataatatgttaatatttagatatgtttatcttcttgctcacgaggaaaatggctttcccttgtctcttgctaattttagtgggaatctcgctgctgtcttctatggcgatgattctctttgttgtgtctccgataaagtgtgtgagtggtttaatcagcactccgactcggaccgatg

SEQ ID NO: 8365 - DNA, 203 bp, Homo sapiens
  source 1..203: mol_type = other DNA
ggcgcgccagtcctgataacacggcttatggctgtcaccggccatgtatatactgatgaaaccaagagtggttcaccaccaccgtatcgcgatatttctgaggtgacattccttaagagagaattcgtgaaacgcgactcattatggatcgctccactatctaaaaacacaatagaagatatgtgtatcgactcggaccgatg

SEQ ID NO: 8366 - DNA, 203 bp, Homo sapiens
  source 1..203: mol_type = other DNA
ggcgcgccagtccttggattccttcttgctcaacaggaacgcggaggagctcatgattccgagcttctaagcttacttctttcagagtagttagggaccgttgacgacagctccacgtatatgctcattacgcccactgcggaaacaatgtgatgctgtggtgtatacgtggtcaagctagcggcgtgcgactcggaccgatg

SEQ ID NO: 8367 - DNA, 203 bp, Homo sapiens
  source 1..203: mol_type = other DNA
ggcgcgccagtcctaacacgcgtcaggagatctccccagccaccatgggctaggttggcagccaggttttaacttggtggggagtaaaatagcctgctccaattcaaaattctgatacttctataatggattcttccgttactaacactggtggtttgatgccctcggctactatttccaattcagagcgactcggaccgatg

SEQ ID NO: 8368 - DNA, 203 bp, Homo sapiens
  source 1..203: mol_type = other DNA
ggcgcgccagtcctacccttacagaacaacaacttatcacaaattatgaacagccatcaattagacaaatttctttacctgatgacatagttaaaggttcctcttttattgcctccaaattagctaatattgcttatatgcgttgcgattatgagttgtatcttcgggtccagggttctccatttcttcgactcggaccgatg

SEQ ID NO: 8369 - DNA, 203 bp, Homo sapiens
  source 1..203: mol_type = other DNA
ggcgcgccagtcctcagggtcttctcttgctttggaataagatgaatgcggatcaaacttctaagattcgttcctcaattactgaacaccttcgctctattacttcttttcctggtgtcacacttaatatgcaatccgactcaagatctgttaagctagtaattccttatactagtgaatttcaagttcgactcggaccgatg

SEQ ID NO: 8370 - DNA, 203 bp, Homo sapiens
  source 1..203: mol_type = other DNA
ggcgcgccagtccttctaaggatcgtgatctttctaaagtttctccctatgagaatattcctgctaagggtttcacacatggtgttggttttgattatggtgtatccactttcgcttttcctgataacgctattgatcctactattgctaatcctgagtccattgatgagatgtctattcaatatttgcgactcggaccgatg

SEQ ID NO: 8371 - DNA, 203 bp, Homo sapiens
  source 1..203: mol_type = other DNA
ggcgcgccagtcctgcttctcggccgtatatgttggataggtataccatcaaaggtggaaatactccctcgccgtcaggtactgttgttgctgatatccctattagtcctgtcaattactctctctatggtagtattatccgtgattatagaaccatttttggtgctcctgtcagtctagctgttgcgcgactcggaccgatg

SEQ ID NO: 8372 - DNA, 203 bp, Homo sapiens
  source 1..203: mol_type = other DNA
ggcgcgccagtcctatggcttcatggtggcgagctaaaattcaccttaatcttcagttcgcaaagacacaataccaccagtgtcgtttacttgttcagtatcttccctatggttctgatgttcaatctcttgaaaatgttctttcccaaattattgatatatcccatgttgatgagagtggtattgatcgactcggaccgatg

SEQ ID NO: 8373 - DNA, 203 bp, Homo sapiens
  source 1..203: mol_type = other DNA
ggcgcgccagtcctttatgctttccttctattttcacaaataaatggatgcgttcttatgatcctgccactgaaggctacactgctgggtgcgcgcctggaagaattcttatttctgtgcttaatcctctaatttctgctagtactgttaatgatgacattgttatgatgccatggcttacttgggaacgactcggaccgatg

SEQ ID NO: 8374 - DNA, 203 bp, Homo sapiens
  source 1..203: mol_type = other DNA
ggcgcgccagtccttcttttcagatttccgctttgcgtcatggtgataaggtcacgataacagaggatcctactaagataaatgttagtggtgttagttttctcactggcaccaattcttggaaagctagtttgaaggatagttctggaactttgttaggacgcttagagtatgatggtacttcttttcgactcggaccgatg

SEQ ID NO: 8375 - DNA, 203 bp, Homo sapiens
  source 1..203: mol_type = other DNA
ggcgcgccagtccttctagtgattcacctgctagcttaattcctggtaagtataatgtggagcttgatcctgctgataattctgccgtagtcaccattgttgctaacaattcatttggaactgcttctcttgatacacatggtggtgggatggattatgctaaatcagattcttcttctttagttacacgactcggaccgatg

SEQ ID NO: 8376 - DNA, 203 bp, Homo sapiens
  source 1..203: mol_type = other DNA
ggcgcgccagtcctgcttaaatctcttaccttaagagtccactctctgagtggttaacccgtcgcgagacgcgtgggttgagttgtcatgacatttgtcagttgtgacgagtgtaactcaacagtttttcctaaccacgcgtcgcgtggcaggttttttaatctgagagttacattcctacccactaacgactcggaccgatg

SEQ ID NO: 8377 - DNA, 203 bp, Homo sapiens
  source 1..203: mol_type = other DNA
ggcgcgccagtcctctaaggttcctgacaatagctttatccggctatctagttacctaggtttacttttattagttgaccttaggagtgtaaccagtgtacacttgcttaccttaattggttggctaactagtcgctatgcattttcgtgcatatcggcggattcctaaaaaaaaaaaaaaaaaaaaacgactcggaccgatg

SEQ ID NO: 8378 - DNA, 203 bp, Homo sapiens
  source 1..203: mol_type = other DNA
ggcgcgccagtcctgcctgatagggtgccggcgggcgcggtacgtgtggtatagtccgctgtcttggggtatggcgtctactcggttttgttgtcgttttggaatgtcccatgtcggagatgtcgttaccggtgtttgctttacttgtgcacgaataagaaaacagagtttggagttttggaagttaacgactcggaccgatg

SEQ ID NO: 8379 - DNA, 203 bp, Homo sapiens
  source 1..203: mol_type = other DNA
ggcgcgccagtcctcatgagcaggctgcgttcttagagacacagtatcatcagttgacactatatccgcaccaaataattaacttgaggacaaccaatgcagccacgattgtggtcccgtataccaacatagcaccggcctcgttttacacgtgtcacaacacgtggaggttgatcataattcctcttcgactcggaccgatg

SEQ ID NO: 8380 - DNA, 203 bp, Homo sapiens
  source 1..203: mol_type = other DNA
ggcgcgccagtcctcctgcatttcccatctggacaccatcagaggggttcccactaccaggtaggatgacaaatttgattagtgtggcccgtataccaacatttttgcagggtacaggaggaaacacttatggtttttcggtgcagaacgcaatacctgctgacaacaccacattgtatagtttggatcgactcggaccgatg

SEQ ID NO: 8381 - DNA, 203 bp, Homo sapiens
  source 1..203: mol_type = other DNA
ggcgcgccagtcctgaagaggccatgctaggtacaaacatcatctgggattttgggttgcaatcaacgtgtacgtttgtgatcccgtatatttccatatcatctcgccggtttgcgaacacaacaggcaccattttctcatatgatggttatgtgaccgtttggtaccaaactgcggttgtatttgcgcgactcggaccgatg

SEQ ID NO: 8382 - DNA, 203 bp, Homo sapiens
  source 1..203: mol_type = other DNA
ggcgcgccagtcctgttgctcgccttgagctcaacgaaatgatctaccagcagcgtattgctgccatcctggaaagagcagtggatgatagtgatgatgaaggttctgagagtgatgctagtgacagtggatactattcgctggatagtatggggctgagtgatttaaccagtgattcagagtttgggcgactcggaccgatg

SEQ ID NO: 8383 - DNA, 203 bp, Homo sapiens
  source 1..203: mol_type = other DNA
ggcgcgccagtcctaagcaagtgttaggtattgtcacaaaattagttgccgtagtcacagccatcacacgatctggtggcgaccctgtcatcctggcctcgatgggtgctatgttatcagtagacctcatgaatgcgtgtccttttgaatgggcaaaacaacaagtggcccaactgatggaggtggagcgactcggaccgatg

SEQ ID NO: 8384 - DNA, 203 bp, Homo sapiens
  source 1..203: mol_type = other DNA
ggcgcgccagtcctaaacacctgtcaaactccaagaagagaccgcatgaaccaattggactgcttattcatggggctccaggcacagggaagagtcttgcgaccaaactaattgggacaaagttagcaaagaatttaggaaacatggaaccttattttatgccacctgacccgaagtattttgatggccgactcggaccgatg

SEQ ID NO: 8385 - DNA, 203 bp, Homo sapiens
  source 1..203: mol_type = other DNA
ggcgcgccagtccttatgctggacagcctgtggtggttatggacgatctaggacaaaacccggatggtgaggacatgaaactactctgtcagatgatatcgtgtgcagagttctacaccccccaagctgatctgcctgacaaagggaaaccttttacatcgtcctttgttcttgcttcaaccaacaaccgactcggaccgatg

SEQ ID NO: 8386 - DNA, 203 bp, Homo sapiens
  source 1..203: mol_type = other DNA
ggcgcgccagtcctatgcttgtcaccttacttaccacactttattttatctggaaatcattacctgcaaacccacagggtgcatatgatggcattatccaaaagaacctgagagtcccagaaaaacggaagattgaagtgcaaggccctgaccctgacacccaatatgccctgtcgctgatgaaacaccgactcggaccgatg

SEQ ID NO: 8387 - DNA, 203 bp, Homo sapiens
  source 1..203: mol_type = other DNA
ggcgcgccagtcctggacaggaaccagaggaacttgagatcgtgatagaacagtacgctgcccaactccagcccctgttgcccaaggatgtgcatgaacccatgactttgcaacaggtagtggagggatatgggcgtttagatggattagacctgaatacatctcctggttatccgtactgtacgcagcgactcggaccgatg

SEQ ID NO: 8388 - DNA, 203 bp, Homo sapiens
  source 1..203: mol_type = other DNA
ggcgcgccagtcctccaatgtggtttaaggccctggacaagctactgcaacgcttaggttttgacacggaagatctgatcataggcttgtgtaattcaacacacatttatgagaaccaactctatagaaccgttggtggcatgccatcaggttgttcagggacatcaatcttcaatactctcatcaaccgactcggaccgatg

SEQ ID NO: 8389 - DNA, 203 bp, Homo sapiens
  source 1..203: mol_type = other DNA
ggcgcgccagtcctttgtgccatctcatctggcacaacggtgaagagtcttataacaagtttattgccctggttcgtagcgagccagtggggagagcactacaactcccgccatataaacttttggagagagagtggttagataacttttattgacccggggccacgccgagtaggatcgagggtacacgactcggaccgatg

SEQ ID NO: 8390 - DNA, 203 bp, Homo sapiens
  source 1..203: mol_type = other DNA
ggcgcgccagtcctcaagcgtgacattggacagatgctcgacggactgaataagcggaaggcgaaacgtcggggggggagttgctcttggatcattatgttactcccgatagttgctgggctgaagcttggaaactataatggtagagttttggccactttaaataagactgatgtatcagacttgctcgactcggaccgatg

SEQ ID NO: 8391 - DNA, 203 bp, Homo sapiens
  source 1..203: mol_type = other DNA
ggcgcgccagtcctcaccccttcacggcatggacggaggtctaggagatcggtgaacgtgcatcaccatggagagagtctacttgaggccaagaacacgccgtggatggattcgaccaaagccactaaatatctcacgaaggttgagaactgggcgttgagaaatcctgggtatgctcttgctgccatcgactcggaccgatg

SEQ ID NO: 8392 - DNA, 203 bp, Homo sapiens
  source 1..203: mol_type = other DNA
ggcgcgccagtccttttcataggctggaatctgggaacgacgagaagccaaaagataattttcacaattatgttaatgttaattgccccagcgtacagcttcagctgtctggggatgcagaaccgagactttgttgagggagtgaatggtgttgagtggatcgatgtcgttctggaaggaggcccatgcgactcggaccgatg

SEQ ID NO: 8393 - DNA, 203 bp, Homo sapiens
  source 1..203: mol_type = other DNA
ggcgcgccagtccttgtgaccattacggcaaaagacaggccgaccatagacgtcaagatgatgaacatggaggctacggaattagcggttgtgagatcttactgctatgagccgagagtgtcggacgtgacgacagaatccagatgcccaaccatgggagaggctcataatcccaaggcaacttatgccgactcggaccgatg

SEQ ID NO: 8394 - DNA, 203 bp, Homo sapiens
  source 1..203: mol_type = other DNA
ggcgcgccagtccttaccatgaacacaaaaagctggcttgttaacagagactggtttcatgatctcaacttaccatggacagggtcatcagcggggacgtggcaaaacaaagagtcattgatagaatttgaggaggcccacgccaccaaacaatcagtggtggctttggcatcacaagaaggagccctcgactcggaccgatg

SEQ ID NO: 8395 - DNA, 203 bp, Homo sapiens
  source 1..203: mol_type = other DNA
ggcgcgccagtccttggcactgtcgtggtggaattgtcttatgcaggtaccgatgggccctgtagagttcccatatccatgtcggcagatctgaatgacatgacaccagttggacgcttgataacagtcaacccatacgtgtcgacctcctccacgggtgccaagataatggtggaagtggaacctcccgactcggaccgatg

SEQ ID NO: 8396 - DNA, 203 bp, Homo sapiens
  source 1..203: mol_type = other DNA
ggcgcgccagtcctttccattgggaaaggcattcatcaggttttcggctcagcatttaaaagcttatttggaggaatgtcatggactactcaaggcatgttgggggcactgctattgtggatggggctgaatgcaagggacagatccatttctatgacttttctagctgtaggaggaattttagtcttcgactcggaccgatg

SEQ ID NO: 8397 - DNA, 203 bp, Homo sapiens
  source 1..203: mol_type = other DNA
ggcgcgccagtcctcctggcagtaaatgtcaatgccgacacggggtgctcaatcgacttggctaggaaagaattgaaatgtggacaaggcatgtttgtcttcaacgatgttgaggcttggaaggataattataagtactatccatccacaccaaggagacttgccaaagtcgtggcagaagctcatgacgactcggaccgatg

SEQ ID NO: 8398 - DNA, 203 bp, Homo sapiens
  source 1..203: mol_type = other DNA
ggcgcgccagtcctggctggaatttgtggcatacgatcagtcagcaggctcgagcacaacatgtgggtaagcatcaaacatgagttgaacgcgatcttggaagacaacgccattgacttgactgtggtggttgaagaaaatcctggaagatacgggaaaactaatcagaggctgccgaacgttgatggcgactcggaccgatg

SEQ ID NO: 8399 - DNA, 203 bp, Homo sapiens
  source 1..203: mol_type = other DNA
ggcgcgccagtcctatggatggaaatgcgaacagaaaatacaactgattgtgacaccgcagtaatgggcacagcaattaaaggaaatagagctgtgcacagtgacctgagctattggatagagagcaagaataatggaagctggaaactggagagagctgtgctgggcgaggtgaagtcatgcacatgcgactcggaccgatg

SEQ ID NO: 8400 - DNA, 203 bp, Homo sapiens
  source 1..203: mol_type = other DNA
ggcgcgccagtcctaggaatcacgtacagtgatctggtcaagtacgtcattctagtggcagctgcatttgctgagagcaatacaggtggtgacattgtgcacttggccatggtggccgcttttaacatccagccaggtttactgattggattcctactgaggaggaagtggagcaatcaggaaagcagcgactcggaccgatg

SEQ ID NO: 8401 - DNA, 203 bp, Homo sapiens
  source 1..203: mol_type = other DNA
ggcgcgccagtcctaatagtggggatagatgtggtgagaataggtgtgctaaccctgggaatcctctcactattgaaagagaggagcaatgcaatggcaaaaaagaagggtggcatgctcctgggagtggcatgcgctaccgctggaatcgctagccctttggtgtttgctggtctgcacatggtgctcgactcggaccgatg

SEQ ID NO: 8402 - DNA, 203 bp, Homo sapiens
  source 1..203: mol_type = other DNA
ggcgcgccagtcctatggctagagaaagcgagcgacatctcgtggagtgaggaggcgagggtgactggagcatcacagagatttgatgtggaaattgatcaggacggtaatatgagattactgaacgatcctggtgtgtcgctcggtgtttgggcctttcgaactgggcttattctgttatcttcatacgactcggaccgatg

SEQ ID NO: 8403 - DNA, 203 bp, Homo sapiens
  source 1..203: mol_type = other DNA
ggcgcgccagtcctagtgggagtcatgcatgagggagtgtttcacaccatgtggcacgtgacgaatggggccgttattcaagcaggagaaggaacactggtcccatattgggcgagtgtacgcaatgatctaatttcctatggtggaccatggaaattggggaagcaatggaatggcgtagatgaagtcgactcggaccgatg

SEQ ID NO: 8404 - DNA, 203 bp, Homo sapiens
  source 1..203: mol_type = other DNA
ggcgcgccagtcctgctgctcacacctcagcgagtgccgaattacaacttgttcattatggatgaggctcacttcacagaccccgccagtattgctgccagaggatatatatcaacaaaggtggaactgggagaggcagctgcaatattcatgacagccacacctccaggtacaactgaggcatttcccgactcggaccgatg

SEQ ID NO: 8405 - DNA, 203 bp, Homo sapiens
  source 1..203: mol_type = other DNA
ggcgcgccagtcctgctaaataggaagagttttgactcagagtatcctaaatgcaagagtggagaatgggattttgtgataaccactgacatctcagaaatgggagcgaactttggagcgcaacgggtcatagatagtcggaagtgcattaaaccagtgattattgaggatggagaaggaagcgtgcacgactcggaccgatg

SEQ ID NO: 8406 - DNA, 203 bp, Homo sapiens
  source 1..203: mol_type = other DNA
ggcgcgccagtcctaatgaatggaccagttcctataacatcagccagtgcagcccagcgtcgtggacgggttggaagggatgtaacacaaattggagatgaataccactactcaggaccaaccagcgaggatgatcatgatttcgctcattggaaagaggccaagatactgctggacaacattaacatcgactcggaccgatg

SEQ ID NO: 8407 - DNA, 203 bp, Homo sapiens
  source 1..203: mol_type = other DNA
ggcgcgccagtccttcatcaagaaacctggagcatgccttggccggatttgagaccagcgacggcatgggcggcctacgcaggagctacaacatttctgactcccttgctaaaacacctcataataacagagtatgtgaacttttcactcatggcaatgacagcgcaggctggagcactatttggactcgactcggaccgatg

SEQ ID NO: 8408 - DNA, 203 bp, Homo sapiens
  source 1..203: mol_type = other DNA
ggcgcgccagtccttccgtcttggcattatgaccaagacaatccttacaagacttggaactatcatggaagctacgaagtgaaagccacaggctcagccagctcaatggttaatggggtagttaggatactgtcaaaaccttgggacaccttgcaaaacgtggtaaatatggccatgacggacaccaccgactcggaccgatg

SEQ ID NO: 8409 - DNA, 203 bp, Homo sapiens
  source 1..203: mol_type = other DNA
ggcgcgccagtcctggaatggaagccctcaaccggttggagaaactggcaagaagtacccttttgctcacaccatttccacgagctgcaaatgaaagatggcagaaagattgtggttccatgtcgagaccaggatgaactaattggaagagccaggctctctccagggtctggctggtcactaacagacgactcggaccgatg

SEQ ID NO: 8410 - DNA, 203 bp, Homo sapiens
  source 1..203: mol_type = other DNA
ggcgcgccagtcctaacagcacgcctgagcaaagcatacgctcagatgtggttattgatgtacttccacaggagggacctcagactaatggcaaacgccatctgctcatctgtccctgtctcatgggtccccacaggaaggacaacgtggtcaatccatggaaaaggtgagtggatgacttctgaagacgactcggaccgatg

SEQ ID NO: 8411 - DNA, 203 bp, Homo sapiens
  source 1..203: mol_type = other DNA
ggcgcgccagtcctcatttgtttgaagagataggaagaggaagtcaggccagggaatccctgccaccggatgttggatgacggtgctgtctgcgttccaaccccaggaggactgggttaacaaatctgggtgcatggaggagctaagcgttcaataccgtctcggagaactccctggctcacgaagtgcgactcggaccgatg

SEQ ID NO: 8412 - DNA, 203 bp, Homo sapiens
  source 1..203: mol_type = other DNA
ggcgcgccagtcctaaagaaagcaaggcccaacctagagtcaagctgtaactctaggggaaggactagaggttagaggagaccccttgcgagtgaacaccacaagaaacagcatattgacacctgggatagactaggagaccctctgtcctaacaacaccagccacttggcacagatcgccgaaagtgcgactcggaccgatg

SEQ ID NO: 8413 - DNA, 203 bp, Homo sapiens
  source 1..203: mol_type = other DNA
ggcgcgccagtcctcctttttgaggtgttcctctctaaggaaggccgccgtcggctcaatgtctttatttacacacacaacaaagctgcctggattgtgcgttccaaggttctggtgtcttcaagcaacaacatacaaaagatatctaaccgaggaattgcggcgtccaaaagcgacgtaggtgatcgcgactcggaccgatg

SEQ ID NO: 8414 - DNA, 203 bp, Homo sapiens
  source 1..203: mol_type = other DNA
ggcgcgccagtcctccatgaactgtccagtggcggtggcaacataactatgatcaactactatggtgcccaatactcccaggctcatgccaacccttctgttcaaatggacccagagaagttcacaaagcccctcactgatcttgctttagcggggactggtcctgcattgaaatcccccaatgtggacgactcggaccgatg

SEQ ID NO: 8415 - DNA, 203 bp, Homo sapiens
  source 1..203: mol_type = other DNA
ggcgcgccagtcctggaggctggttactcagataggatcatgcaaataaccgcaggcaactccactcttacaacacaggaagcagctcaggcgattgtgggttatggtgtttggccagattatgatgttggtgttgggcatgccattgacaaggaaacaaagcctggacctgctgttgagcggttttacgactcggaccgatg

SEQ ID NO: 8416 - DNA, 203 bp, Homo sapiens
  source 1..203: mol_type = other DNA
ggcgcgccagtcctcaccctcgatagcatttactggaaccaggattggaagggtcgcgtgattcgcttgcctggcgccctcactgaccttggtatgttcggtcagaactgccaattccacttcctcatgagatcaggattctgcgtccatgtgcaggtcaacgcctcaaaatttcaccaaggaatgttcgactcggaccgatg

SEQ ID NO: 8417 - DNA, 203 bp, Homo sapiens
  source 1..203: mol_type = other DNA
ggcgcgccagtcctttgtactcccgctgaaaatgccctgacacacaacttcgtgtctctatacattgttccaattgtcccactgaagttcgagaagggcgcatccacgaccatccctgtgactgtctccatctcgcccatgttcgcagaattctcagggctccgtaacagggtcgttgctcagggtgtcgactcggaccgatg

SEQ ID NO: 8418 - DNA, 203 bp, Homo sapiens
  source 1..203: mol_type = other DNA
ggcgcgccagtcctccctactttccagatacctggatctggacagttcgtaaccactatcaagaacgatggtttcccagcattgccccactaccaagagaccccgctccacttcatccctggtgaggtcacgaaccttcttgaagtctgccagattgacacttttgccaaccttgggacatctgagctcgactcggaccgatg

SEQ ID NO: 8419 - DNA, 203 bp, Homo sapiens
  source 1..203: mol_type = other DNA
ggcgcgccagtcctggctactggtaagattctcatcgcttacacaccaccaggcggagatgccccagcaacacgcaaggatgccatgctcgcgacccacgttgtgtgggatttggggctccagtcttcagttacattcacagtcccctacatctcccaatcacagtacagatataataacattgatggcgactcggaccgatg

SEQ ID NO: 8420 - DNA, 203 bp, Homo sapiens
  source 1..203: mol_type = other DNA
ggcgcgccagtcctgaacatcttctcatatgatggtttcatcagcatgttctatcaaaccaatatagttgttccccctggtgccccatcgacctgccaaattgtcctcctagtttctgctgcaaaggacttcaccctccgcttggctactgacagtgcttacttccagggcctcggcgaagaccttggcgactcggaccgatg

SEQ ID NO: 8421 - DNA, 203 bp, Homo sapiens
  source 1..203: mol_type = other DNA
ggcgcgccagtcctgaatcttgtcaatggttctgtgcaaactaccgcccagcaggtacttcgccccgctacaggtttagcttccgaagttcccaatactctttctatccacacaggcgagtcggggattctgactgcaccggaaacaggcgcctcctccaccactgaggctggggctatgattgagaccgactcggaccgatg

SEQ ID NO: 8422 - DNA, 203 bp, Homo sapiens
  source 1..203: mol_type = other DNA
ggcgcgccagtcctcaggtcagtgtctactatgtactctgccgcagagacttccatcgaggcatttatgtctcggtatgcaatgttctctgccttcgaccttcgcactggttcaactgctgcgaacggcgaatacagaatcctggacctccgcttctcggaggaatcatctacacacaaggcccttgtcgactcggaccgatg

SEQ ID NO: 8423 - DNA, 203 bp, Homo sapiens
  source 1..203: mol_type = other DNA
ggcgcgccagtccttgcaaagtatcgcatgttcacctaccttcgtatggggtatgatgtggtcgctattgtctccccaaaggcaaacatcagggaccgcgtccatatgtcatcaccgcccaaatttcagatgatgttcattccccctggttgcccagcaccccgtcttgtagatggtccggagtggtacgactcggaccgatg

SEQ ID NO: 8424 - DNA, 203 bp, Homo sapiens
  source 1..203: mol_type = other DNA
ggcgcgccagtcctcctccccaccacccccagtgtctatttctctgtggaccaacccccggcatccctacggctaccatacatgggcgttatgtccacctttgcctcccgttatgatggcttctattcattccagacaaccaatcctcatagctacggttacttcccaggcaatgacattggcaagctcgactcggaccgatg

SEQ ID NO: 8425 - DNA, 203 bp, Homo sapiens
  source 1..203: mol_type = other DNA
ggcgcgccagtcctcatcttcccggtctcccgaactgatttcatcgccccattccaccttttcaacaacagacttgtttttgcaccatatggtgatgatgacttcctccagatcccatacacggcagtgaggtgtgaccttgaacatgatttggtcctggggcgcatggggaagccaattttcacccgcgactcggaccgatg

SEQ ID NO: 8426 - DNA, 203 bp, Homo sapiens
  source 1..203: mol_type = other DNA
ggcgcgccagtccttttgtgtggctcccctctcctgacgcgtgatggcattgtggctatggccacagcaggcagtgactcagttagttatttcacaaacctccaccttgtggagtggctcaatgtggagcccttagccgaagaacagggcatttcagattggttcagtgactttgcctcacaactgggcgactcggaccgatg

SEQ ID NO: 8427 - DNA, 203 bp, Homo sapiens
  source 1..203: mol_type = other DNA
ggcgcgccagtcctatgtggaaagatgcgccaactcaaactgggcgctgatatctacggggtgcagcgaaaccaggccacacatcagattgtcaagtattaccaaaaggctatgtctatacttcaggcaatgacccaagggcgctccgaaccggtggcgcttttggtacacggcaccccaggaacaggcgactcggaccgatg

SEQ ID NO: 8428 - DNA, 203 bp, Homo sapiens
  source 1..203: mol_type = other DNA
ggcgcgccagtcctgaagagcttagccacagaaattattggcagggccctcacgcagaagttgggtggcaacaggccatactctctcccacctgacccaaaacactttgatggttacgcccagcaacctgtcgtcatcatggatgatgttggtcaaaaccctgacggcgaggatctcaaactcttctgcgactcggaccgatg

SEQ ID NO: 8429 - DNA, 203 bp, Homo sapiens
  source 1..203: mol_type = other DNA
ggcgcgccagtcctggttgataccgactataaaaggaatgacaagcttactgcaaacactgcacttgacaggtgcaaccatcctgcaaccaactttaagcactgctgtcctcttatctgtggtaaggccatccgtctcaaggacatgaggacaatgaagatgttcacactcgatgaggtggtgtcaatcgactcggaccgatg

SEQ ID NO: 8430 - DNA, 203 bp, Homo sapiens
  source 1..203: mol_type = other DNA
ggcgcgccagtcctgctctacgcggagcatctaaaccgccaggggtgcggttctaagctcgaggcaatcttccaaggccccggcactaatgacatcatttcgtgtgaatggaatgctgaagcaaagaggaggggcgtcgctctcgtcacagaggatgagtggtttgagactgactacgacaaagaagacgactcggaccgatg

SEQ ID NO: 8431 - DNA, 203 bp, Homo sapiens
  source 1..203: mol_type = other DNA
ggcgcgccagtcctttcaacaatggactggatcaagaaactttcctacggtctctccatcttgtcatccctcaccgctgtctgtggcttcatttacatgctttacaagatttttgcctcggttcagggcccctacacaggaactgcccaaaagacactcaagaagcctgaactcaagcgcaaagctgtcgactcggaccgatg

SEQ ID NO: 8432 - DNA, 203 bp, Homo sapiens
  source 1..203: mol_type = other DNA
ggcgcgccagtccttgaagtggacctcgatgaggcgatgtttgccaagcacaagggtaacacagacattcccattgatgaagagcttgggattgccatagaccactacacagagcagattagaccccttatgcccattaaccttacagaacctttgacaatggaggaggtcgtctatgggacagataacgactcggaccgatg

SEQ ID NO: 8433 - DNA, 203 bp, Homo sapiens
  source 1..203: mol_type = other DNA
ggcgcgccagtcctccttgaggggcttgacctctcaacctccgctggatttccatatgtcattaagaacaccaggaagagggaccttattcctgagcgtggccaacccttaacaaaattgcttgatgcccttgacctctatggctacgacctcccgtatgtcacataccttaaggatgagctcagacccgactcggaccgatg

SEQ ID NO: 8434 - DNA, 203 bp, Homo sapiens
  source 1..203: mol_type = other DNA
ggcgcgccagtcctaattgacaaagtcaggaaggggaagacccgcctgatagagtgcagttccatgaatgacacaatcaggatgaagaccacttttggtcgcttgtttcagactttccatgcaaatccaggtaccgtcaccggatcagctgttggttgcaacccggatcttgactggagcaaattctacgactcggaccgatg

SEQ ID NO: 8435 - DNA, 203 bp, Homo sapiens
  source 1..203: mol_type = other DNA
ggcgcgccagtcctcgtgtatgaggttgagggaggtatgccttcaggatgttctgggacatccatcttcaattcaatcataaataacctcataattaggacacttgtgttgaagtcttataaatcaattgacttggatcgcctgcgcatcattgcgtacggtgatgacgtgattatatcttaccctcacgactcggaccgatg

SEQ ID NO: 8436 - DNA, 203 bp, Homo sapiens
  source 1..203: mol_type = other DNA
ggcgcgccagtcctccagctggatgctgctgcactcgcggagtgcggcaaggattacaatttgacaatgacacctgcagacaagtcagacacattcaatgaggtaacatgggacaacgtcacctttcttaagcgacgatttgttccagacaagcacttcccattcttggtccaccccgtcttcccaatcgactcggaccgatg

SEQ ID NO: 8437 - DNA, 203 bp, Homo sapiens
  source 1..203: mol_type = other DNA
ggcgcgccagtcctcaagcaccgtctgggaagatgttccgctgtggctgccaaacctggtaacaggtgccccagtgtgtgtagtcttcctccagtctccggactggcagtcttgtgtaaagatgcagtgtaaggttcaagtgccaaatccctggaaggagtgaccctctactgccctaggaatgctgtcgactcggaccgatg

SEQ ID NO: 8438 - DNA, 203 bp, Homo sapiens
  source 1..203: mol_type = other DNA
ggcgcgccagtcctgcaggtacccccaacttcggttggggatctgagcacaggctaattgtctacgggtagtttcatttcccatcctctcttttttggcatcatggcgaacacacgggtttcacgatctgtgctctccgctgttgccaaaacttctacccacagagtctatcacacagttcttgactgcgactcggaccgatg

SEQ ID NO: 8439 - DNA, 203 bp, Homo sapiens
  source 1..203: mol_type = other DNA
ggcgcgccagtcctctatgacaggctctacctcaattcctacccccaaatgctctaccccctaccccgctcaccctctttcccttgccccttctgcatgtatgatgaagacctggaatttctctcacccgagtcgctctgcggcgagggcgctgagccatgttggaagtgcatgtcaaagtccccccgcgactcggaccgatg

SEQ ID NO: 8440 - DNA, 203 bp, Homo sapiens
  source 1..203: mol_type = other DNA
ggcgcgccagtcctcggagcgctccaacaacttctcaaatttccccacctctcccccgcacagatgcccctcgccgtgaaacaactcaaacggcaggggaattctgtcaccaacatctacggcaatggtaacaacgtcactactgacgttggtgccaatggctggtcccccaccgtgtccactggactcgactcggaccgatg

SEQ ID NO: 8441 - DNA, 203 bp, Homo sapiens
  source 1..203: mol_type = other DNA
ggcgcgccagtcctcggtgatgcccctgtctctgcatcagcagacaccatccccggtcgctccgggggtgcgtcttctgacaaaactggatctgtttcagtctcctcaggcaacaaggtgggctcccgcttctccaagtggtgggagccggctgccgcgcgcgctcttgagcgtgcgaccgatgccaccgactcggaccgatg

SEQ ID NO: 8442 - DNA, 203 bp, Homo sapiens
  source 1..203: mol_type = other DNA
ggcgcgccagtcctctccctggaatccccttccttccccatctccacagaatccaattggggcactcaatctggccaagccccgactgcctatccccttcccttttctttcgtgcgtgcgtacccggacaccccctgggctgccatgtacgacacccactccatgtggaattgtggttggcgtgtgcacgactcggaccgatg

SEQ ID NO: 8443 - DNA, 203 bp, Homo sapiens
  source 1..203: mol_type = other DNA
ggcgcgccagtcctggtcaccgtcaacggttcgcagttccacgctggagccctcatcctttacatggtcccggaagcgactactcaaaccatcgagtcatctcgtcgcaatgccgggttcgtgtacccctatgtcatcctcaacctctatgagagcaacactgctaccattgaggtcccctacatttccgactcggaccgatg

SEQ ID NO: 8444 - DNA, 203 bp, Homo sapiens
  source 1..203: mol_type = other DNA
ggcgcgccagtcctggcagatgaaccaggcgaacgcctggcgatccttcctgtctccccttctgccattgctggcacaggtactcccatatcctatgtcctctctctcttctcccaatggcgcggtgagctcgccgcccaccttctcttcacaggttcttcccagcactatggccgcttggtcgtgtgcgactcggaccgatg

SEQ ID NO: 8445 - DNA, 203 bp, Homo sapiens
  source 1..203: mol_type = other DNA
ggcgcgccagtcctccaagttccccttgaccccatccactggcaaagtgacgccgatgtctccggcctcactgctatgctttcctgtttcacctatatctctgctgatctccgcatcaccttgcggatttctaaccccaatgggctaccaatctccctcatggtggcctttgccccccctggatcaaccgactcggaccgatg

SEQ ID NO: 8446 - DNA, 203 bp, Homo sapiens
  source 1..203: mol_type = other DNA
ggcgcgccagtcctgaagactgttgccatcgtgcggcaaggcgctcgccacacccttggtgacgtcccaccagacgacacagtctacatcatccgtgcgcgtagaccaacttacgtgcactgggccctccggaaagtcactcctgatggaagtgccaaacaaatttccctttcccgtgaaggcctcaccgactcggaccgatg

SEQ ID NO: 8447 - DNA, 203 bp, Homo sapiens
  source 1..203: mol_type = other DNA
ggcgcgccagtcctcgccgtggtcgcatacgaaccatgtgaaggtgagatctatcgggaagtcccactctcctcctggtccattgccgaacttcaactcggcagcccgtgggattacagtgccaccaacaactgtacgcacttcgtccaacgggccaccaatgtggatctccccaacaccggcttctccgactcggaccgatg

SEQ ID NO: 8448 - DNA, 203 bp, Homo sapiens
  source 1..203: mol_type = other DNA
ggcgcgccagtccttctcacctggctcgccaaaatcttcggctatctccttgtcctctttggttccccctccccaatgtccatctctggacttctagtcatcatctgtgctgatcttgccccccatgcccgggatttcttcactgcctcgggcaatgtcctctcctccctccacttctggatcgcgaccgactcggaccgatg

SEQ ID NO: 8449 - DNA, 203 bp, Homo sapiens
  source 1..203: mol_type = other DNA
ggcgcgccagtcctgttcctgaaccaatccctcagaaattacaccttggccctttctcaacaccgcaagcgccaggtcggcccccgaccggaacccgtggtggtctacctctacggaccccccgggaccgggaagtccctcttggccgccctccttgcccaaacccttgcccaacgcatatccggtgacgactcggaccgatg

SEQ ID NO: 8450 - DNA, 203 bp, Homo sapiens
  source 1..203: mol_type = other DNA
ggcgcgccagtcctagaaaaaggtacacattacacttctcgtgtcattgtgattacctccaacttccatgagcccaatgagcgcgcagcgcgctcgatgggagccctcaagaggcgcgtccaccttcggatcaacgtcacctccaatggcgtgaggtttgacccggtgaacgcgctcaacccaatccccgactcggaccgatg

SEQ ID NO: 8451 - DNA, 203 bp, Homo sapiens
  source 1..203: mol_type = other DNA
ggcgcgccagtccttggaacccaatccaaatacttcacctctcaaacccctctcacccttttccaagccaacgtggtccgcttggaccgcgattcaatctggacaccctccttctccaacatggacgagctcgtggacgctatcatggcgcgcatggaccgttcatccggtgtttcaaattctcttgccgactcggaccgatg

SEQ ID NO: 8452 - DNA, 203 bp, Homo sapiens
  source 1..203: mol_type = other DNA
ggcgcgccagtcctctccctcatcaagcgtcagggcaaccgcgtggtcgaagcaactccccgggaaatccccgaggagtatgctgacgagctcgtggaagccttggcacaccacagggctgtaccctgttccctctccctctcccacgccatctccaacaacaccccccttgaaaccatctcccagaccgactcggaccgatg

SEQ ID NO: 8453 - DNA, 203 bp, Homo sapiens
  source 1..203: mol_type = other DNA
ggcgcgccagtcctcctctggcgctacaggaaacccatcttcgccgccaccaccttcctggcggtggtcggattcctttgctccatcatccccctcgctagatcaatctggcagggccgcgaagactcttcctcgcagccccaagcggcgtactcaggtgtgccgcaccaaaagtcaaaacccaaaaccgactcggaccgatg

SEQ ID NO: 8454 - DNA, 203 bp, Homo sapiens
  source 1..203: mol_type = other DNA
ggcgcgccagtccttcccaaacccatccccacccaacatatccagcgccaggggatctctcccgcaatccctggcatttcccagaatgtcgttcacgtcgagtccggaaacggcctcgagaagaatgtcatgtctggcttctacctcttctcccgctacctacttgtccccacccacctacgtgagcccgactcggaccgatg

SEQ ID NO: 8455 - DNA, 203 bp, Homo sapiens
  source 1..203: mol_type = other DNA
ggcgcgccagtcctccaccacaagaccctcctcgtgggcgttgacgcctacgattgggccaccctccctaccctcgagcttggtgagctcaccctagtccataccccaacctctcgccagtacaaggacatgcgccgcttcatcggcgcacacccctatcccactggccttcttgtctcccaacttaacgactcggaccgatg

SEQ ID NO: 8456 - DNA, 203 bp, Homo sapiens
  source 1..203: mol_type = other DNA
ggcgcgccagtcctatcagccccgctctatgtccgcttctccggcaaccgcgtgcttgacatgaacttccccggtgccatcgtctgtgagcaggcgtacggctaccacgcagctacctttgaaggtctgtgtggtgccccgcttgtcacggacgatcctgccggggtcaagatccttggattgcacgtcgactcggaccgatg

SEQ ID NO: 8457 - DNA, 203 bp, Homo sapiens
  source 1..203: mol_type = other DNA
ggcgcgccagtcctggccggagtggctggtacgagtggtttctcagcccccctccataccattctccctgaaatcctcagatttgccactacccaccaatccctcatcatccccactggagaggcgaagcccggagtcaacatcaaccggaactcgcgcctccgtccctctcccgcctatggtgccttcgactcggaccgatg

SEQ ID NO: 8458 - DNA, 203 bp, Homo sapiens
  source 1..203: mol_type = other DNA
ggcgcgccagtcctcgttctcacccaggaacaggcgatccatggaacccccaacatggaagggcttgatatggggcaggctgcgggtttcccatggaatacccaaggccggtcccgtcgatcgctctttgatgaacctgaacctgggtactttgtccccaaacctgaactccaggtagagattgaccgcgactcggaccgatg

SEQ ID NO: 8459 - DNA, 203 bp, Homo sapiens
  source 1..203: mol_type = other DNA
ggcgcgccagtcctttcccacggtagtgcggttggttgcaaccctgacgtccactggaccgagttcttctacaagttctctgagttctcacaagtgtttgatctggactacaagtgctttgatgcaactctgccttctgctgccttctcccttgtggctaaacacctggagcgcctcaccggtgaccccgactcggaccgatg

SEQ ID NO: 8460 - DNA, 203 bp, Homo sapiens
  source 1..203: mol_type = other DNA
ggcgcgccagtcctccgtgttgtgaaatacatcgaatccatccgccattcccatcacatctatggcaaccagatgtatgacatgatcgggggaaacccctccggatgtgtggccacttccatcctcaacaccatcatcaacaacatctgcgtgctatcggccctaatccagcacgtggacttttcccccgactcggaccgatg

SEQ ID NO: 8461 - DNA, 203 bp, Homo sapiens
  source 1..203: mol_type = other DNA
ggcgcgccagtccttaccaaatttcagatcctcgcgtacggtgacgacgtcatctacgcgacggaacccccaatccacccctcctttatcagagacttctaccagcgtcacaccccgctggtggtcacccctgctaacaagggctctgatttcccccccacgtccacgatctatgaagtcaccttcctcgactcggaccgatg

SEQ ID NO: 8462 - DNA, 203 bp, Homo sapiens
  source 1..203: mol_type = other DNA
ggcgcgccagtcctcaaacgctggtttgttccagatgacaggcgcccattctacattcaccctgtgatggaccctgacacctacgagcaatcagtgatgtggttgcgtgatggagactttcaagacgtggtcacctcactctgtcatttggccttccacagcggacccaagacatatgagcgttggtgcgactcggaccgatg

SEQ ID NO: 8463 - DNA, 203 bp, Homo sapiens
  source 1..203: mol_type = other DNA
ggcgcgccagtcctcatgaaagtgcgcgagcagtgcctcaagtctgggttcgctccaaatttcctcccctactcttacctccaactccgctggcttaatatgctggcagcctgatagttagggaacccaaccacggtggaatacccgtggtgctagttagttagaaccctttactctcctccatggtgcgactcggaccgatg

SEQ ID NO: 8464 - DNA, 203 bp, Homo sapiens
  source 1..203: mol_type = other DNA
ggcgcgccagtcctatataaagaccacccacaatctttcgggtgagcccctaagccatggttgtactgtgctatcttctaagacgtcctccctctggacgcactttccccccggtgccgcgcctcccctgggagctgcacccggggaccggggtagtctttgaacttttctaactgttcttaaaaaaacgactcggaccgatg

SEQ ID NO: 8465 - DNA, 203 bp, Homo sapiens
  source 1..203: mol_type = other DNA
ggcgcgccagtcctgaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagccccgactcggaccgatg

SEQ ID NO: 8466 - DNA, 203 bp, Homo sapiens
  source 1..203: mol_type = other DNA
ggcgcgccagtcctttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctacgactcggaccgatg

SEQ ID NO: 8467 - DNA, 203 bp, Homo sapiens
  source 1..203: mol_type = other DNA
ggcgcgccagtccttgactcataataattggacaatatatattacacctgttgtgccattggattatgtcaccggctcctccaccaatgttcctgttacaatttccattgcaccaatggcagcctctttttctggtttgcgcaatgctgttcaacctagttttagtgttcatacgcagggtgttcctgcgactcggaccgatg

SEQ ID NO: 8468 - DNA, 203 bp, Homo sapiens
  source 1..203: mol_type = other DNA
ggcgcgccagtcctctgtttcctttacattggatgtttctaataatagtgtgtcaaatgctgccatagcccattgggatatggacatgggaagcgtgctgttttcaaccacctacatggcaaggtgtgccaaatggtactcccagcatcgtggagggatacgtgtgaccttcatgttctgtggctcagcgactcggaccgatg

SEQ ID NO: 8469 - DNA, 203 bp, Homo sapiens
  source 1..203: mol_type = other DNA
ggcgcgccagtcctccatggcaactggcaagttgcttcttgcattcacaccacccggcggttcggcgccagccacccgcagggacgcaatgcttggcacacatgagatctgggatttgggcttgcaatcctccatcacactcgttgttccgtggatctcccagacggcttatcgctttaaccaaccttcgactcggaccgatg

SEQ ID NO: 8470 - DNA, 203 bp, Homo sapiens
  source 1..203: mol_type = other DNA
ggcgcgccagtcctttggcgatgaacttggcaaagtcatcactgaagcagcccaacatgccctgcagcccctagatgttaaacctgtcaacggacccagcgtcccagctggcctgtccattcaggttggtgatgcatctgcactaacagcccccgagactggggcaacggctgcaacagaagcaccctcgactcggaccgatg

SEQ ID NO: 8471 - DNA, 203 bp, Homo sapiens
  source 1..203: mol_type = other DNA
ggcgcgccagtcctctactccttgtgtgtatcaaaagtcaagtgctgatgcccccatttctttgcgacttccctttatgggcccagcctctgcttattgtgtgacctatgatggatatcccaattatcgtattggacaaaaatatggtgagtttcctggaaatgattttggtacaatttgttttagatcgactcggaccgatg

SEQ ID NO: 8472 - DNA, 203 bp, Homo sapiens
  source 1..203: mol_type = other DNA
ggcgcgccagtcctttatcaatttgacgggcggtaaccaagtgcaggatattaaacatcgcattttgatgcttgcccgacccacccaggtctccgccttttgcccgcgaccaattgtttcacttgcgcaacatcgacctgctgctgttaccaatgggagaattgcatatgttagggatggacctgatgcgactcggaccgatg

SEQ ID NO: 8473 - DNA, 203 bp, Homo sapiens
  source 1..203: mol_type = other DNA
ggcgcgccagtcctatgttgttccagaaggtgatggaaccgatagggttcttagagcagcaaattgtgggccccgtctgaaggtcggaaagagaatgaatccagagtgctgccctccccatttgtacagattttttgaggattgttatcagtgctgggatgttgataatgaagtttctttccattgctcgactcggaccgatg

SEQ ID NO: 8474 - DNA, 203 bp, Homo sapiens
  source 1..203: mol_type = other DNA
ggcgcgccagtcctttcctctttcccctcgtgagtgcttgattcctgctcatctttatgttgctgatcttgtgttttccaagcatattgctgggcccagggcagagataccctatcgaaagaagtgggctgattataccatggatttggtttgcttggaacttgctgaagattattttcaaaccattgcgactcggaccgatg

SEQ ID NO: 8475 - DNA, 203 bp, Homo sapiens
  source 1..203: mol_type = other DNA
ggcgcgccagtcctaaggtctccgtgatatgatgaatgatgttgcccgtgagctgggtcacagctttggtgattccaccatgactggtgtggcaaatgtgattgaagatgctgtcaagcagtatacctttaataaagccaatgcacaaatgtcttatgttaaacagattattaagtggcttgtgaaggcgactcggaccgatg

SEQ ID NO: 8476 - DNA, 203 bp, Homo sapiens
  source 1..203: mol_type = other DNA
ggcgcgccagtccttccagtcattgacaaaaggtcggactgagcccgttgccatgcttgtccatggcacacctggctccggcaaatcccttgccacagaaattgttggccgcctgctttcccaaaggtatggcggctcccgaccctattcattgccaccagaccccaaacattttgatggatatgccccgactcggaccgatg

SEQ ID NO: 8477 - DNA, 203 bp, Homo sapiens
  source 1..203: mol_type = other DNA
ggcgcgccagtcctttagacctcccactgtgtcagaaccccaagcccttaagcgtagattttttgtggatgttaatattgaagttcagaaggattatatggttcaaaatggtaaacttgctgctgatgttgccttgaccccctgcaatcatcaggcagcaaattttaaggtttgctgtcctatgatttcgactcggaccgatg

SEQ ID NO: 8478 - DNA, 203 bp, Homo sapiens
  source 1..203: mol_type = other DNA
ggcgcgccagtcctagagtgattatgataggatgcctcctgtgcttaagacgtatgaagaattgagaaaggaagggattgaaaggcctgcgccaaaagaagtgcttgacttggttcgtgctgtgcccaccccagaggtttttgattattgtcgggttcagggttggatgctacccgttgaggtcagaccgactcggaccgatg

SEQ ID NO: 8479 - DNA, 203 bp, Homo sapiens
  source 1..203: mol_type = other DNA
ggcgcgccagtccttgcgtcgggttgtcaagacacaaggacctgacatggaatttgtcaataagctgttcaagcagagcattttctccgtgaagacggagaaagggtggttctctggcttgggcttacactctcagtggcttttgcttcccaaacattctgagcctggatatgagattgagatgaatgcgactcggaccgatg

SEQ ID NO: 8480 - DNA, 203 bp, Homo sapiens
  source 1..203: mol_type = other DNA
ggcgcgccagtcctttaaagatgaattaagacccaagaagaaaattgcagctgggaagtcaaggctgattgagtgttcatcactcaatgataccatccgcatgaagcgggtctttggccacctcttccaaacctttcacgcaaatcctggtaccgtgactggctctgctgttggctgcaatcctgatgcgactcggaccgatg

SEQ ID NO: 8481 - DNA, 203 bp, Homo sapiens
  source 1..203: mol_type = other DNA
ggcgcgccagtccttcgttccggatgaggagtttccttttctgattcatccctgctttccaatgaaggaaatttacgagtccattcgttggtctcgttctgctgcagcaactgaagaacacgttcagtcattgtgttatcttgcctggcacaatggccgttctgtgtatgaggattttattgagaagacgactcggaccgatg

SEQ ID NO: 8482 - DNA, 203 bp, Homo sapiens
  source 1..203: mol_type = other DNA
ggcgcgccagtcctttcgcactgtgcctgttggtagagccttgaaactcccttcgtacagtgtactgcgccagcaatggcttgatcagttttaagtagttaattgctagtgtagtttttaggcttaagtttagttgttaagtttaagcagtttgttatagtaagttaagtttaggtttaagttagtgtcgactcggaccgatg

SEQ ID NO: 8483 - DNA, 203 bp, Homo sapiens
  source 1..203: mol_type = other DNA
ggcgcgccagtcctgataacccctgaccgggtgtgtaggataggaaaggtgcccactgtgggcgacaggttatggtagagtggatacctagccaggggcaatgggactgctttgcatatccctaatgaagtattgagatttctctgctcattacccggtgatggttgtgtggggggggccccatacaccgactcggaccgatg

SEQ ID NO: 8484 - DNA, 203 bp, Homo sapiens
  source 1..203: mol_type = other DNA
ggcgcgccagtccttagatccatactgcctgatagggtcgcggctggccgaccataacctgtatagtcagttgaattcagccaagatgtgtttctttttccacacaaagaccaacgatattagcccaatgacaagaaagacttctgttgaacgcctcatgtccccagggcctaagtgcctagacatggcgactcggaccgatg

SEQ ID NO: 8485 - DNA, 203 bp, Homo sapiens
  source 1..203: mol_type = other DNA
ggcgcgccagtcctgtggtaatattacgcagataaattactatggttcagactatgcgtcggctcatggtgctgcacagacccgcctagatcccgattctctggcacgacccttggctaaccttgctgatatgactggtcccgcattaaaatctcccacagtggaggaggctggcttctctgatcgcacgactcggaccgatg

SEQ ID NO: 8486 - DNA, 203 bp, Homo sapiens
  source 1..203: mol_type = other DNA
ggcgcgccagtcctcaagaaccggtcttggctacggaataaagctgcctgcagctcttacagacttaggagtttttggtcagaattgccaatttcattttctgtgtcatactggttactgcgtccacgtgcaagtgaatgcatcgaaattccatcagggtatgctgttagtctgcgccatacccgattcgactcggaccgatg

SEQ ID NO: 8487 - DNA, 203 bp, Homo sapiens
  source 1..203: mol_type = other DNA
ggcgcgccagtcctgtaaagttgatgggagagataatgctactgtttataatttggaagcaaaagatcttgaagattatccaaggtttcaattgactctttatcctcaccagtttataaacctgagaacaaataattctgcaacccttatactcccatatgttgctgcatcacctgctgaatccccaccgactcggaccgatg

SEQ ID NO: 8488 - DNA, 203 bp, Homo sapiens
  source 1..203: mol_type = other DNA
ggcgcgccagtccttcacccataataattggactgtttatgttacatatatagtggagctttcatatatgaatgggtcctcaacggaagttccaattacagtttcagtggcacctatgtcatgctcatttagcgggttgcggtctaaggttacacgccctgaacatcaaggggtaccagtgtttgaagcgactcggaccgatg

SEQ ID NO: 8489 - DNA, 203 bp, Homo sapiens
  source 1..203: mol_type = other DNA
ggcgcgccagtcctttcccgggtctggacagtttgtaacaacaatacgtaattcggggtttcctattttaccggattatgaggagaccccaaaccatggcattccaggccgtgtgagaaaccttatggaagtgtgtggggtggacacgttttgtaactgtgcgacctccaccaccactgatgaacaaccgactcggaccgatg

SEQ ID NO: 8490 - DNA, 203 bp, Homo sapiens
  source 1..203: mol_type = other DNA
ggcgcgccagtcctcaggcaagctgctgttggcctacacccctccagggggagcagctcccgccacacgcaaagaggcaatgcttgggacacatgtggtgtgggatattggattgcagtcatccattacaatggttgttccctgggtttcccaaacagtatataggtataatcatccaaaagaagaaacgactcggaccgatg

SEQ ID NO: 8491 - DNA, 203 bp, Homo sapiens
  source 1..203: mol_type = other DNA
ggcgcgccagtcctatatgttcacctatattaggtgcgcctttgatttggtcatagttacatctgtaaatggttcttctggcgcaaagaatggcctacccatggttcaggccctctactgtcctcctgggtgtccaacgcccactaaccaagacactatggagtggtatcttccgaccacccctagtgcgactcggaccgatg

SEQ ID NO: 8492 - DNA, 203 bp, Homo sapiens
  source 1..203: mol_type = other DNA
ggcgcgccagtccttgattcccggtcatctttatgttgctgatcttaagtttcagaggacaaatggtgcttatccccatgagattccctataggaagaagtgggctgactggacaatggacctggtttgcctgcagctggaccgcgatttctttgaaaccagagtgcatctgtgtaagaggcaatgctcgactcggaccgatg

SEQ ID NO: 8493 - DNA, 203 bp, Homo sapiens
  source 1..203: mol_type = other DNA
ggcgcgccagtcctgtaagaatacatggactgtctgtgatacaactgagcataatgttgcaatccgctgtggggatgcaacttttcaaaaggatgtttgggttgatggtcctgtcacatctagtggacattggcaaagaaatttgttacgtgttgagatccccatccgtcctggccattgtggtagcccgactcggaccgatg

SEQ ID NO: 8494 - DNA, 203 bp, Homo sapiens
  source 1..203: mol_type = other DNA
ggcgcgccagtcctaacctgtggcagttttgattcatggggctcctggtttaggtaagtcattagtgacagaagttgtcggacgacaattgtcacgctactatggagctggacggccctactcattgccacctgatcccaagcattttgatggttatgcccagcaacctgttgtgattatggatgatccgactcggaccgatg

SEQ ID NO: 8495 - DNA, 203 bp, Homo sapiens
  source 1..203: mol_type = other DNA
ggcgcgccagtccttgggacaaaacccagatggagaagattgtaagctgctgtgtcaaatggtatcctcaacagagtttataacccctatggcttctttggatgacaagggaatgccttttacatctgattttgttcttgcgtcaactaacctgtcagcccttaaaccacccactgtgtcagagccgacgactcggaccgatg

SEQ ID NO: 8496 - DNA, 203 bp, Homo sapiens
  source 1..203: mol_type = other DNA
ggcgcgccagtcctatgctattcgacggcgattcttcattgatgctgccatcgaaccctcaaaggattaccttaaaccaagtgggcatcttgatgcggatacttcgcttacccaatgtgatcatgctgctgtgaattttgcaaaatgttgtccccttatttgtgggaaagccctggttttgaaagatccgactcggaccgatg

SEQ ID NO: 8497 - DNA, 203 bp, Homo sapiens
  source 1..203: mol_type = other DNA
ggcgcgccagtcctatatggagtttgtaaataagctatttaagcagagcatcttttctgttaagactaagaagggctggttttctggacttggcttgcatactcagtggcttttacttccgaaacactctgaacccgaggatgttatagaaatgaatgatgtagagtataagtgtttagatatagtgacgactcggaccgatg

SEQ ID NO: 8498 - DNA, 203 bp, Homo sapiens
  source 1..203: mol_type = other DNA
ggcgcgccagtccttagccttggggaaatctaggcttatcgagtgttcctcattgaatgataccatcctgatgaaaagagtatatggccgcttgtttcaaacattccatgcaaatccaggaaccattacaggatcagccgtggggtgtaacccagatgtggattggtcaaagttttatgcggagatggcgactcggaccgatg

SEQ ID NO: 8499 - DNA, 203 bp, Homo sapiens
  source 1..203: mol_type = other DNA
ggcgcgccagtccttccttgtccatccctgttttccaatgaaggaggtttttgaatccattcgctggtgcaagtcagcggccgcaactgaagaacatgttcaatcgttgtgctatttagcctggcataatggagagcatgtgtataatgattttcttgataagattcgctctgtgcctgtaggtagagcgactcggaccgatg

SEQ ID NO: 8500 - DNA, 203 bp, Homo sapiens
  source 1..203: mol_type = other DNA
ggcgcgccagtcctgaaattcaaccatcaccacccaggaggcagtaaatgcagtggtcgcgtatggttgttggccatcatttgactcaggagctggggaggccatagataagttaactgatccaggtccctctgtggacaggttctacactctggactcaattgagtggagcaccaccacacaaggctcgactcggaccgatg

SEQ ID NO: 8501 - DNA, 203 bp, Homo sapiens
  source 1..203: mol_type = other DNA
ggcgcgccagtcctatagctattggaccctacttctagttcccctggttcctctcgagtatagttcaggggctacaactcggattcccgtgactatatcaattgcccctatgtgctcatcattttctggcctgaggaaccggataccccttgctcaaggtattccaacattccaagtaccgggatccgcgactcggaccgatg

SEQ ID NO: 8502 - DNA, 203 bp, Homo sapiens
  source 1..203: mol_type = other DNA
ggcgcgccagtcctagcaatttgtcactaccctccgcaatcctggttacccactgtacccggagtaccagaagacaccaccccatcatataccaggtagggtaacaaatttgatggaggtggcggaggtggacactttatgcaatctatcagatactgaggtgttgtacatcaatgcaacagggtctgcgactcggaccgatg

SEQ ID NO: 8503 - DNA, 203 bp, Homo sapiens
  source 1..203: mol_type = other DNA
ggcgcgccagtcctcaccattgggcgagaacctgggcacctgggatctttcattacagggtaatttattatcccccacctacctcggtcgcctgtcgagattctatacccattatagaggctctatcaacttgactttcatgttctgtggctcagccatggccacgggaaagttcctcatctcctatacgactcggaccgatg

SEQ ID NO: 8504 - DNA, 203 bp, Homo sapiens
  source 1..203: mol_type = other DNA
ggcgcgccagtcctccctgtggtaccagaccgccgttgtcaccccaccaaattgtcccaatcagtgtgcgcttgtttgtttcgcttctgcctgcaaggactttgagatgagattgcctgttgattcagcctatttccaaggactaggtgatgacctttcgaaggtgataacaagtgtcacgaaggacacgactcggaccgatg

SEQ ID NO: 8505 - DNA, 203 bp, Homo sapiens
  source 1..203: mol_type = other DNA
ggcgcgccagtccttcacccaaccacttatggagccggtaactggtactgtggcgtcactaccacaacagctctcactgcaggtgggtgacggctcggctctcgcagcacctgagactggggtctcggcgactactgagccggagcagatgatggagacgagggtttcaacagtgctatacagcaagtcgactcggaccgatg

SEQ ID NO: 8506 - DNA, 203 bp, Homo sapiens
  source 1..203: mol_type = other DNA
ggcgcgccagtcctgcctcaaggctgccccagcctcctttagaataccctttatgggcatctcgtccgcttatgcctccttctacaatggttactccactttcacaccacaagctgcaaaatatggcgaatttccagggaactacctgggtgatctgtgggtgcgccttgttgctgataattcacgtccgactcggaccgatg

SEQ ID NO: 8507 - DNA, 203 bp, Homo sapiens
  source 1..203: mol_type = other DNA
ggcgcgccagtcctctggtagtgcatccacggtggtggtcaatgtccaggcattctgccggccagtcaattttgagggctacctacctcgccctatagtttcactcaagcctaatgtcagggtggggccctccagggggcgtgttgaattcgttgagacaggtgtctccatggagattggggtcggcccgactcggaccgatg

SEQ ID NO: 8508 - DNA, 203 bp, Homo sapiens
  source 1..203: mol_type = other DNA
ggcgcgccagtcctcaacaaacctcatgttttctcatggcgctgtgtaccacttctccgagtacaaaccagtgtggatgtccatgacttatgacgttgcagtcttgaagctagagaaacctaccttccattgtagcccccccatctgtctacatggttgtagatcaggatggctcaagtgtgtgactacgactcggaccgatg

SEQ ID NO: 8509 - DNA, 203 bp, Homo sapiens
  source 1..203: mol_type = other DNA
ggcgcgccagtcctccacagcgaccaacaggaaacagtccttctttaccaagatgtctgagataccgtattttcaggcgatggagcagggccctggtgattggctagcgggcatctttgaaaatatggggggtgcttttggtgaggggctcatacaaccaattaaggacaaactggatgacatccgggcgactcggaccgatg

SEQ ID NO: 8510 - DNA, 203 bp, Homo sapiens
  source 1..203: mol_type = other DNA
ggcgcgccagtcctccaacctcacgcccaataccatacggagtgaccttaccaagaccacgatcaccacccttgtaaagattatctgcgccatggtcctcatatccaaggcctacgacaaggtggagaccgcagcccttgtgggtacaatgttaggcgttgatttcctctctaaagacccatttgagtcgactcggaccgatg

SEQ ID NO: 8511 - DNA, 203 bp, Homo sapiens
  source 1..203: mol_type = other DNA
ggcgcgccagtcctgacggacccacttcatcaagggcctggagaagctacccatgcttatggagacctttgataagatttccacctcccgtggacagtacagtccggaaaccgtcaagcgtgtttgcaccgctttccgtgagttgaagcgtggggctgacatttatggtggtgagaggaatttcgccacgactcggaccgatg

SEQ ID NO: 8512 - DNA, 203 bp, Homo sapiens
  source 1..203: mol_type = other DNA
ggcgcgccagtcctcccatcctgcgaccaacttcaagaggtgctgcccacttatatgtggaaaggccgtgaaactgaaagatcggaagtcaggtatcacctactccgttgatgaccttctcacctgcctctatagggagtcagcgcgtcgtcagaggtgtggggataagctagacgctcttttccaggcgactcggaccgatg

SEQ ID NO: 8513 - DNA, 203 bp, Homo sapiens
  source 1..203: mol_type = other DNA
ggcgcgccagtcctgtattgaagatgaaatcaggatgctgccagacgcttacagacaaaagatgaaggtaaaacatcagatccatgatggtgacctagggtttgagcgtgtacagatggtccctgacccagaggagtggttcgaaactgattgggataagatgcctcatatcctgaagacgatcgacgcgactcggaccgatg

SEQ ID NO: 8514 - DNA, 203 bp, Homo sapiens
  source 1..203: mol_type = other DNA
ggcgcgccagtcctaacaggtggcaacgggactatcaatcctagcgagtatcgcaaccctcgcctccttcatatatttagcctataggatgtttgcctctaggcagggtccttattcaggagaatcacccgcccccctcaaggcaccagttccccgtagggttgtggtaacccaaggtcctgactctgcgactcggaccgatg

SEQ ID NO: 8515 - DNA, 203 bp, Homo sapiens
  source 1..203: mol_type = other DNA
ggcgcgccagtcctacaatgagcaaggtgctctcgaactcaccttgatcagaatcaaccgtcccaccaaattcagagatattaggaaattcttcccccctgccttttcagcggagagagactgcacacttgttgtgaataacaagaacttccctagggtgatgctccccgtgggtgcagtcacggcctcgactcggaccgatg

SEQ ID NO: 8516 - DNA, 203 bp, Homo sapiens
  source 1..203: mol_type = other DNA
ggcgcgccagtcctcgtttatggagggggccattgtgtccacatctcaggccccaaggcctatcaacctcaacacaaagaccaccctaaggccgtccgtgttctacgacacctttaaaggggagaaagaacctgcagccctacatgtcaaggacagacgcctcgaggtagaccttgagaaggccatgtcgactcggaccgatg

SEQ ID NO: 8517 - DNA, 203 bp, Homo sapiens
  source 1..203: mol_type = other DNA
ggcgcgccagtccttctcaaagtacaagggcaaccttgacgttgagttcccaccagagctgtccctggctgtggaccaatacgttgagcagatcagaccattgatacccccggatgtgactgaccccctatccttggaggacgttgtttatggcattgacaacctcgagggacttgatttgaacacgtcgactcggaccgatg

SEQ ID NO: 8518 - DNA, 203 bp, Homo sapiens
  source 1..203: mol_type = other DNA
ggcgcgccagtcctcatcggggtgttctggcacgtccatcttgaattcgataatcaacaacctcattatcaagaccctggtacttaggacttacaaaggtgtggatctggaccaaatgaagatcctagcctacggggatgacgttatagtgacctaccccttccagctggatgcatcgatagtggcagcgactcggaccgatg

SEQ ID NO: 8519 - DNA, 203 bp, Homo sapiens
  source 1..203: mol_type = other DNA
ggcgcgccagtcctgacttcattgccaaggtgcgcactgtacctgtagggagggctttgtcattgcccacctaccgcgtgctgcgcgcattttggcttgatctattttgatccccatcaatactcaactaccagtccaatcataggctaatactgatagttgaagacatttaattgagattggcaattcgactcggaccgatg

SEQ ID NO: 8520 - DNA, 203 bp, Homo sapiens
  source 1..203: mol_type = other DNA
ggcgcgccagtcctgaacgctccgccactgccatgtatagcgtgcaatgcataaatggtgcactacatgatacgagggaatgggaaaccctccatggccgaatgcagggtgacagcctgccggcggatgcctgttgttagtataatccgttgtttgccacatggattccacagtctcttttccagcatcgactcggaccgatg

SEQ ID NO: 8521 - DNA, 203 bp, Homo sapiens
  source 1..203: mol_type = other DNA
ggcgcgccagtcctctctccaaggggcacaatgtaagaaacttaaggcctgccggccgaagatgtattgtgaccaggggtactgtcatgctagttgtcgaaggcataggtcggctttgaggtgttgtctttgcagcaaggcctatgaagaagaggacttgaaggttgaagcattagagtatccttgctcgactcggaccgatg

SEQ ID NO: 8522 - DNA, 203 bp, Homo sapiens
  source 1..203: mol_type = other DNA
ggcgcgccagtcctggacacagatatatctgggtgatcggaaaatgcattggatatgtgatgcacatctaggatgtacgacgcattgctgttgttgtgatggtcagtttcagggacagttgtctagcaccatgtctggtaacaaacacataggggcttctggcggttccactgtgaattatattaactcgactcggaccgatg

SEQ ID NO: 8523 - DNA, 203 bp, Homo sapiens
  source 1..203: mol_type = other DNA
ggcgcgccagtcctattatggtgctgagtatgcaaatgcagcgaatgcccccacccaaaacttggatccagcagccttcactgacccagtcacagagttagcttcctctagttttgtacccgatctacaaagcccatctgctgaacaatgtgggtactctgatcgaattttgatggttacggccggtacgactcggaccgatg

SEQ ID NO: 8524 - DNA, 203 bp, Homo sapiens
  source 1..203: mol_type = other DNA
ggcgcgccagtcctgtgccacgcttgtgttgccatatcttaacatcacaccagcgtgtctacccaaaatccattgtccatggtcattgaacttgatcatcctggctgacctggactatgctgcaggcgctgccaccactattccaataacggtatcagttgccccccagtgttctgagttcgctggcccgactcggaccgatg

SEQ ID NO: 8525 - DNA, 203 bp, Homo sapiens
  source 1..203: mol_type = other DNA
ggcgcgccagtccttttcaccaaatggttctgtggcgccccccgataccgaatcacaatgggcaacatcccttaacccagtgacaacatttagattgcagcaaaattggtctagtgtccgaatcccgtttttatctactgctcattatttctccaccttctttaacggttatggcacatttgataaaacgactcggaccgatg

SEQ ID NO: 8526 - DNA, 203 bp, Homo sapiens
  source 1..203: mol_type = other DNA
ggcgcgccagtcctacctgattaagggaattgaaaagaccattctggcctttgaaccggaagatgacaatcatggggtcctcgatgtccttgagtgggtcacaaagttagtgtgcgcaacaacgataatcgtcagggggcaccatgacccagccatagtgacctcatgttgcgtaatgttgggtgtagcgactcggaccgatg

SEQ ID NO: 8527 - DNA, 203 bp, Homo sapiens
  source 1..203: mol_type = other DNA
ggcgcgccagtcctttaaagagctgatagattgggtcaaggatctggttgtcaaaatgaagcaccaggaaactatggctgatgaattgaagttttatcttaatgagtggtttctgtatcagaaggacccatccaaatttacgcgtggttctgttatcaaattgtgtgataaattactagagattaaagcgactcggaccgatg

SEQ ID NO: 8528 - DNA, 203 bp, Homo sapiens
  source 1..203: mol_type = other DNA
ggcgcgccagtcctgtaaggcattgtctaaattttatagagttcaagaaccctactcgctcccacctgatccaaagtattttgatggttataaagggcagatggtcacaatcatggatgacttgggacagaaccccgacggagcagatttccaattcttgtgtcagatgatttcgacagttgacttttcgactcggaccgatg

SEQ ID NO: 8529 - DNA, 203 bp, Homo sapiens
  source 1..203: mol_type = other DNA
ggcgcgccagtcctacccaccgatggctgacttggcagataaaggagcaccatttattagtgattttgttctagcatccacgaatttgagaactttcaatcctccaacgatttcagacgtaggagcaataaaccggaggtttttcattgacacaaccattgatctgagtaaggactattgcaatgcagcgactcggaccgatg

SEQ ID NO: 8530 - DNA, 203 bp, Homo sapiens
  source 1..203: mol_type = other DNA
ggcgcgccagtcctctgggaaattggatgtgcagaaggcattggcgaagtgtgatcatgaggtggatgtgctttacactaagcattgttgcccactactctgtgggaaagcggtaaagttggtggacaagaagggaaacaagttttcggtgaatgaagtgattggattactggtctcggaggctgagacgactcggaccgatg

SEQ ID NO: 8531 - DNA, 203 bp, Homo sapiens
  source 1..203: mol_type = other DNA
ggcgcgccagtcctgaaaaagaaaagttgggatcaatgttgacggtttatttcagggaccaaccgctccaaaaccaattctggagactgtgacagttagtggttcagctttgcccgaggatgttgctgatgctttgatggccaatcaagccggagacaatttgattgatcaattggaacaggcaggatcgactcggaccgatg

SEQ ID NO: 8532 - DNA, 203 bp, Homo sapiens
  source 1..203: mol_type = other DNA
ggcgcgccagtcctcacaactgcaaaaaccggtggttgggaccgttaatgtacaaggaccaggagcaccaaatccagatttccagtttgcccaaaagatccaaaagaagagcttacttccacttgtgactggagcaggcccctacacggcagtgggaatttttggtagaacagttctgctcccgaagccgactcggaccgatg

SEQ ID NO: 8533 - DNA, 203 bp, Homo sapiens
  source 1..203: mol_type = other DNA
ggcgcgccagtcctactatgtggaacaactcaggcccctgttaccagaggatgtcactgagcccctgaccctagatcaggccattgaagggtaccatggattgcaaaaattggactcggccacaagtgctggttttccctacaacaccatgggaataacaaagaaacaattgatggcaaatgacaggacgactcggaccgatg

SEQ ID NO: 8534 - DNA, 203 bp, Homo sapiens
  source 1..203: mol_type = other DNA
ggcgcgccagtccttcttttgtgaaaacccaggcacagcgaccgggatggctgttggatgcaatccagacagggattggactagatttcaagctgaatttgattcttcatatgtgataagctttgactacaaaaattttgatgctagtctatcaccaatgtggtttgccgccctgcaaggagtactgccgactcggaccgatg

SEQ ID NO: 8535 - DNA, 203 bp, Homo sapiens
  source 1..203: mol_type = other DNA
ggcgcgccagtcctagggacttggatttgatgagaatgatgtcgaattcatcattgaccacatgtgcttttccgtccatttatggggtgacaccttcgtgcacattgaaggtggaatgccatcaggttgctccggaacatccatctttaacagcatgatcaacaatatcattttgaaaacaatcattccgactcggaccgatg

SEQ ID NO: 8536 - DNA, 203 bp, Homo sapiens
  source 1..203: mol_type = other DNA
ggcgcgccagtcctccttggagctgcacaccttcctcaaacgcggcttcaagagagatgatgaatttgatttcttggtgcatccaaccatggacaagacagcaatctatgagtcgctgcgctggacgcgcgaccccaaggactttcaggaccatgtccgatgtctgtgtgaactgatgtggcaccatgcgactcggaccgatg

SEQ ID NO: 8537 - DNA, 203 bp, Homo sapiens
  source 1..203: mol_type = other DNA
ggcgcgccagtccttaggagatgtctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcgactcggaccgatg

SEQ ID NO: 8538 - DNA, 203 bp, Homo sapiens
  source 1..203: mol_type = other DNA
ggcgcgccagtcctcaatctatcatccacccttctaagcctgtccagaaggatcctgaggacatcctcgaggattccgaatggccagacaacatcttacaccctgaacccccttcttttactaccgatgctgagcaaaattggcatgaccgcttggcatctgcttccttgcctggacccacccaggcacgactcggaccgatg

SEQ ID NO: 8539 - DNA, 203 bp, Homo sapiens
  source 1..203: mol_type = other DNA
ggcgcgccagtccttccaccgctcctgtggtctgtgcttaccctcccaccccttctgttcctcttcctaatccagatgctccctctgtccctggtccgtctggtgaccgtacttggctgttggacactctcgaatggaccactgagaatccacaactgtggaacttggctggtccaaacgggatgcaacgactcggaccgatg

SEQ ID NO: 8540 - DNA, 203 bp, Homo sapiens
  source 1..203: mol_type = other DNA
ggcgcgccagtccttattctgctctccaaaacctcactttccctgtttcttcttctgctaattggggaacacaagataactccccacccactgcctaccctctccctttctcttttgtccacgcttatccagactgcccttggacggctatgcatgatacccactctatgtggaattgtggatggcgccgactcggaccgatg

SEQ ID NO: 8541 - DNA, 203 bp, Homo sapiens
  source 1..203: mol_type = other DNA
ggcgcgccagtcctatccaagtggtggttaatggttctcagtttcatgctgggtgtttagcattggtcatggtccccgagtactccgccggagagctcgcccagggccgtctaaatgccatcttcacttttccctacgccctcctcaacctctaccaaggtaacaccgcctcaatagaggtcccttaccgactcggaccgatg

SEQ ID NO: 8542 - DNA, 203 bp, Homo sapiens
  source 1..203: mol_type = other DNA
ggcgcgccagtcctaacactggtttttctcttctccttggtctgggcgctctcgccctcctgtctggttgcgcagccgtgcaagcgtcgaaaggacgcgtgacccgacagggcctcctctctcttgaagcccccccagaggtcgtccaggctgctaaccgtgtcgctgactccattgagaccactgcccgactcggaccgatg

SEQ ID NO: 8543 - DNA, 203 bp, Homo sapiens
  source 1..203: mol_type = other DNA
ggcgcgccagtcctgtttcctccagcctgaacggtttcactgatatgctctcttccttttccaagaccttcactcaaggtgcttccaaagtgctgagagatggtatctctaccttccttacctgggtggccaaagtctttggttaccttcttgtcctctttggatctcccactccgatgtccatagctcgactcggaccgatg

SEQ ID NO: 8544 - DNA, 203 bp, Homo sapiens
  source 1..203: mol_type = other DNA
ggcgcgccagtcctggtctattggtcatcatctgtgctgaccttgctcctcaagcctctgaatacttccactcttgtagctctgtccttggttccctttactactggattgctaccaagcttggtctctctgtcactcctgaggaggcacacgcagcaacggtagaacaccaaggtgttcgtgactaccgactcggaccgatg

SEQ ID NO: 8545 - DNA, 203 bp, Homo sapiens
  source 1..203: mol_type = other DNA
ggcgcgccagtcctattctttctgagtctaaacctgtacccacttccctttcctttgagcgggctgtctcacagaatgctcctctttcggtggttaaccagctctggaactaccgaaaacccatctttgcctgtactactttccttactgtgattggtttcgttcttaccatcattgctgtggcgcgtcgactcggaccgatg

SEQ ID NO: 8546 - DNA, 203 bp, Homo sapiens
  source 1..203: mol_type = other DNA
ggcgcgccagtcctgacaatgtctatcccattgctactgaatcccctactattggtcgcagcgcaagctgtggcttctttcttttctctcgattctttctagcccctactcatatcatcccggatgatacgacccgcatctctgtaggtccagatgtctttgactgggcgacactccaacacaaacgccgactcggaccgatg

SEQ ID NO: 8547 - DNA, 203 bp, Homo sapiens
  source 1..203: mol_type = other DNA
ggcgcgccagtcctctgggaaaagaactcactatcatccattttcctactattcgccaacatcgtgacctccgtcgctttattggtgaacatccctaccctactggacatcttatttctactctttctggtcctcctgtctacctacgattctccaagaaccgttgggttactcttgaccttcctggccgactcggaccgatg

SEQ ID NO: 8548 - DNA, 203 bp, Homo sapiens
  source 1..203: mol_type = other DNA
ggcgcgccagtcctcaggcagcaggttacccgtggaacaccatggggcgctcgcgccgttcactctttgtccaacagaatgggatgtggttacctcttccagagttggaagttgaaatcaacaaaactcttgaagatccctattacttctactctactttccttaaagatgaacttagacccacctctcgactcggaccgatg

SEQ ID NO: 8549 - DNA, 203 bp, Homo sapiens
  source 1..203: mol_type = other DNA
ggcgcgccagtcctccgtcattcatcaaggagttttatgacaagcacacaccacttgttgtaactccagcaaataaaacagacaccttcccggaaaactccaccatctatgacgtcacgtttctgaaacgttggtttgtgcctgatgacattcgaccattctatatccacccggtcatggacccagaccgactcggaccgatg

SEQ ID NO: 8550 - DNA, 203 bp, Homo sapiens
  source 1..203: mol_type = other DNA
ggcgcgccagtccttatcttcagacccgctggttaaacctcctggcagcgtgagacaccagatacactcttgctctgtatcgctttgtgtagaatagactcatgctttcctaagaccggaactctcatccggcactttcacccacctgccctgccttcattttgaagctgcacccagggaggtggtcccgactcggaccgatg

SEQ ID NO: 8551 - DNA, 203 bp, Homo sapiens
  source 1..203: mol_type = other DNA
ggcgcgccagtcctgaaaccagtgacacggagagggtggccagtcagtgaggctttgactgctgtgggattgacattcgcgttggcaggaggaatagcccagtttgatgacagcagcatggcgattccattagccgttggcgggattatgctggtggtggcagtggtaacaggcttctctacagacttcgactcggaccgatg

SEQ ID NO: 8552 - DNA, 203 bp, Homo sapiens
  source 1..203: mol_type = other DNA
ggcgcgccagtcctaagcaatgaaggtgttggcgacatttaagaaaattcttggaaatctgatgaaaacccttcaaacccggaaaaagagaccgaatagacgatctgctgggagtaatggaatgatgatgctagccttgattgggactgctatggcagccacgagtatgactaaagacgataccatctcgactcggaccgatg

SEQ ID NO: 8553 - DNA, 203 bp, Homo sapiens
  source 1..203: mol_type = other DNA
ggcgcgccagtcctgtaaggggatttctgttgtactgacctatggaaggtgcaagactaattccactaccccggcacctcagcgtcgcagatcaagaagatctatcatgatacctacacacagtacgggtggattgcaccaaggaaccgaaggatggcacaggaccaataatgtgaagaacttcctcacgactcggaccgatg

SEQ ID NO: 8554 - DNA, 203 bp, Homo sapiens
  source 1..203: mol_type = other DNA
ggcgcgccagtcctaaggggtgtcaggaggtacctgggtagatgtggtcttggaccgtaaaggatgcgtgacaatatcagcaaccggaaaaccgaccatagacgtacggatggttaagatggaagcctccaatttggcatccgtgcgaacatactgtctggaagcttccacctcggaaatttcatccgcgactcggaccgatg

SEQ ID NO: 8555 - DNA, 203 bp, Homo sapiens
  source 1..203: mol_type = other DNA
ggcgcgccagtcctttgaatgcctgatggactttgggattgatttggatgacgtttacacggccgatatgtcaggaaagtggtggttggttaagcgtgattggtatcatgacattgctctcccatggacagcaccctccgctgacttttggcatgacatggacagattggtggaatttagcacaccaccgactcggaccgatg

SEQ ID NO: 8556 - DNA, 203 bp, Homo sapiens
  source 1..203: mol_type = other DNA
ggcgcgccagtcctatgccactaagcagagtgtgtataccctaggtgaccaagaaggagccatgtccactgccctaggtgatgcggccgttattgaatacatgtcatcaggaagcaaggtggtctttcgtacagggttcctaaaatgtagagtcaagatggaaaatctgagattgaaaggctccacatcgactcggaccgatg

SEQ ID NO: 8557 - DNA, 203 bp, Homo sapiens
  source 1..203: mol_type = other DNA
ggcgcgccagtcctatatgcaatgttccaaggagttctctattctgaagaggcccaccgccaccccgtatggaactgtcatcatgcaggtgaagtacgcgcagactgatgtcccgtgtcgtgtgccagtgggcgttcatgagaggccaggtggtgagcaagttggacgtattataacagcccatcctacgactcggaccgatg

SEQ ID NO: 8558 - DNA, 203 bp, Homo sapiens
  source 1..203: mol_type = other DNA
ggcgcgccagtcctggaacacttttagggttgaggagtttggcacgggaatcatgaaaacaaaagtgtttttggatataaacccgactttaacgagatactgcgataccgaattgcttggagcagctgtgaaaggaaaccattctgctcatggtgatcctggtttgtggatggtctctgagaaagaagcgactcggaccgatg

SEQ ID NO: 8559 - DNA, 203 bp, Homo sapiens
  source 1..203: mol_type = other DNA
ggcgcgccagtcctgaagtgagtggaaactcacgagcctgtcactatccgagagtaggaggtgtttgtggcctgattctcatactgtctggggacgtggagttgaagagaccaaactcatccttcctgccaatcttggagggccagtgtcacacatgaacactagatatggctactcaacccagatctcgactcggaccgatg

SEQ ID NO: 8560 - DNA, 203 bp, Homo sapiens
  source 1..203: mol_type = other DNA
ggcgcgccagtcctctggaccatggaacaatgttccactagacgtggtctttgagacctgtcctggaacgacggttaatgtcactagaacatgtgtggggagatcggcatcggcaaggtcaacaactgacagtgggaagatcataccggagtggtgttgcagagcctgcaccatgcctcccttgacatcgactcggaccgatg

SEQ ID NO: 8561 - DNA, 203 bp, Homo sapiens
  source 1..203: mol_type = other DNA
ggcgcgccagtccttccctggaatggtttcgaaagccttaccccttttatgttgtctggctccgttgcctttagctgttatgactaacgccacgagagctagtgtggcaactttggcagttggaaccatgttggccggtgccaagggcaagtcagtgaaaaaatccctaccatggttttcagctttgacgactcggaccgatg

SEQ ID NO: 8562 - DNA, 203 bp, Homo sapiens
  source 1..203: mol_type = other DNA
ggcgcgccagtcctctgcggcccttatattcaccgcatatgccataagcggcaaggccaacgacatattccttgagaaagctggtgagatgacatggagccatgatgctcagctatctggatcaagtccaagagtggacgtcaaagttggtgagagtggggattttcggcttcgccacgagtctgaagcgactcggaccgatg

SEQ ID NO: 8563 - DNA, 203 bp, Homo sapiens
  source 1..203: mol_type = other DNA
ggcgcgccagtcctactcgtggctgaaaacaggcgtaacagctggctgtctcatcatggccggcttccatccccttgccataccggttgcgggattgatttggtatggatatgtgaaacatgaccgtagaggtggagtcttgtgggacattccacacccatcaacatccaaagccggagacactgagacgactcggaccgatg

SEQ ID NO: 8564 - DNA, 203 bp, Homo sapiens
  source 1..203: mol_type = other DNA
ggcgcgccagtcctgctatggtggaccatggagattgaatggaacgtgggacgggactactgaagtgcaacttatagcagtgtcacctggcaaagttcctatcaacgtccaaacgaaacctggaaaattcgtgctcactgatggacgtgagataggagcagttgtgttggactatccgcccggaacatcgactcggaccgatg

SEQ ID NO: 8565 - DNA, 203 bp, Homo sapiens
  source 1..203: mol_type = other DNA
ggcgcgccagtcctatttgcatccaggcgctggtaagactaggcgagtcctacctgagatactgcgtgaagctgtgaagaaaaatctgaagacattggtccttgcacccacacgggttgttgcacgagagatggctgaagcattagctggactaccagtgcggtaccaaacaccatctgtcagtcaagcgactcggaccgatg

SEQ ID NO: 8566 - DNA, 203 bp, Homo sapiens
  source 1..203: mol_type = other DNA
ggcgcgccagtcctactcaaccggtcgtgaactaatagacttgatgtgtcatgcaacattcacgtatcgtcagttgactcctggacggatggtgaattaccaattgtacgtcatggatgaggcccatttcacggatcctgcgagtattgccgcacggggaatcatttcaacaagagtcagtcttggggcgactcggaccgatg

SEQ ID NO: 8567 - DNA, 203 bp, Homo sapiens
  source 1..203: mol_type = other DNA
ggcgcgccagtcctaagctgcagccatgttcatgacagccactcctccgggaacgacagacgctttccctgagtcaaacgggcatatagaagatgaagaaagggaagtgcctgatgctgcttggagtgctggctttgattggataaccgaattcaacggcaaaaccatttggttcgccccatccattacgactcggaccgatg

SEQ ID NO: 8568 - DNA, 203 bp, Homo sapiens
  source 1..203: mol_type = other DNA
ggcgcgccagtcctatggagacatggcgcattggattgaggctaagattctcatggacaacatcacagtgcctgggggactttatcctcaattctatgaacctgagcgaatgaaatgtccagcgaccgatgggtttcacagacttgatgacaagaaaagggctgttcttcgcgatctcataaggcgcgcgactcggaccgatg

SEQ ID NO: 8569 - DNA, 203 bp, Homo sapiens
  source 1..203: mol_type = other DNA
ggcgcgccagtcctaccaacgagtctaccaggaacgtgcttctttgaaaagtttcacggaatttgcagagggcagaaggagttacatgcctattttagatgtggttgggaaactgccccagcattttagtgatcgtgccattgatgcagctgacactattcgaactgttctcacagccaatcctgactcgactcggaccgatg

SEQ ID NO: 8570 - DNA, 203 bp, Homo sapiens
  source 1..203: mol_type = other DNA
ggcgcgccagtcctcacgatcttaccgactggcaatagacaatctgccggaagcggctgaaactgctatgcttataggcatgctggtttctgtcaccatgggttccatcatgtttttgatgatgcccaaaggcataacccggatgtccttgggattgattgtcatgattatggcaacttggttcatgtcgactcggaccgatg

SEQ ID NO: 8571 - DNA, 203 bp, Homo sapiens
  source 1..203: mol_type = other DNA
ggcgcgccagtcctcgttgatgcacttcgcccttatcctacccggattgaaagctaaagctgcccgggaagcacaaagtaggaccgccgctggaatctcaaaaaatcctttgatagatggtgtgaatactacggcgattccactcccatcagccattgaccctatgtttgagaaaaaactcggactgtcgactcggaccgatg

SEQ ID NO: 8572 - DNA, 203 bp, Homo sapiens
  source 1..203: mol_type = other DNA
ggcgcgccagtcctggatgttgcttatagtttcgtctctagcggtgcttcttaatcgaagcacgctgcatatgactgaacttggaatccttggctcagctgctatatctcctctaatagagggacaagcttcggccatctggaacacttcagttgcagcctccgtgtgtaacttgatgcgtgggagctcgactcggaccgatg

SEQ ID NO: 8573 - DNA, 203 bp, Homo sapiens
  source 1..203: mol_type = other DNA
ggcgcgccagtcctagaagaagattgtgcgcgtcaaaggatacacaaaaggtggaccaggacatgaggaaccagtgcccgttcaatcatacgggtggaacctcgtaacgatgaggtccaacgttgatgtgttctacttagggactgagaaatgcgacacgctggtttgtgacataggagaatcatcatcgactcggaccgatg

SEQ ID NO: 8574 - DNA, 203 bp, Homo sapiens
  source 1..203: mol_type = other DNA
ggcgcgccagtccttagtgaaagagatgtcaaaaccgtgggacacgatttatggagttacaagtgtttgcatgacagacactactccattcggtcagcagcgcgtgtttaaggagaaggtggacaccaaggctagtgaaccaaaggcaggcatccgtgaggttatgcgcataactaaccgttggctcccgactcggaccgatg

SEQ ID NO: 8575 - DNA, 203 bp, Homo sapiens
  source 1..203: mol_type = other DNA
ggcgcgccagtcctctaacctaaaagtccagcttatacgcatggctgaatctgaaggcgtcattcatggagatgacgttgaaacactatctagcagtgggcgtataaacttggaaatgtggcttgtcatgaacggggcagaccgtcttaagcgcatggcatgcagtggtgatgatgtcgttgtaaaaccgactcggaccgatg

SEQ ID NO: 8576 - DNA, 203 bp, Homo sapiens
  source 1..203: mol_type = other DNA
ggcgcgccagtcctaggacatctcctgcggttcgctcatagggacacggtctagagctacctgggctgataacatcaagacagcagtcaatcaagtccgtggaatcataggaagggacgaaaagtatatggactatttggccattcaaaatcgcttcatgccccctctccaatttagattgggaagcgcgactcggaccgatg

SEQ ID NO: 8577 - DNA, 203 bp, Homo sapiens
  source 1..203: mol_type = other DNA
ggcgcgccagtcctgatgttgggacctggttatccattaagacagcagtcgggaacggatcatgcatcgttatggctacagatgtggggacttggtgtgaagacactgttacgtatctttgtcccaaattggacggtgctgctgagcctgacgacattgattgttggtgtaaagttgtatcagtttatcgactcggaccgatg

SEQ ID NO: 8578 - DNA, 203 bp, Homo sapiens
  source 1..203: mol_type = other DNA
ggcgcgccagtcctgttacctatggtaggtgtagacgagatggggtgagtagacgcagcagacgatctgttgctctcgcaccgcatgggacaggaaaccttcacacaggagaggcaccaatgtggaaatcacacactgacgctagtaaatacttgcagcgagtcgaacggtgggctctgagaaatccacgactcggaccgatg

SEQ ID NO: 8579 - DNA, 203 bp, Homo sapiens
  source 1..203: mol_type = other DNA
ggcgcgccagtcctgttttggacgtgcacgggtgtgtgactattgcagcagaaggtaaaccaacagtggatttcaagttgacgaagttggagatgacgaaacttgcaaaggtgcgagcgtactgcctcactgcctccgtatcagacatcacagtcgaaagtggatgtccaggaacaggcgaaattcatcgactcggaccgatg

SEQ ID NO: 8580 - DNA, 203 bp, Homo sapiens
  source 1..203: mol_type = other DNA
ggcgcgccagtcctgagcaagtcttgatcgtagacacagcctcacgctggtggatggtcaagagagactggttccaggacttagcacttccatggacatcaccgtcagcagacttctggcatgatcgtgaccggttagttgaatttggagttccgcatgctacgcgacaatctgtatactccattggacgactcggaccgatg

SEQ ID NO: 8581 - DNA, 203 bp, Homo sapiens
  source 1..203: mol_type = other DNA
ggcgcgccagtcctgatcaagaaggagcatttttcactgccgtggcaaaagccccgtcagtcgagtggaactctgacaaagtcaagttagcgaccggattcctgaaatgcagaatcaagcttggcaacatgaagctgaaagggtcaacatacgtcacgtgtgcgcaagcgttcacctttgcgaagcggcgactcggaccgatg

SEQ ID NO: 8582 - DNA, 203 bp, Homo sapiens
  source 1..203: mol_type = other DNA
ggcgcgccagtcctccagtggacacaggtcatgggacagtcgtgttccaagtatcatatgctggaacagatgcgccatgtaaaataccagtggccgtgactgacaaaccaaacggcgagcatgtcgggagattggtgacagcacacccattcatagcgaaacagaatgagaaggcagtcgttgaagttcgactcggaccgatg

SEQ ID NO: 8583 - DNA, 203 bp, Homo sapiens
  source 1..203: mol_type = other DNA
ggcgcgccagtcctacccgaaacacaacaggactgcagtacggatggaagtcgtggggcaagacaatgtttgtttcagtgccaatagccgagaacactttcataatcgatggaaatgatgaaggagagtgtgcctcggacaaacgcgcttggaatacatttaagatagaggagtttggcacaggaatacgactcggaccgatg

SEQ ID NO: 8584 - DNA, 203 bp, Homo sapiens
  source 1..203: mol_type = other DNA
ggcgcgccagtcctatgaaaaccaaagtcttcctggatttggctgacgcacaaacagaatactgcgacacggaactgttgggagctgctgtgaaaggcaacaagtctgttcatggcgaccccggattgtggatgactgcttctaaggaatcaggcgactggaaactggaatcattgtcaatgacggagcgactcggaccgatg

SEQ ID NO: 8585 - DNA, 203 bp, Homo sapiens
  source 1..203: mol_type = other DNA
ggcgcgccagtccttcaccacgggaaagtaccattttggcttcagcagcagtcgttctgcaaatttgtgcggctgcatggcaatcaacaaagtctatgcaagtgctgaatgctcttgctatgggatggctgtacatcagagccattgtggtacccggagctctttccaaagcaatgcccctcatttgccgactcggaccgatg

SEQ ID NO: 8586 - DNA, 203 bp, Homo sapiens
  source 1..203: mol_type = other DNA
ggcgcgccagtcctatgtgcgtcccaggcgtgttgagcctgacgccacatgctataagagtcagcatggttacaatagcggcaggcactctcatcaaaggcacgaagggaacatcagttcggaagcacatgccctattttttaggactagtaggagccgtggccggactggatccattaggtatgcttcgactcggaccgatg

SEQ ID NO: 8587 - DNA, 203 bp, Homo sapiens
  source 1..203: mol_type = other DNA
ggcgcgccagtcctggttctacgcaagtaggagtgggagtgatgaaagactcagtgtttcacacaatgtggcacgtcacccgtggcgcctctctaacgagtggtaacggtagaatggatccatattgggcggatgttcgagaagatctcatcagctacggtgggccatggaagctcaacagcacttggcgactcggaccgatg

SEQ ID NO: 8588 - DNA, 203 bp, Homo sapiens
  source 1..203: mol_type = other DNA
ggcgcgccagtcctggaactcttgatgcattcccagaatccaatagccatattgaagatgaggaaagggaaattccagacaaggcatggagcaccggattcgaatggattacagattacacaggcaaaactgtgtggtttgttccatcaattcgaactgggaacatcatagcgagctgcctcgcgaggcgactcggaccgatg

SEQ ID NO: 8589 - DNA, 203 bp, Homo sapiens
  source 1..203: mol_type = other DNA
ggcgcgccagtcctgtcccttctgagagagtagtgttgggatctccaaaacccataagcccagctagtgcagcacagcgtagagggagagtgggtcgagaccccactcagcttggtgaccagtacatttacggaggcgaggttggtgacgacttctccaacatggtgcactggacagaagcgaagatccgactcggaccgatg

SEQ ID NO: 8590 - DNA, 203 bp, Homo sapiens
  source 1..203: mol_type = other DNA
ggcgcgccagtcctttaatggacaacatcatggtaccaggcggtctgtacccacagttctacgagccggaggctgacatgctaagtgaaacggatggacacttcaggctggatatgaccaaacgtgacgtattcaaggatttggtgcgcaaggcagacttacccatatggctggcttatcaggtggcccgactcggaccgatg

SEQ ID NO: 8591 - DNA, 203 bp, Homo sapiens
  source 1..203: mol_type = other DNA
ggcgcgccagtcctaagcatggtcatgaatacaaagacagaagctggtgccatagtgggccatctggacatctcatctacgatgattacggacagacagttgaatacaagcttgtgaatggcgagaggaagatactgcaaccaagatggattgaccaacgcacataccaggagaaaacagcactcaagcgactcggaccgatg

SEQ ID NO: 8592 - DNA, 203 bp, Homo sapiens
  source 1..203: mol_type = other DNA
ggcgcgccagtcctgctttcatcgaatttgctgagggacgccgaagttatgttcctataatagaagtgctcggcaaacttccacagcatttcgccgacaaaactattgatgcggctgacaccttcaagactgtgcttacagccactccaggaagtagagcatacaggcttgcagttgacaacctaccccgactcggaccgatg

SEQ ID NO: 8593 - DNA, 203 bp, Homo sapiens
  source 1..203: mol_type = other DNA
ggcgcgccagtcctgatgcagcagagacggcaatattcgtgacgatggtagggttcatgaccatgggaatactaattttcctgatggcacccaaaggcatgacacgcatgtcgctgggattcatgaccatcatggcagctacgtattttctgtgggcttcaggcatggctggatatcaaatagcggcacgactcggaccgatg

SEQ ID NO: 8594 - DNA, 203 bp, Homo sapiens
  source 1..203: mol_type = other DNA
ggcgcgccagtcctcaagcaggaatactgctatcaatggataaaggaacgccatttttcaacttggactggggcgtcattctgttgggagtggggtgttggtctagcataacggggacaaccttgttgtgtgcgatcggactctcctgcgttcacttctcaatgactctacctggagtcagggctaaacgactcggaccgatg

SEQ ID NO: 8595 - DNA, 203 bp, Homo sapiens
  source 1..203: mol_type = other DNA
ggcgcgccagtccttcgctaaaaggggttccccgtagaggagtcaccataagcaacacccgagggatggaatggaaacgcaaactaaacgcaatgaacaaggaaacctttcagagatacagacgagatgggatagttgaggtggacagaacagcagcgcgggaagctttaaagagtggaaatgtaacacgactcggaccgatg

SEQ ID NO: 8596 - DNA, 203 bp, Homo sapiens
  source 1..203: mol_type = other DNA
ggcgcgccagtcctggaggtcacgctgtatcccggggttcagcaaagctcagatggctggtagataaaggatatttacgcctgatgggggatgtcacagacttgggatgcgggcgaggtggatggtgttattacgcagcagctcaaagaaacgttgtatctgtacgaggcttcaccaaaggaggtgaccgactcggaccgatg

SEQ ID NO: 8597 - DNA, 203 bp, Homo sapiens
  source 1..203: mol_type = other DNA
ggcgcgccagtcctggacacgaagaacccattccggtgcagacttatggatggaacattgtcactctgcgtagcaaagtggacgttttctacatgcctacacacatgacagacactctattgtgtgacattggagagtcatcgtctaacatgctagtagaagaagagaggaccctacgcgtgctgaatcgactcggaccgatg

SEQ ID NO: 8598 - DNA, 203 bp, Homo sapiens
  source 1..203: mol_type = other DNA
ggcgcgccagtcctctggttgaagagtggatcagaaagagtaagccaactcacttttgttgcaaggttcttgctccatacatgccaaatgtattggagaagatagacaagctaatgaaagttcatggaggtgctttagtgagagtgccactctcccgcaacagcacacatgagatgtattgggtatctcgactcggaccgatg

SEQ ID NO: 8599 - DNA, 203 bp, Homo sapiens
  source 1..203: mol_type = other DNA
ggcgcgccagtcctctcacgtacatgaacaaggttgtgagagtgatgaggccaggcaagggaggaaagacgctaatggacatcattagcaggaaggaccagagaggtagcggacaggtcgtgacttaccccctcaacacgtggacaaacctcaaggtgcagttgattaggatggctgaaggcgaaggacgactcggaccgatg

SEQ ID NO: 8600 - DNA, 203 bp, Homo sapiens
  source 1..203: mol_type = other DNA
ggcgcgccagtcctatggccaagatcagaaaagatatcaatgaatggaagccctcaacaggctggaacagttgggagggtgtgccgttttgttcacaccatttccacaagctcagcttaaaggatggaagaacactcacagttccatgcagagatcaggacgaacttattggaagagctagagtgtctcgactcggaccgatg

SEQ ID NO: 8601 - DNA, 203 bp, Homo sapiens
  source 1..203: mol_type = other DNA
ggcgcgccagtcctcctggagcagggtggacgttgcgagaaaccgcaggactcagtaaggcgtatgcgcaaatgtggatgctgatccacttccacagaagggatctacgaaccatcgcgttcgcaatttgcagtgcagtgcctaaagactgggttcccacaggaaggacatcgtggtccatccatgctcgactcggaccgatg

SEQ ID NO: 8602 - DNA, 203 bp, Homo sapiens
  source 1..203: mol_type = other DNA
ggcgcgccagtcctcccgagctggacaaggcatgtgtactagcggttagaggagacccccccaaaaatgaagggcactatatcgacacttgggaaagaccagaggtactcgctgattcaccgccaccagactacacggcacagcgcgccggaaaaggtagtttggaggttgtaaaacaacaagtatctcgactcggaccgatg

SEQ ID NO: 8603 - DNA, 203 bp, Homo sapiens
  source 1..203: mol_type = other DNA
ggcgcgccagtcctgcttttgaccagtggctctgggttacttagccaagtccctttctcttattttcactagtttatgttgtgtgttgtctgttttgttttgtttaaattgtatacaagatccttcccgccgacacagacctcgacagtctggtgtaggagggttggtgatattaatttgccccaaaacgactcggaccgatg

SEQ ID NO: 8604 - DNA, 203 bp, Homo sapiens
  source 1..203: mol_type = other DNA
ggcgcgccagtcctgagtgaccgtgatacgtggaaaccatgagtacatgtgtatccgtggaggatcgcccgggactggattccatatcccattgccatcccaacaaacggagggtatacccaccacgtgcgcgtttgcagtgggaatctgcaaatttagtcatactgcctgatagggtgtgggcctgccgactcggaccgatg

SEQ ID NO: 8605 - DNA, 203 bp, Homo sapiens
  source 1..203: mol_type = other DNA
ggcgcgccagtccttgcttttggaagaatcggtcgtttcctgcttatggcacatcacgatattttcagttctttcgtggttcgttccatattaagattcaggtcaatgctgctgcaggttctgccggttcttttgtcgttgtctatgtgccaaatgaccattatcagagttggaataataaggatttgcgactcggaccgatg

SEQ ID NO: 8606 - DNA, 203 bp, Homo sapiens
  source 1..203: mol_type = other DNA
ggcgcgccagtccttgtatttttgattggcaggctagccatgctccaacaaccaagtctccgatttttgggcgtggctataagatacgagagcttggtaatttgggtccattgtcaacagcctatcagttttggcgtggttctattattttcactctcaccatttttgctagcagttttcaccgtggccgactcggaccgatg

SEQ ID NO: 8607 - DNA, 203 bp, Homo sapiens
  source 1..203: mol_type = other DNA
ggcgcgccagtcctaacgtgtatgttgaaacccgattggctcacaataatgcatcttccaacgttataaaatgcgcactttttgtgcgtggcggcgaggattttgagttcttggcgccatgcggtgacactgtcaagttccatggttggggatcggatatggatgaagctgatcctttggatgacatgcgactcggaccgatg

SEQ ID NO: 8608 - DNA, 203 bp, Homo sapiens
  source 1..203: mol_type = other DNA
ggcgcgccagtcctatatttgccaaagatcatatgcaccttgattatttctttggtcgtggatggtatgtcatgaaacataactatgagggcgagagccgtgcccctttttatattgatgtggatgctccatcgtctatgccaggcgctgcaatgaatttcttttctttctgggctggggaggttaaccgactcggaccgatg

SEQ ID NO: 8609 - DNA, 203 bp, Homo sapiens
  source 1..203: mol_type = other DNA
ggcgcgccagtcctttccatgttgtcaacaatagtgatgacccaatggctgtcactcatagttattcgcatgaggctagcactgttggtcccgctgaaggtctagggttgataattgtgccgcctcgtgagatgatatcatttgcagcccctttctattcctggtcgccattgcggactgtgcttgctcgactcggaccgatg

SEQ ID NO: 8610 - DNA, 203 bp, Homo sapiens
  source 1..203: mol_type = other DNA
ggcgcgccagtccttctgaattttctagtgtaagacttgtgtcgtctcaaacagccgcttttgtggatgccctttttaatggtgatttgtataaactctctgaacaattcctttcaatgatggatattggttctgattctgactataaacaattaatcaaggagacgttgggatcgtaccctcctgaacgactcggaccgatg

SEQ ID NO: 8611 - DNA, 203 bp, Homo sapiens
  source 1..203: mol_type = other DNA
ggcgcgccagtcctatgaacccatttgagtcacagagtttggctgcatttaatgctttgtccttgagtgctcgtaattgtacatggtggattgagctcttccagaaattgcacacgttcgtgcgtgacttattgaaaccagatacttcggcaaagtttcatgaatggtgtaggaaaaataagatgctccgactcggaccgatg

SEQ ID NO: 8612 - DNA, 203 bp, Homo sapiens
  source 1..203: mol_type = other DNA
ggcgcgccagtcctgacatgcgtaagagcatgttagctgttaagctagggcaagaatatcagaatacgtgtgctcgtgaggagccccttggtgtgctgctacgtggcgaacctggacaaggaaaatcctttatgacacatctgctcgtgcgtagtgtttgcaatgctatgggctggaaggtttctgagcgactcggaccgatg

SEQ ID NO: 8613 - DNA, 203 bp, Homo sapiens
  source 1..203: mol_type = other DNA
ggcgcgccagtcctagtgtgtttagccaccctacatcaagtgagttctttgatgggtatgctgggcaaccgattcatcttatcgatgattttgggcagaatgtggaggaacctgaatataaagttttgtgccagtgtatgtcttccataccattttctgtgcctatggcttcgcttgaggaaaagggtcgactcggaccgatg

SEQ ID NO: 8614 - DNA, 203 bp, Homo sapiens
  source 1..203: mol_type = other DNA
ggcgcgccagtcctttgccttatacttcaaagttagttattgccacgacaaataaatcagattggtcatctcgtaccttgtgcgctccaggtgctttgaagcgccggtttcctattgtttataccgttcgcgcacggaggactttaaccaagaatggccttcttgatgtcaacgcacatatgagtgcacgactcggaccgatg

SEQ ID NO: 8615 - DNA, 203 bp, Homo sapiens
  source 1..203: mol_type = other DNA
ggcgcgccagtcctgatatggtgtcccttcttggccctgctgttccagttgcttcagtgttcgactattgcgctagcactggtgttgtacccatgttaaagcaagcgtcggaatctgtccttaagtggtttgattcgtgtgttgacagcatggtgtcgtttgttacacgtaacaaaaagtggattgctcgactcggaccgatg

SEQ ID NO: 8616 - DNA, 203 bp, Homo sapiens
  source 1..203: mol_type = other DNA
ggcgcgccagtccttttggtgctttaactatgagtgtgttaggtattgctatatctatgcttaaggaattggacagccagcgtccctataatcagaccgcccataagatgcctgttactaagctcacgcgtgggcgacgtgtgcttgtttcccaaggcccttataatgaattccagcattattctaaacgactcggaccgatg

SEQ ID NO: 8617 - DNA, 203 bp, Homo sapiens
  source 1..203: mol_type = other DNA
ggcgcgccagtccttactgtgtttttctccattctgggtctattacacttcatggccttgcatttggtggtaattcttttttgttttacacacatggccttgctactcttgagcgctatgataattgggtgcttgactataatgggtccatgtttgatttagatattgaaactgtggatgagttataccgactcggaccgatg

SEQ ID NO: 8618 - DNA, 203 bp, Homo sapiens
  source 1..203: mol_type = other DNA
ggcgcgccagtcctaagattgaacaaggccttacaaggtgcattgaaagtagcgattttgactatgtttttagtgccaaaagagtcttttgcaagctgttccggcaactttatgattctgaccctattgagactggatttgctgttggtatcaactgtattgctgactggaagaatttgttggacggccgactcggaccgatg

SEQ ID NO: 8619 - DNA, 203 bp, Homo sapiens
  source 1..203: mol_type = other DNA
ggcgcgccagtcctatgtatgattacatttatgattttgatctgaaaggatatgatggttctataccacgtcagctcatgatagatgcttgtcgtgtcttgagtgaaagttgtagtgatgaagagttagcctacaatttactccacaaaactgtggattcacagcatgtggtaggtaaccagcttttgcgactcggaccgatg

SEQ ID NO: 8620 - DNA, 203 bp, Homo sapiens
  source 1..203: mol_type = other DNA
ggcgcgccagtcctacagtttctggtggaatggcttcaggatcaccttttacaactattgtcaatacagcttgtaatatccttgcaaatatgactgttcttgaggaggagggtgttgagtatacgctagtgtgttatggtgatgatatactagtctccacctccgatcccatttctgtcaatgactatcgactcggaccgatg

SEQ ID NO: 8621 - DNA, 203 bp, Homo sapiens
  source 1..203: mol_type = other DNA
ggcgcgccagtcctgttgacaaaatggggcaatattttgggttcactgtcaagcttgatggtgattatcccaagactaaaaataattttacttttctaaaacggagaactacttactggaacggcattccagttggagcgatggaagttggccttttgttgcaacatcttgggtattgtcggtcagtgcgactcggaccgatg

SEQ ID NO: 8622 - DNA, 203 bp, Homo sapiens
  source 1..203: mol_type = other DNA
ggcgcgccagtccttccctacccaagccccagtacaccactatggagttctttatatcccagcgcgtggtggacgcactgtgaggtattccgataccaccccactcgcacttcctggatagtgcgttagatatgcccgacatatcgcttccaggaccaaagccccccttttctctttcccaaccagctcgactcggaccgatg

SEQ ID NO: 8623 - DNA, 203 bp, Homo sapiens
  source 1..203: mol_type = other DNA
ggcgcgccagtccttcgccactcaagctgtaattccatgtccggtctttccggccttagtatcatggaaatgtggtcgtgctcaaatgaaattgagttgacattgatcaatgaaagttgcactgaactttgctaaactggctagcgccacctggtgtgtgccgttggtctcctcacatggtaacatgtcgactcggaccgatg

SEQ ID NO: 8624 - DNA, 203 bp, Homo sapiens
  source 1..203: mol_type = other DNA
ggcgcgccagtccttatggatgaatgagtagaccccctgaaggtaccccattacatgggatctgatcagggccacattctgcgtgtctccccgcacttgtggttaaaaccatgaaagttcatcccaaacaatcttttcctcttctttttcttttagtggtgacaacctactggattggtgattaccaacgactcggaccgatg

SEQ ID NO: 8625 - DNA, 203 bp, Homo sapiens
  source 1..203: mol_type = other DNA
ggcgcgccagtccttaacatataatgtaacaggaaataacaattcctttgacactgaccaaggattaatggcttctggatccgttgcagccactggacatggaaatgcttctgccactgatgtaacctcccctgaccccatccaagctaatgccacaaaacccactaaacccaagcccactcgctctacgactcggaccgatg

SEQ ID NO: 8626 - DNA, 203 bp, Homo sapiens
  source 1..203: mol_type = other DNA
ggcgcgccagtccttcccctctaaagctgcttcttttgacgttattgctatgacctcctcccgcggtgtagatacccccccttcgacgacccgctctgctgagaaccctgcttcaatcctccaatcggcacgaactcgcaatcagactaatgctatggcatctgatgtaaaggctgaagaaactggttcgactcggaccgatg

SEQ ID NO: 8627 - DNA, 203 bp, Homo sapiens
  source 1..203: mol_type = other DNA
ggcgcgccagtcctctgctcccaacacgcaaggactagtgaccatgcccgccgctggttccggcgatggttacacatattcagcccagacccgcgactttcatcccgtgatgcaagccccaccacccctcccgcatgtagatcaccttcccgggcaaatttcatctttttctgaattggcaatgtgtccgactcggaccgatg

SEQ ID NO: 8628 - DNA, 203 bp, Homo sapiens
  source 1..203: mol_type = other DNA
ggcgcgccagtcctctcaaactgcatctggtagattgatagtgtcctacaccccccccggttttgctgccccatctaggcttactgatttatccccttctgctaaacatctttgggatttgacttcatgttcttctgtctccatccttatccccaactgtttccctggtggctgggtccctaccctcccgactcggaccgatg

SEQ ID NO: 8629 - DNA, 203 bp, Homo sapiens
  source 1..203: mol_type = other DNA
ggcgcgccagtcctttttcaatttcaaaggatttggactcatgcctcagtattccccaatcaagaccaatactcccttctatcaacccccatgcttcctgagcaatgcccgcatcccctccaagcgccaaggaggtgaagccattgacatatctggtgaaccagtgtatgtgattcgggcacctcgcccgactcggaccgatg

SEQ ID NO: 8630 - DNA, 203 bp, Homo sapiens
  source 1..203: mol_type = other DNA
ggcgcgccagtcctctttccgcaactgtacccactttgtagaagctttgactggatacaacctgcagaactcaggacttggcataactctaggattaggtgctgctgctgttgccactgcttcagtgggcgtcgcaaaaacgctccttgacgctcacttccgctccctccctcagccccgtccccgtccgactcggaccgatg

SEQ ID NO: 8631 - DNA, 203 bp, Homo sapiens
  source 1..203: mol_type = other DNA
ggcgcgccagtcctttaggaattataatactaggatgactgccctcaccaacaatgtccccgccccccgtcccgagcccgttgtcctgtatatctatggtccccctggtactggaaaatctctgcttgctaccctccttgcttcgatttttgcttaccacctttccggtgatccgaacgatgtcttttcgactcggaccgatg

SEQ ID NO: 8632 - DNA, 203 bp, Homo sapiens
  source 1..203: mol_type = other DNA
ggcgcgccagtcctcgcaacctcctggaagttatgagtactttgatggataccatggtcaatctgttcacattgtggatgatattggccaggcggtcgatggatccgactgggttcatttcccgcaaatggtgtctacctcacccttcaagccccccatggcggcgcttgaagataaggggatgctctcgactcggaccgatg

SEQ ID NO: 8633 - DNA, 203 bp, Homo sapiens
  source 1..203: mol_type = other DNA
ggcgcgccagtcctacttcacctccgattgtcctttccttaggttagaaacttgtaggcttactgtagatatggccaatgtaggagataaaatggatttcaaatttaggcacgtagatcaaattgtagatgaggttctcttgatgattcaggctaaacaccataatatcaatacctttaaacacttgacgactcggaccgatg

SEQ ID NO: 8634 - DNA, 203 bp, Homo sapiens
  source 1..203: mol_type = other DNA
ggcgcgccagtcctatgaggatgtgcaagtgcaatcctccattccgactgaagtcgaggaagcgattcgtgaaaacaaaccgctttctttcgtccagaaggtatggagttggcgcaagcccatctttgtcggtaccgctgttctgtccatgattacttctttgtctgtgctcttctctctgacctatacgactcggaccgatg

SEQ ID NO: 8635 - DNA, 203 bp, Homo sapiens
  source 1..203: mol_type = other DNA
ggcgcgccagtccttgtgtggtgccccccttgttctttccactcctgctggccctcgccttgtcggtgtacatgtagccggtgtcgctggcgttaccggttacgccgatccacttgtggatcttctgcacgccttcaaggatgctatgccccaatccctaattgtagacattccccgctctggccctccgactcggaccgatg

SEQ ID NO: 8636 - DNA, 203 bp, Homo sapiens
  source 1..203: mol_type = other DNA
ggcgcgccagtccttcgctggtagaatgatctttggccaactttttgccctcttccattccaatcctggtatgtttggctctgctgttggttgtgaccctgattttcattggactcccttcgcccattcctttaaacccttccggaatgtgtggtctcttgactattcctgttttgattctaccctcccgactcggaccgatg

SEQ ID NO: 8637 - DNA, 203 bp, Homo sapiens
  source 1..203: mol_type = other DNA
ggcgcgccagtcctcctctatcttcaattcgatgatcaataacatttgtgtgttgtctgccctcatctcccgtcctgactttgttcccacccctaacaattataggattcttgcttatggtgatgatgttttgtatgcttgtaccccagacttccacccccgtgatcttaaggctttctatgataaatcgactcggaccgatg

SEQ ID NO: 8638 - DNA, 203 bp, Homo sapiens
  source 1..203: mol_type = other DNA
ggcgcgccagtcctggaccccgctgcaagtgacccctgctactaaagaaggtgatttccctaactcctcttctctctctgatgtcacttttctgaagcgatggtttgtcccggatgaaactatcccttactactatcaccctgtgattgagcccgatacttatgaacagagtgttatgtggtctagggcgactcggaccgatg

SEQ ID NO: 8639 - DNA, 203 bp, Homo sapiens
  source 1..203: mol_type = other DNA
ggcgcgccagtcctgtggcgaatttcaggataccgtcacttctctctgctttcttgctcaccacgctggtccccgcaactacaccaattggattgctgccgtccgtgatgcttgtaaacgcaatggctatgaccctcccattttcttagaatattcttatcttcagatgcgctggatgcaacttgtgtcgactcggaccgatg

SEQ ID NO: 8640 - DNA, 203 bp, Homo sapiens
  source 1..203: mol_type = other DNA
ggcgcgccagtcctctggctaactgcctaggcctgcttggcagtataataaatcaggtgctctggccgagctaaatggctagttgtaggacttacaacctgcacctagggccgccgccatctgggttttcactcaggtggtacctcccatgcggtatctcatactcctaggtctatcccaatgagttccgactcggaccgatg

SEQ ID NO: 8641 - DNA, 203 bp, Homo sapiens
  source 1..203: mol_type = other DNA
ggcgcgccagtcctagaaagtgtggttgtcccaatgcttaagccacatttaaacgctcattgggaagagttacctagggagcctgtatgtgttgtaggttatgagatttgttcaaaatgtagcatacaggataggtgttttagaacagtcgattggttacgtccccaagatgtagtgtgtaattcatgcgactcggaccgatg

SEQ ID NO: 8642 - DNA, 203 bp, Homo sapiens
  source 1..203: mol_type = other DNA
ggcgcgccagtcctcagtgcggcttcacctaaatgtggtgaagagatggatacagaaagtagttgtgtccgagaagaaggtgaaatggatgtagattatagtgatcctttatctttgttatatgaaggaattcgtcacaattatatccccccagttgattatgagtatgaatgtggagatgataaggtcgactcggaccgatg

SEQ ID NO: 8643 - DNA, 203 bp, Homo sapiens
  source 1..203: mol_type = other DNA
ggcgcgccagtccttatatgtactgtagtttgtggaggtatgcgttttgctgctttgggtgattctcattctgaagctcaagtgaatgctgttaaaaatttcttatctgttgttggtcatattatttgtcctgaaacccacatgtttgctttatctactatacctcaacgatcgagtgaatccttggacgactcggaccgatg

SEQ ID NO: 8644 - DNA, 203 bp, Homo sapiens
  source 1..203: mol_type = other DNA
ggcgcgccagtcctcatctcttcaacattagcctcatttaagaatgttttagataagatttatgcatggcttccttctactaacccagacattattgcattagttaaggatatttttgtttcgcttttctttgctataatcactcgatctcttacacctttggttcaaggcatatctagttatgctttcgactcggaccgatg

SEQ ID NO: 8645 - DNA, 203 bp, Homo sapiens
  source 1..203: mol_type = other DNA
ggcgcgccagtccttgcacctcgctctatccatagtgctgatgcctttttgcgtaggttggatatacaagtgcgtgtggatgtagatagtaagtttgctcggtatgtacccagcgtggcagctcagcggaaagttccagatgaaagtaaaatttggttgcatcagaatcctggtaaaacattgctagacgactcggaccgatg

SEQ ID NO: 8646 - DNA, 203 bp, Homo sapiens
  source 1..203: mol_type = other DNA
ggcgcgccagtccttaagactgaagttccactccccgacttacctagtgaattggaagagtatgcaggagctttccctgcagcgcacggttcagcgacaatgtgctttgctactgactggttgggacagttcactaatctgaccgagtccctgaatttattgaacaaaacatttagccctcgtttcgtcgactcggaccgatg

SEQ ID NO: 8647 - DNA, 203 bp, Homo sapiens
  source 1..203: mol_type = other DNA
ggcgcgccagtcctttgtaaggtaaaggcattgttgtctgaaggtggttcattgatgcaattagtaggtgctcgatcgtgtgtgttcgcgtgtgatttgtgcaagcgcgttaagaaaggtgatttaaatttgcgtgttcgtagtagatctgatggaaccataacctttgtgccgagtgacgttcgtcgcgactcggaccgatg

SEQ ID NO: 8648 - DNA, 203 bp, Homo sapiens
  source 1..203: mol_type = other DNA
ggcgcgccagtcctaagtccaggtaaaccaggaaaacagacgtggctaggttcaggtgagttcatagtagataatgtggaccttaaaaaacatgttgatatgatagttgagaaagcacagaatggtgtagttgatgtaggtttaggtgtttttgcagcgaccttgaaggatgagcgtcgtcctttggacgactcggaccgatg

SEQ ID NO: 8649 - DNA, 203 bp, Homo sapiens
  source 1..203: mol_type = other DNA
ggcgcgccagtcctgaaagtcgctgcaaataagactcgagtgtttgctgcttctaatcaagggttggctttggccattcgtagatattatctagcatttatggaacatgttatgactaacagaattgataatgaaattggtttgggagttaatgtttattcttatgattggacgcgtattgtgaataacgactcggaccgatg

SEQ ID NO: 8650 - DNA, 203 bp, Homo sapiens
  source 1..203: mol_type = other DNA
ggcgcgccagtccttgtcttttatggtgatgattcattgtgttgtgtgtcagataaggtgtgtgagtggtttaatcagcatgtcatcacccgtttaatgttggtgactggacatgattacactgatgaaacaaagagtgggtctccacctccttatcgctctttgtctgaagtgtcgtttctaaagcgcgactcggaccgatg

SEQ ID NO: 8651 - DNA, 203 bp, Homo sapiens
  source 1..203: mol_type = other DNA
ggcgcgccagtcctatggtttgttattcaacgtgcgtgtaccccaggcagccccgaaaacacgcgtcaggagacagttccaaccactttgggcgaagttggtggctacgcttgcgtagtggaacttatttattgcctgctattcctactgaaattaataatgatacttcttcctcttctgctggacttcgactcggaccgatg

SEQ ID NO: 8652 - DNA, 203 bp, Homo sapiens
  source 1..203: mol_type = other DNA
ggcgcgccagtccttggcagactactgataaagagattgctcccactatgtctcatagtgaactagtatcagatttcaatcagcctttccttaaagaaatttctcttccggatgatattgtgcgtaaatctccttttatgtccgctaagcttgcaaatattgcttttgttcgcagtgattatgaaattcgactcggaccgatg

SEQ ID NO: 8653 - DNA, 203 bp, Homo sapiens
  source 1..203: mol_type = other DNA
ggcgcgccagtcctggtctggatgaaatgtcgattgagtacctagctctgcgtccctatgtacttcagcgttacaccatcaaaggtggtgatacgcctgatcctactaaaactgtcatagctgatatccccattagtcctgttaatttttccttgtttggtgctgttataaagaactatcgtactcttcgactcggaccgatg

SEQ ID NO: 8654 - DNA, 203 bp, Homo sapiens
  source 1..203: mol_type = other DNA
ggcgcgccagtcctcttgtgaccaatcatcctattatttctgaaccgattggaccttcttatgtggcgcaagatttttcatccggagatactattattattgctcaggataccctcgttacttgtgcttttgcccagtcgaccaccaatttcagtgtttctttaactaaagaggatgtttcaaccaatcgactcggaccgatg

SEQ ID NO: 8655 - DNA, 203 bp, Homo sapiens
  source 1..203: mol_type = other DNA
ggcgcgccagtcctcgtagatcaagtccagttgatattgttcgtggtgcttctgttaccttacctggtatcaatttcggcactgacaattcgctgcgacagagtttggtgaatgtaatttcctatatgtaccgttttactcatggaagcatttcttataaaattatacctaaagagaagggagatctgcgactcggaccgatg

SEQ ID NO: 8656 - DNA, 203 bp, Homo sapiens
  source 1..203: mol_type = other DNA
ggcgcgccagtccttacatcacgactgttagcccagatgtggtggagaagaatcctaatgcttatcagtttgatactaatcgtgctatgcactttatcaatacttctttgaacccaattgcccaagtcactcttcccttttatagcccggcagagaacttggtattggattcgcgctcttttccccaacgactcggaccgatg

SEQ ID NO: 8657 - DNA, 203 bp, Homo sapiens
  source 1..203: mol_type = other DNA
ggcgcgccagtcctttgagtgatctagtcattggcaatttagacaggtctgaaaatgaatattttgttcttgctagtgctggtgatgatcatactttttctcaattggctggatgtcctgcttttacttatgggccatccaggacttaaatctccgatgggagtgcaccctatgggtgtttgacccgccgactcggaccgatg

SEQ ID NO: 8658 - DNA, 203 bp, Homo sapiens
  source 1..203: mol_type = other DNA
ggcgcgccagtcctggaattgagtgtctggtacactctgtgtaacagtgaaaacaatgtgatcacttcggtgagctagtagcctgtggaccaacaactggtaacagttgcctcaggggccaaaagccacggtgtttacagcaccctactggtttgattggagcaatccaagatgtcacagagttagtacgactcggaccgatg

SEQ ID NO: 8659 - DNA, 203 bp, Homo sapiens
  source 1..203: mol_type = other DNA
ggcgcgccagtcctattgccaagcagtccgtactggtatcttgacataccgtgcagttttggatagtgaaggatgccctgacggtacccataggtaacaagtgacactatggatctaagcaggggctcactctacgctgctttacagctggctgtgagttaaaaaacgtctagctatccacaacctagcgactcggaccgatg

SEQ ID NO: 8660 - DNA, 203 bp, Homo sapiens
  source 1..203: mol_type = other DNA
ggcgcgccagtcctaattcaacacgctttcatggtggtgctttgggtgtttttatggtgccacagtttgtttacactagccaaactgatttgactggaccaaaacccttgatggcaacagattatccacttttcaaccagcaacagttgtttctgtttccacaccaaatcttgaatcctcggactaatcgactcggaccgatg

SEQ ID NO: 8661 - DNA, 203 bp, Homo sapiens
  source 1..203: mol_type = other DNA
ggcgcgccagtcctcagggtgaggacacccagataacacctgccgaaactgggcagactcctgaggttacagctgaaaattccaaccagaatgtggtgccaattccatacgcacctcagaggatttcacatagcgctgtgcgcttttggtatgacagatttttcttagctgacagccttcaggtcaaccgactcggaccgatg

SEQ ID NO: 8662 - DNA, 203 bp, Homo sapiens
  source 1..203: mol_type = other DNA
ggcgcgccagtcctatagttaaatggctgccgagccactgcaggacacaaccaccacctttcccctcttcagatgaaaacccagatgatggaagtaaagatattaagaaagaaagtgcctctagtggcttcagcctgctagttgtctttaaaaattcttctaaacctctttcagtgaattcaggtgaccgactcggaccgatg

SEQ ID NO: 8663 - DNA, 203 bp, Homo sapiens
  source 1..203: mol_type = other DNA
ggcgcgccagtcctatcaaacctaaaacagatgatgtgccattgattgatttgaccaacatggggccaaagattgactaccccggctcccataatccatttggagaatcactggccgacaagctggttcaggaaaatgagagattagttgctgaagcgcaggctgagtatgcacgccgtagtgctaatcgactcggaccgatg

SEQ ID NO: 8664 - DNA, 203 bp, Homo sapiens
  source 1..203: mol_type = other DNA
ggcgcgccagtcctggagtttggaagcaacaagaagaagatgcctccgaggaacgctttagggaaagaatgcaagtgtaccctcagatgatggaacagtatgaacagtacaagaattctcctagacaccagaaatggaatgactgcaagacatggtttgatgagatgcggaaacttgcagtattgcatcgactcggaccgatg

SEQ ID NO: 8665 - DNA, 203 bp, Homo sapiens
  source 1..203: mol_type = other DNA
ggcgcgccagtccttgttcagcacccctccatatggtgaaagctgacatacatttgttctctagtgcgtgcttgaagtttaaagaccgcatggctagatgcgagtgtagtttggttggagtctatgatagggtgatgaactctcacaaaagaaggaatgatttggccaataaattagttgaaatttttcgactcggaccgatg

SEQ ID NO: 8666 - DNA, 203 bp, Homo sapiens
  source 1..203: mol_type = other DNA
ggcgcgccagtcctcttgcagtgcgtggcaggctggttgtaatgaacttccacttgtggaatgatgcaacacacctgcagcttgatggagaatggatgccacgtgacaccatacccgcagtgagacccgctgcaaacggcatccccacagaacttgtcttcatgaactgggcaaaaaccccaggaaggcgactcggaccgatg

SEQ ID NO: 8667 - DNA, 203 bp, Homo sapiens
  source 1..203: mol_type = other DNA
ggcgcgccagtcctgtactgaagtataaagcccaaacagcaccagggttttgtggcagtgttgttgttgttgacaacggcatctggaagaaagtatttggattgcattgtgctggagcacatggtgttgggatggcagcaattatctcgcgcgagatggttgatgctatttcacagcttgctgaattccgactcggaccgatg

SEQ ID NO: 8668 - DNA, 203 bp, Homo sapiens
  source 1..203: mol_type = other DNA
ggcgcgccagtcctcacgttggtgaccgtactgatggaccattagccatgattagaggagcccgcttttatgcacgacttgtgcgagcaaagtgtggacaggtgaatgaacgactgtcgctgcacgaggcagtctttggaacagacaaccttgacccaatggaccagacgcgctctcctgggtggccgcgactcggaccgatg

SEQ ID NO: 8669 - DNA, 203 bp, Homo sapiens
  source 1..203: mol_type = other DNA
ggcgcgccagtccttacatcggtaccaagagacgcccagacctgctttggcagacggatgaaggcttggacatggatccggtgctgcgtgccgaactgatgctcatgatggaaggaaatttttcccaccacaaatttgttacctttcttaaagatgagctcagggacaaagaaaaagtgaaacaaggccgactcggaccgatg

SEQ ID NO: 8670 - DNA, 203 bp, Homo sapiens
  source 1..203: mol_type = other DNA
ggcgcgccagtccttttgttgatgtggattattcgggatttgatgcaacacactctaccttttcctttcaatgcctgaaaatttttcttcaggagcttggatttgatgatgtggccttgaaatatgtggattctttgtgtgattcaacccacatttgggatgatgagatttttaaaatttcaggaggacgactcggaccgatg

SEQ ID NO: 8671 - DNA, 203 bp, Homo sapiens
  source 1..203: mol_type = other DNA
ggcgcgccagtcctactgtccaggagaagctgttgtccgttgcccgcttggcgcaacatcgtggcgagcaggactacaaggctcttatggaaccttttgagtcttgtggctattttgttcctagctttgatgaccttgaacttgagttcttttctcttttctttggttgagttaggtgatggagttttcgactcggaccgatg

SEQ ID NO: 8672 - DNA, 203 bp, Homo sapiens
  source 1..203: mol_type = other DNA
ggcgcgccagtcctaggacataggacagatgttggatggactcaacaagagaggaaagaagaaaagaggaggaagcactggtggtttgcttttgattattagcttctcatgtgcgtgtgcccttaaggtgggatcgtacaatggaaagccgctgatcactgtaaaccaaacggacgtgcagaacccaacgactcggaccgatg

SEQ ID NO: 8673 - DNA, 203 bp, Homo sapiens
  source 1..203: mol_type = other DNA
ggcgcgccagtcctgcacgccgacgagacatgccagacggtcaagaagagcgatcacagtccatcatcatggcgaaagcctattggaagcgaagaacacaccatggatggactcaacaaaagccacaaagtacttgactaaggttgagaactgggctattcgaaatccaggatacgctctagccgcagcgactcggaccgatg

SEQ ID NO: 8674 - DNA, 203 bp, Homo sapiens
  source 1..203: mol_type = other DNA
ggcgcgccagtcctgtgtgactataacggcgaaagacaaaccaacaattgatgtcaaaatgatgaacatggaggcaactgacttggccctcgtccgctcttattgctatgaacccaaaataaccgatgtcagtacagagccacgctgcccaaccatgggagaggcccacaatacaaaggcatccagtccgactcggaccgatg

SEQ ID NO: 8675 - DNA, 203 bp, Homo sapiens
  source 1..203: mol_type = other DNA
ggcgcgccagtccttgaccatgaacatgaagagctggctagtgaacagagactggttccatgatttaaatctgccatggaccggttcagcagcaggaaattggcaaaatagagagtcactagttgaatttgaggaggcgcacgccaccaagcaatcagtggttgctttggcctctcaagaaggagccccgactcggaccgatg

SEQ ID NO: 8676 - DNA, 203 bp, Homo sapiens
  source 1..203: mol_type = other DNA
ggcgcgccagtccttgcacgcggcactggccggagcaattcctgtgaagtacacaagcagcaagctggaaatgacatcaggacacttgaaatgtagggtaaaattgcaaggattgaagttaaaaggaatgacttacccaatgtgctctaacaaattcagcctagctaggaatcccacagacacggggccgactcggaccgatg

SEQ ID NO: 8677 - DNA, 203 bp, Homo sapiens
  source 1..203: mol_type = other DNA
ggcgcgccagtcctcctttggcgactcgttcatcctagttggtagtggagaaaatcaaattaaatatcagtggcataagagtgggagctcaattggtaaagcatttgtttccaccctcaagggagcccagcgtatggtggcacttggggatactgcctgggatttcggatcagtaggaggtttctttacgactcggaccgatg

SEQ ID NO: 8678 - DNA, 203 bp, Homo sapiens
  source 1..203: mol_type = other DNA
ggcgcgccagtcctggaaaggaatatgtggagtcagatcagtgagccggttggaacacaacatgtgggattcgatcaagcatgaactcaatgccattctggaagacaacggggaggatttgacagtcgtggtggaaccaattgtgggacgtctcaggtcgacacagcgaagattgacgtggacggaagcgactcggaccgatg

SEQ ID NO: 8679 - DNA, 203 bp, Homo sapiens
  source 1..203: mol_type = other DNA
ggcgcgccagtcctaagagttggaatatggatggaagaaatgggggaaaaccctctttacgagtccaggcatgtcaaacagaacttttgtggtggatgggccaaaaacgaaagagtgtcccgatgacaagagagcttggaacagcttgtacgttgaggactttggatttggcatcacatccactagagcgactcggaccgatg

SEQ ID NO: 8680 - DNA, 203 bp, Homo sapiens
  source 1..203: mol_type = other DNA
ggcgcgccagtcctcaacagtgaaagtgacttcgacctgccatgacagggcagcatcagctcgaaccaccactgccagcgggaagctcattcaagactggtgttgcaggtcatgcacactcccaccattgagatacatgacaaaaagtggatgctggtatgccatggaaatccggccgacaacacacgcgactcggaccgatg

SEQ ID NO: 8681 - DNA, 203 bp, Homo sapiens
  source 1..203: mol_type = other DNA
ggcgcgccagtcctgtgaggacacccttatcaagtctaaggtgagcgcattcagaggcgatggcatggaaccatttcaactgggggttctcttgatgtttgtggccacacaggaagtcttgcggaagagatggacagcaggcatggcattaccagcaatgctcatgtttttatgtgctttgatctttgcgactcggaccgatg

SEQ ID NO: 8682 - DNA, 203 bp, Homo sapiens
  source 1..203: mol_type = other DNA
ggcgcgccagtcctttttggttggaattgccctttcaatgttgaccttggccatgcaagattgggacatgacaatcccgagcctgcttaactcgggagcggccgcttggttgctgctgagagctgtgagtgagggaacagtaagtgccgtctgcattccagtgctgggcatgctggctcctggacttccgactcggaccgatg

SEQ ID NO: 8683 - DNA, 203 bp, Homo sapiens
  source 1..203: mol_type = other DNA
ggcgcgccagtcctgcatcgcgggaattgacgtggttcgcataggattgctgatcatagggattatgtcgctgatgagggaacgcaacaatgcagcagcaaaaaagaaaggaggattgttgataggactggccctagcagaatctgggttgatcagccctcttgtttatgccggactaaccttggcaccgactcggaccgatg

SEQ ID NO: 8684 - DNA, 203 bp, Homo sapiens
  source 1..203: mol_type = other DNA
ggcgcgccagtccttaaaaccaaacatgaggagaggatggccggtgagtgaagcactgacagccgttggattgacgttcgcactggctggtggcatcgcacattttgatgaaggaaatatggccattccgttagcagtgggcggcataatgttggttgtggcagttgtgacagggttcacaacagatccgactcggaccgatg

SEQ ID NO: 8685 - DNA, 203 bp, Homo sapiens
  source 1..203: mol_type = other DNA
ggcgcgccagtcctacaacccttatctccttccagtgacgttgggagcttattggctcacagtcaaggctccgaaacgtagcggagcgatttgggatgttccagcaccaaaggaaagaaggaaagcagaaattagcacgggggtgtttagaatcatggccagaggaatttttggaaaataccaagctgcgactcggaccgatg

SEQ ID NO: 8686 - DNA, 203 bp, Homo sapiens
  source 1..203: mol_type = other DNA
ggcgcgccagtcctggttgttaacaccacaaagggtgcctaactacaacttattcgttatggatgaagcacatttcactgacccagccagcattgcggctcgtgggtacatttccacaaaagttgacctaggagaagcggcagccatattcatgactgcgacaccaccaggaacgagagatgcctttccgactcggaccgatg

SEQ ID NO: 8687 - DNA, 203 bp, Homo sapiens
  source 1..203: mol_type = other DNA
ggcgcgccagtcctaattaaatgggccagttcccatcacagcggctagtgcagcacaaaggaggggaagagtgggcagaaatccagtgcaagttggggatgaataccactttgctggaccgaccagtgaggatgatcacgatttcgcccattggaaggaagcgaagatcttgctagacaacatcaacccgactcggaccgatg

SEQ ID NO: 8688 - DNA, 203 bp, Homo sapiens
  source 1..203: mol_type = other DNA
ggcgcgccagtccttaccaaacggactggtggcgcaattgtatgagcctgaacgagagaaggtcttttccattgatggggagtacaggctgagaactgagcaacggaaaaactttgtagagttcttgagaacgggagacctgccagtttggatatcgcacaaactggctgacgctggaatagcttacacgactcggaccgatg

SEQ ID NO: 8689 - DNA, 203 bp, Homo sapiens
  source 1..203: mol_type = other DNA
ggcgcgccagtccttaggaaaagggatgccctttgtgtccatggacctgtcagtgcctcttcttttactcggatgttggggacagttcaccatgaccaccacactcacgacaatcgtgttgttgattgtgcactatgcattcctcgtgccaggatggcaagctgaagcaatgcgtgcagcgcaaaggacgactcggaccgatg

SEQ ID NO: 8690 - DNA, 203 bp, Homo sapiens
  source 1..203: mol_type = other DNA
ggcgcgccagtcctggacagctgctggagtgatgaagaatccagtggtggatggaatagtcgccacagacatacctgatctagacgccagtactccgattacagagaagaaattcggccaagttattctaatagttgtgggagtctgtgcagttttcctaaaaccagggaccatgtcgctaacagagtcgactcggaccgatg

SEQ ID NO: 8691 - DNA, 203 bp, Homo sapiens
  source 1..203: mol_type = other DNA
ggcgcgccagtcctccgcaaaactacggtggatggtcgagagaggttttgtgaagccacacggaaaggttatagacttgggctgcggcagaggaggctggagttattactgcgccaccttaaaattagttcaagaggtgaagggttacacaaaagggggaccaggtcatgaagaacctgtgatgatgccgactcggaccgatg

SEQ ID NO: 8692 - DNA, 203 bp, Homo sapiens
  source 1..203: mol_type = other DNA
ggcgcgccagtcctgagttgaagatttctgtgtaaaaattctttgtccatacatgcccaaggtgcttaaagagctggaaaagatgcaattaagatggggaggtggcctgatccgggttccactttcgaggaattccaaccatgagatgtactgggtgagtggagccagtggaaacatcacaaattccgcgactcggaccgatg

SEQ ID NO: 8693 - DNA, 203 bp, Homo sapiens
  source 1..203: mol_type = other DNA
ggcgcgccagtcctccaccacatggcactatgactcggagcacccttacaaaacttggaactatcatggaagttatgaagtcaaagcgaccggatcagctagctccatggtgaatggggtggtccgggtgctctcgaaaccatgggacacactgcagagtgtggtgaacatggccatgactgacacaacgactcggaccgatg

SEQ ID NO: 8694 - DNA, 203 bp, Homo sapiens
  source 1..203: mol_type = other DNA
ggcgcgccagtcctgtgaatttggaaaagcaaaaggtagccgggccatctggtacatgtggttaggttcaagatatcttgaatttgaagctctggggttcttaaacgaagaccattggatgagcagagagaacacacttggaggagtcgagggcttaggcctgcagaagcttggatacgtgctgagagcgactcggaccgatg

SEQ ID NO: 8695 - DNA, 203 bp, Homo sapiens
  source 1..203: mol_type = other DNA
ggcgcgccagtcctaagtaatgagaccaggagctgatggcataacagtgatggacgtcatctcacgggaagaccagagagggagtggacaggtggtaacatatgcactcaacacgttcaccaacctttgtgtgcagctcatacgatgcatggaaggagagggtttgctgaagccagaggaggtggagacgactcggaccgatg

SEQ ID NO: 8696 - DNA, 203 bp, Homo sapiens
  source 1..203: mol_type = other DNA
ggcgcgccagtcctttgttttagaccttagaagatagatttagatttattttagggcgatagtcaggccaggcaatgcctgccaccggaagttggatgacggtgctgtctgcgctccaaccccaggcggactgggttaacaaagtggtgatccaggagacgcaaagcgttcactaccgtttcggagaacgactcggaccgatg

SEQ ID NO: 8697 - DNA, 203 bp, Homo sapiens
  source 1..203: mol_type = other DNA
ggcgcgccagtcctctccctggcgttcgaatggaacactgcccaaagtcaggccgtaggttttacgccactagcatgcagtgctgcctgagacaagacatgccccaggaggactgggaaaacaaagccgttaaggcccccgcggcccaagcaagggaatggtgtgccccttgtggaaggtctagaggtcgactcggaccgatg

SEQ ID NO: 8698 - DNA, 203 bp, Homo sapiens
  source 1..203: mol_type = other DNA
ggcgcgccagtcctaaaacaaagccgttaaggcccccgcggcccaagcaagggaatggtgtgccccttgtggaaggtctagaggttagaggagaccccgcggaaatcaaagcaaggcccaacctggcaaagctgtaaaccaggggaaggactagaggttagaggagaccccttgcgagtgaacaccaccgactcggaccgatg

SEQ ID NO: 8699 - DNA, 203 bp, Homo sapiens
  source 1..203: mol_type = other DNA
ggcgcgccagtcctagaacagtcgtcagtagttcaacgctggtaaaccccagccttgagatgctacgtggacgagggcatgcccaagacacaccttaacctggacgggggtcgtccaggtgaaagtacccatctttgggtgctgggagtacagcctgatagggcgctgcagaggcccactgacaggctcgactcggaccgatg

SEQ ID NO: 8700 - DNA, 203 bp, Homo sapiens
  source 1..203: mol_type = other DNA
ggcgcgccagtcctatgacaggggtaggggggaggtgaggacaactctggaaaaacttccacgtaagggagattgtaggagtggcaatcaactaggaccggtaagtggaatttacataaaaccaggtccgatttactaccaagattatgcaggcccagtctaccacagagcaccattagaactatttgcgactcggaccgatg

SEQ ID NO: 8701 - DNA, 203 bp, Homo sapiens
  source 1..203: mol_type = other DNA
ggcgcgccagtcctgggatagaccaacaaccctaacggggtgcaagaagggtaagaagttttcttttgcgggtatcattatggagagcccctgcaacttcaacgtctctgcggaggacatcttatatggggataatgggtgtggtaacctcttccaggacacggctttgtacgtcgttgacggagtcacgactcggaccgatg

SEQ ID NO: 8702 - DNA, 203 bp, Homo sapiens
  source 1..203: mol_type = other DNA
ggcgcgccagtccttatacttggttcttcatttcaccatcccccagtcttatgagaaccccaaagactgtgataagaatcagttaaacctgaccattggtcttagaacagaagacgtcgtgccctcatcagtctggaacattggtaagtatgtttgcatcaggccggactggtggccttacgagacaacgactcggaccgatg

SEQ ID NO: 8703 - DNA, 203 bp, Homo sapiens
  source 1..203: mol_type = other DNA
ggcgcgccagtcctgggcgcaagggcaatttacttgtgagaaaaactataggtatgctatagcaaaaacaactgatgtggggttgcttggtgctgaaggcttgaccaccacttggagggaatacaaaaacaattttgaacttgatgatggattactgagagcagtatgcaaatctggtttcttcacttcgactcggaccgatg

SEQ ID NO: 8704 - DNA, 203 bp, Homo sapiens
  source 1..203: mol_type = other DNA
ggcgcgccagtcctggaagtataacgcaacccttctgaacggtagtgctttcaatctcgtttgcccaattgggtggactggggtagtggaatgtacagtgataagtgagtccactctgcacaccgaagtcgtgaaggtgttcaggagagataagccattcccatctaggaaatactgtgttgacaccacgactcggaccgatg

SEQ ID NO: 8705 - DNA, 203 bp, Homo sapiens
  source 1..203: mol_type = other DNA
ggcgcgccagtcctatgaaactggatatagactggtggatggaaccacatgtaacagacatggggtgataatagaccagacaggtagccatgagtgcctaataggcaagaccaaaataaaagtgtatccagttgatgacaaactggggccaatgccttgcagacctaaggagattatatccagtgaagcgactcggaccgatg

SEQ ID NO: 8706 - DNA, 203 bp, Homo sapiens
  source 1..203: mol_type = other DNA
ggcgcgccagtcctctgttggcatagtagtgtcgatgctgattgccagaagagaccccacgacaataccacttataataactgttgtaaccttgaggactacggggctggcaggtgggctagcaacagacttggccatagcgaccgtaacaacagtgctactaatgtggaccttcattagtgattactcgactcggaccgatg

SEQ ID NO: 8707 - DNA, 203 bp, Homo sapiens
  source 1..203: mol_type = other DNA
ggcgcgccagtccttactagagatatcctactatctccacaggaagatcatagaagaagttgcagggggaacaaacttgctatccagatttatggcagcattgatagagactaactggactcttgataacaacgaggtcagggggttaaaaaaattctacctactatccagcagagtcaggagccttacgactcggaccgatg

SEQ ID NO: 8708 - DNA, 203 bp, Homo sapiens
  source 1..203: mol_type = other DNA
ggcgcgccagtccttgcctagaggtacgacaccaagggcaccggtgaggttccctacgtcactgctgaaaatcaggagggggctagaaactggatgggcgtacactcaccaaggcggcatcagttcagttgaccacgttacatttggaaaagacctgcttgtttgtgattccatgggtaggacaagggcgactcggaccgatg

SEQ ID NO: 8709 - DNA, 203 bp, Homo sapiens
  source 1..203: mol_type = other DNA
ggcgcgccagtcctccacagatttaacagacttggtgaggaagataacagctatgaatagaggagaatttaaacagataaccttagcaacaggtgcaggaaagaccactgagctccctaggtcagtcatagaagaaataggtcggcacaagaggatactcgtcttgatcccactaagagcagcagcagcgactcggaccgatg

SEQ ID NO: 8710 - DNA, 203 bp, Homo sapiens
  source 1..203: mol_type = other DNA
ggcgcgccagtcctagtctgtataccagtatatgaggcaaaagcaccccagtatatcattcaatctgagaattggcgagatgaaggaaggagacatggctactggtataacctatgcttcttatggatacttctgtcagatgcctcagcccaagcttagagcagccatggttgagtattcttacatctcgactcggaccgatg

SEQ ID NO: 8711 - DNA, 203 bp, Homo sapiens
  source 1..203: mol_type = other DNA
ggcgcgccagtcctggctggcttttgggggggagacactgtccgaccatataaaacaagctgccactgatctagtagtctattatatcatcaatagaccccagttcccgggggatactgagacccaacaggaagggaggaaatttgtggctagcctcttggtgtcagcccttgctacatacacgtacacgactcggaccgatg

SEQ ID NO: 8712 - DNA, 203 bp, Homo sapiens
  source 1..203: mol_type = other DNA
ggcgcgccagtccttattaggcactggagttagcgcagcaatggaaataatgtcacaaaatcctgtatcggttggaattgctgtgatgctgggagtgggtgcagtggccgcccacaatgccatagagtcaagtgaacagaaaaggacactattgatgaaagtatttgtaaaaaactttcttgaccaggcgactcggaccgatg

SEQ ID NO: 8713 - DNA, 203 bp, Homo sapiens
  source 1..203: mol_type = other DNA
ggcgcgccagtcctctgccactgatgaattggtgaaagagagccctgaaaagataataatggccctgtttgaagcagtgcaaacggtaggaaaccctcttaggttgatttaccatctgtacggggtcttctacaaaggatgggaagctaaggaactagcagaaaggacagcaggaagaaacctattcacgactcggaccgatg

SEQ ID NO: 8714 - DNA, 203 bp, Homo sapiens
  source 1..203: mol_type = other DNA
ggcgcgccagtccttggccgaggtggaagtagacctactgagatacgtggactacaaaggtacattccttactagagagaccctggaggctctaagcctggggagaccaaaaccaaaagatctaacgaaagcagaagcaatgaggttgctccatccggaatcagggctggtagagttgcctgactggtcgactcggaccgatg

SEQ ID NO: 8715 - DNA, 203 bp, Homo sapiens
  source 1..203: mol_type = other DNA
ggcgcgccagtcctttatgcaagtagagaacaagcacaacaacttgacccctctgttcgaagagctcatgcttcgatgcccgcctgggaaacagatgaggtccgagcacatggtcaccgcataccaattggcccagggcaactggatgccaaccagctgtaatgtattcttagggacaataccggccacgactcggaccgatg

SEQ ID NO: 8716 - DNA, 203 bp, Homo sapiens
  source 1..203: mol_type = other DNA
ggcgcgccagtcctgagtagctgaacagctccagagggaaggccacaagcacaacgtgtacaacaagattataggctctaccatgacggcagtggggattaggctagaaagattaccggtagtgagagctcaaactgacaccaccagtttccaccaggctataagagataagatagacaagagggaaacgactcggaccgatg

SEQ ID NO: 8717 - DNA, 203 bp, Homo sapiens
  source 1..203: mol_type = other DNA
ggcgcgccagtcctacttgcaaaccccaggcctacacggcaagctgctggaaatattcaacaccctgaagaaaaatgatttggcacaaacatatgatgctgtagaatgggaagaactagaacgtggagtaaaccgaaagggtgctgctggattcttcgagcataaaaacataggagaagttttgaacacgactcggaccgatg

SEQ ID NO: 8718 - DNA, 203 bp, Homo sapiens
  source 1..203: mol_type = other DNA
ggcgcgccagtccttcagactggcaatcacaaaagtgatgtataagtgggtgaaacagaagccggtggtaatacctgggtatgaaggcaagacgcccttgtttgaggtctttgacaaggtaaagaaagagtgggaccagttccacaacccagtggccgtaagttttgacacaaaagcatgggacacaccgactcggaccgatg

SEQ ID NO: 8719 - DNA, 203 bp, Homo sapiens
  source 1..203: mol_type = other DNA
ggcgcgccagtccttggcaaccaggttggactctagtggagaaagagggacaacggcatatgaaaaagccgttgcgttcagttttctattgatgtactcatggaaccccttggttaggaggatttgcttgctcacgttgtctactgagccagaagtgaagccaagcaaggcgacaacttattactacgcgactcggaccgatg

SEQ ID NO: 8720 - DNA, 203 bp, Homo sapiens
  source 1..203: mol_type = other DNA
ggcgcgccagtcctaaatcccggccgcgtgttgtgattgtgttagggcaggtgacagtcggcagggtcgaccccctgcttcaggaccactgtcttcctggacgaccgttgctgaaaaagggccgccacggtctgtagctcgccgacgcttctaattcaggccggaggaccacgctccgtaatcgagcccgactcggaccgatg

SEQ ID NO: 8721 - DNA, 203 bp, Homo sapiens
  source 1..203: mol_type = other DNA
ggcgcgccagtcctcaagtactcaaaccccagcacccctgggtcacgccctacgccgcccttttaacgcttcggctaatagggtctatccggcgggttgacaaagggcgcagggttacctggtactacgagcttgggtgtccctgggagtaatcccagggtgccatgctgcagcgcaggcgggcgaggcgactcggaccgatg

SEQ ID NO: 8722 - DNA, 203 bp, Homo sapiens
  source 1..203: mol_type = other DNA
ggcgcgccagtcctgtggtgcctcggcctaggggaagagcgcaagtgaccccgtgctgcataaatccccccccttttttctacatgggtgttccatgtgccgccaagatggcgctgttgttgcttttcctggccggcgtggctgctgccccctcgcatctctgcgagtgggaaggcaaaccttacttgcgactcggaccgatg

SEQ ID NO: 8723 - DNA, 203 bp, Homo sapiens
  source 1..203: mol_type = other DNA
ggcgcgccagtcctcattcatggcttgcttacgttgcaggtgttgggggcgtcggggagctgtatggcgcggggctcatcgcgggtctcgctgctgtttcagctgtcccggcttctactccccctttaaactgctctgttgagtgcgcttgggggtatgaggtaatgcttggcccggtcaggtcctggcgactcggaccgatg

SEQ ID NO: 8724 - DNA, 203 bp, Homo sapiens
  source 1..203: mol_type = other DNA
ggcgcgccagtcctctccttgagcttggttcctcttccgggttttggctgcttcagcttcctggcgctctctggtcttttgttgcaagtgttagtcctgtttttcttgttctgttggccttgctcttcttggaggggcgctggcctctaattgtagctcttgtcgccatccggttgctagtttgcccgcgactcggaccgatg

SEQ ID NO: 8725 - DNA, 203 bp, Homo sapiens
  source 1..203: mol_type = other DNA
ggcgcgccagtcctgcatctttgcgcatgggagagaatgagtcttgcatttgtggccctaaaatttctgaccatctacgagctatccaatatgtcaactacactcctggccttcgcatccagctgcgtgcgtccccccaggttgcgttacacggagcgcttgttccgttgacgctgacctacgggccgcgactcggaccgatg

SEQ ID NO: 8726 - DNA, 203 bp, Homo sapiens
  source 1..203: mol_type = other DNA
ggcgcgccagtcctctcaggggtggtattgtttgggcttaccctcttgatggcatggcttggttccctgtggaatccttttctgttcctcccaccggttgggactgcactgtcaatactgattatcagttttgggagtgcgtcgactccacacgataccggcgggctatagtgtgccgtgcattcacgcgactcggaccgatg

SEQ ID NO: 8727 - DNA, 203 bp, Homo sapiens
  source 1..203: mol_type = other DNA
ggcgcgccagtcctaccactacctccagtaacacctcttcccctacccaactttgctttgactatgtcggcccatcccaggatccttgcaagatctatgcttggcaaaacatctctgcttgctttcgaagaggctggggcaacctgacctctgcgtttgctggccttgctggggtgccgggtgccttgcgactcggaccgatg

SEQ ID NO: 8728 - DNA, 203 bp, Homo sapiens
  source 1..203: mol_type = other DNA
ggcgcgccagtcctttggctatcctcgccatcgcggttcttggtcggccggggaggtctgccttgggcttggaggtgtgctttgatgtgtcagggcccgggtgggatgtgccggatggaattctaccatggtgctttgctggtgttgtgtccgggctgttaattcacctggccacattcaaccactggcgactcggaccgatg

SEQ ID NO: 8729 - DNA, 203 bp, Homo sapiens
  source 1..203: mol_type = other DNA
ggcgcgccagtccttattgctttgttgctatttgctttgatctctttgatatgttccttgaagcttgcctctgttctcaaccctctgtgtcgagtgtggctgctcttttggaggttgccgcgcgcgcccgcagcagtagtctagttcgctggattattgtgcgggcgcgtgcgaggggtgtgttgctccgactcggaccgatg

SEQ ID NO: 8730 - DNA, 203 bp, Homo sapiens
  source 1..203: mol_type = other DNA
ggcgcgccagtccttatcaacatcggggtgatgtgccctggagggctgtctcgttcctgaaggaattggagtgcgcgctggagcccgtttctgtctctgctgaggatctggaagtcgtgcgtgacgcggcaggtgtcctggagtgcggtaagttcttcaggggtaagcctgtcgtcgcgcgccgcggccgactcggaccgatg

SEQ ID NO: 8731 - DNA, 203 bp, Homo sapiens
  source 1..203: mol_type = other DNA
ggcgcgccagtcctgctgcgagccggtctatgggtacctgtgtggggggtgtcatgttcacaacgtggcactcctcgcaggggcgcacattggctggtccgactggtcctctcaatccgcggtggtggtcggtcagtgacgacactgccgcttacccaattcccttaggttccagatgtatggacgtccgactcggaccgatg

SEQ ID NO: 8732 - DNA, 203 bp, Homo sapiens
  source 1..203: mol_type = other DNA
ggcgcgccagtccttgcacctgtggcacccggagcgcatgggtaatgcgtcgtgatgggggcctagcccatggagagttgtcaccagtgaatgaagtcaggttggatgtctctggcagggtccgtgctttccgcggggcctccggcagtcctgtcatgtgtgaccaggggcacgtggtgggcatgatgcgactcggaccgatg

SEQ ID NO: 8733 - DNA, 203 bp, Homo sapiens
  source 1..203: mol_type = other DNA
ggcgcgccagtcctgtgtcggtcctccatcgagggcctgatgccttcgctgtccgctatgttgagccctggaaggccttacctgcagatgttcagagcccactgtcccccctctctcctcctccggtcccagcaatgggagcctatgaggagaggtcgctgttcgtgccgacggggtccggaaagtcccgactcggaccgatg

SEQ ID NO: 8734 - DNA, 203 bp, Homo sapiens
  source 1..203: mol_type = other DNA
ggcgcgccagtcctaccctggtccctgccagttacgccaaggaagggcacaaggtccttgttctaaatcctagcgtggccacgaccgcgtcgatgctcgattacatgaaggagctgactggtgtcagccccagcgtgttttgcgggcacggggcgaacgcgatcacgcggcggacgcagagcaagattcgactcggaccgatg

SEQ ID NO: 8735 - DNA, 203 bp, Homo sapiens
  source 1..203: mol_type = other DNA
ggcgcgccagtcctgccgtgtcttggtataatatgacctctgaccaggcagcgcgcctcctgcgggcctacgcaggttgcgcgtatacttgtcacatctctacacacattgaggatgccacgcgtgcagttgcggcgctgagcgctttctccacgcaccctcaagtcactcggttgcgcaatgcatcccgactcggaccgatg

SEQ ID NO: 8736 - DNA, 203 bp, Homo sapiens
  source 1..203: mol_type = other DNA
ggcgcgccagtcctgcgatcgctgaggctcttggtgagagtgtcacggagacggctgctggaccgattctgttggtgggcttggctgcggctgcggccctggccattggggattataccggaagcctggtcgtggtagccgaagtggtggttgagcccggagggaatccagtccccccttctgggccccgactcggaccgatg

SEQ ID NO: 8737 - DNA, 203 bp, Homo sapiens
  source 1..203: mol_type = other DNA
ggcgcgccagtcctgtgaagaatacatctgttggtcagggcttcctgcgagcgtggacggcgcttacaggaaatatcggccctgtggtgtccctggtgacggcggcgtgggcggcggggcggtcccccccccttgcctgcgcggcctccctcctacttggtctgcaagctgctctcccgctggagacgcgactcggaccgatg

SEQ ID NO: 8738 - DNA, 203 bp, Homo sapiens
  source 1..203: mol_type = other DNA
ggcgcgccagtcctcgactgccttgcgcaattctggccggggctatcggtacttgtactggtacccccgaagcagggttgggcatgatgggagcgtttatggttggaggtgcagtggggtctcttagcgtcttcggcttcctcttggaggtcttgggcggctgggaggccacagctactactgcttctcgactcggaccgatg

SEQ ID NO: 8739 - DNA, 203 bp, Homo sapiens
  source 1..203: mol_type = other DNA
ggcgcgccagtcctccaagagggcaagtcctgccagacggatatttccttgaggaggacgtcactgctcgtgcaagcgaactccttaagcggatgtccatctccagggctgtcatgagtgtgctggaatgtgttcatcagcagtatgagactaggacagatggcagtgtgttttggacgatcgttgcccgactcggaccgatg

SEQ ID NO: 8740 - DNA, 203 bp, Homo sapiens
  source 1..203: mol_type = other DNA
ggcgcgccagtcctgcttgccttgacggtgcgaggcggtttcttgactggatcattgcttatgtgaaggacaggataccatcagtggctatccctctcgtgtcatgtcaacgaggctacaccggcccttgggttggttcgggggcagttacagctaactgcacctgcggagcactcttcacggcgcatcgactcggaccgatg

SEQ ID NO: 8741 - DNA, 203 bp, Homo sapiens
  source 1..203: mol_type = other DNA
ggcgcgccagtcctaccgttcgagaggcgggagttccgctagatgaccgaggcatgcccgagattatcccccctccccccccaacgcctgcgttgcaggggggtgcggtggctaatactcctgacaatatcttgttggctccacctctatcacaggccactcctcagtatgttaccagaattttcacccgactcggaccgatg

SEQ ID NO: 8742 - DNA, 203 bp, Homo sapiens
  source 1..203: mol_type = other DNA
ggcgcgccagtcctcatcgggctcttgcggctactggagccctggaggtcgccaccggcgtcacccccacgcagtccgggtcgagcaccgacggggacactcctgcctcggcagaggcgggtcgtgtttctcgcgtgatgcaggccgttcggtctgcattcgattccgtgctgggtgatggaggcgtccgactcggaccgatg

SEQ ID NO: 8743 - DNA, 203 bp, Homo sapiens
  source 1..203: mol_type = other DNA
ggcgcgccagtccttcatcaatcactcccagtgatgtggagagagagatggagatcttcgcgtgcaaccatgctaatgcgccactggtccgtgctttggggaaatactatgcatcaggtcccatggtgaacgggagcggtgtggaagtcggagttcggcattgccgggcttccggagtttacaccactcgactcggaccgatg

SEQ ID NO: 8744 - DNA, 203 bp, Homo sapiens
  source 1..203: mol_type = other DNA
ggcgcgccagtccttcctctgcaaattcaattacatgttggcttaaggtttctgctgcctgtcgcaagataggcttgcaaaacccgtccttccttatccatggagatgactgcctcatcatttgtgagcgtaccgatgagccttgcgctgcgcgtctgaaagcggcgctcgcctcatacggttatgcccgactcggaccgatg

SEQ ID NO: 8745 - DNA, 203 bp, Homo sapiens
  source 1..203: mol_type = other DNA
ggcgcgccagtccttacacgttgagctacccttggcatccattgactaggcatgtgttgattccgacactgcttacccctttgtttgccgctgggaagtctccacgtgagactatctgttgtgaggtcgcgggcaaccgcatccactttccgctcttatcattaccatcgattttggtctcgttgcaccgactcggaccgatg

SEQ ID NO: 8746 - DNA, 203 bp, Homo sapiens
  source 1..203: mol_type = other DNA
ggcgcgccagtcctggccaggacgtcctagatgttcgggccgattcaacaaagacactgtcagaagcacaaaaagcattgcaggccttgtcgatgcgggggctgagctggtaccgcaagagggctaccatcctgcgcacccgcctcatcagggctgggggagagtgggcctacctcgcacgcacgttgcgactcggaccgatg

SEQ ID NO: 8747 - DNA, 203 bp, Homo sapiens
  source 1..203: mol_type = other DNA
ggcgcgccagtcctgggctcgacacggctatagagctaatgacgcgccatgcccacttaattgtggggatgtcgtggatggcctatttccttgcggctctggtgtgactccagccgatgcccttacagggcattcttccttcctgctcccctaactctgcgtgagatcggggcaggtactgtgcgcttcgactcggaccgatg

SEQ ID NO: 8748 - DNA, 203 bp, Homo sapiens
  source 1..203: mol_type = other DNA
ggcgcgccagtcctctctctaactcttcgtgagattgaggggcttgcagtctttccgccaatctaactctacgtgagattttggcgggcctccctgctcccctaactctgcgtgagatcggggcaggctctgttcgcttctctctaactcttcgtgagattgaggagcttgcagttcttccgccaatccgactcggaccgatg

SEQ ID NO: 8749 - DNA, 203 bp, Homo sapiens
  source 1..203: mol_type = other DNA
ggcgcgccagtcctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggcgactcggaccgatg

SEQ ID NO: 8750 - DNA, 203 bp, Homo sapiens
  source 1..203: mol_type = other DNA
ggcgcgccagtcctatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctcgactcggaccgatg

SEQ ID NO: 8751 - DNA, 203 bp, Homo sapiens
  source 1..203: mol_type = other DNA
ggcgcgccagtcctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgactcggaccgatg

SEQ ID NO: 8752 - DNA, 203 bp, Homo sapiens
  source 1..203: mol_type = other DNA
ggcgcgccagtcctcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacccgactcggaccgatg

SEQ ID NO: 8753 - DNA, 203 bp, Homo sapiens
  source 1..203: mol_type = other DNA
ggcgcgccagtcctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcacgactcggaccgatg

SEQ ID NO: 8754 - DNA, 203 bp, Homo sapiens
  source 1..203: mol_type = other DNA
ggcgcgccagtcctaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggcgactcggaccgatg

SEQ ID NO: 8755 - DNA, 203 bp, Homo sapiens
  source 1..203: mol_type = other DNA
ggcgcgccagtcctcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagacgactcggaccgatg

SEQ ID NO: 8756 - DNA, 203 bp, Homo sapiens
  source 1..203: mol_type = other DNA
ggcgcgccagtcctatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctcgactcggaccgatg

SEQ ID NO: 8757 - DNA, 203 bp, Homo sapiens
  source 1..203: mol_type = other DNA
ggcgcgccagtcctgtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgcgactcggaccgatg

SEQ ID NO: 8758 - DNA, 203 bp, Homo sapiens
  source 1..203: mol_type = other DNA
ggcgcgccagtcctcgacgccccacgtacgggaacgccgccaaaaccttcgggacagctatgcgggttgacaatcccagtggggggccggggaccagctgattacttgtcctgcgagttcctcttgagactggccgaaaggcagccacggggccaccaaggcggcgcagcgctgcatgcggcaaggggcgactcggaccgatg

SEQ ID NO: 8759 - DNA, 203 bp, Homo sapiens
  source 1..203: mol_type = other DNA
ggcgcgccagtcctgttgttcccgagacgaggtttacttctgtttcggggacggatgtctggtggcttatggctgtactgtttgcacacagtcttgctggaagctctaccggcctggggtggctactcggcccgggtccgaaccaggtgagctgctggggagatttgggagtgtaattggtccggtgtcgactcggaccgatg

SEQ ID NO: 8760 - DNA, 203 bp, Homo sapiens
  source 1..203: mol_type = other DNA
ggcgcgccagtcctcggcttcggcttacaccgctggagtcctcgggttgggtgaaccttacagtttggccttcttggggacgttcctcaccagtcgcctctcacggattcccaacgtcacctgcgtgaaggcttgtgaccttgagtttacctacccaggcttgtccatcgattttgactgggcgtttacgactcggaccgatg

SEQ ID NO: 8761 - DNA, 203 bp, Homo sapiens
  source 1..203: mol_type = other DNA
ggcgcgccagtcctcaccttgtgcttcttgcgtcgttgaccagaggccgctgaaatgtggttcctgcgtccgcgactgctgggagacggggggtcctgggttcgatgagtgcggtgtcggtactcggatgacgaagcacctcgaggccgtcctggttgatggaggtgtggagtccaaggtgacaacgccgactcggaccgatg

SEQ ID NO: 8762 - DNA, 203 bp, Homo sapiens
  source 1..203: mol_type = other DNA
ggcgcgccagtcctaaggcaacagacagcaggtttacagtggtcagcgaaggtcttcgccggcttggttgcttactgacatggtcctggccctgttggtggtgatgaagttggctgaggctagagttgtccccctgtttatgctggcaatgtggtggtggttgaatggagcatctgctgccactattgcgactcggaccgatg

SEQ ID NO: 8763 - DNA, 203 bp, Homo sapiens
  source 1..203: mol_type = other DNA
ggcgcgccagtcctctctcggcaaggtggtggatttagatatgcccgctgagttgtcagactttcgcgggtcttctggatcaccaatcttgtgcgatgagggtcatgctgttggcatgctgatttcggtgcttcatagggggagtagggtttcctcggtgcggtataccaaaccttgggaaactctcccgactcggaccgatg

SEQ ID NO: 8764 - DNA, 203 bp, Homo sapiens
  source 1..203: mol_type = other DNA
ggcgcgccagtcctagttgcacgtcaccgacccgacctcaattttggggatgggtcgggcgaggttactcgctcgcgagtgcggcgtacgcctcctgcttttcgctacggcgaccccaccggtctctccgatggcgaagcatgaatctattcatgaggagatgttgggcagtgagggggaggtcccctcgactcggaccgatg

SEQ ID NO: 8765 - DNA, 203 bp, Homo sapiens
  source 1..203: mol_type = other DNA
ggcgcgccagtcctgcgccacagacgcactttccactggttacactggcaattttgacaccgtaacagactgtggtttaatggttgaggaggtagtggaagtgaccctggacccgaccatcactatcggtgtgaagaccgtcccggcccctgccgaactgagggctcagaggcgtggtaggtgtggcccgactcggaccgatg

SEQ ID NO: 8766 - DNA, 203 bp, Homo sapiens
  source 1..203: mol_type = other DNA
ggcgcgccagtcctacctacattatacctccctactgtgcagacattactacaagaggacagtgcctgttggcgtcatgggcaatgctgagggagcagtcccccttgtgcctactggcggtggaatcaggacttaccaaattgggacttctgactggtttgaggctgtggtcgtgcatgggacaatcacgactcggaccgatg

SEQ ID NO: 8767 - DNA, 203 bp, Homo sapiens
  source 1..203: mol_type = other DNA
ggcgcgccagtcctcggtgcacgccaccagttgctatgagttgaaagctgctgacgttcggagggcggtgcgagccggcccgacttacgttggtggcgtaccttgcagctggagcgcgccgtgtactgcgcctgcgctcgtttacaggctaggccagggcatcaaaatcgatggagcgcgccgactgtcgactcggaccgatg

SEQ ID NO: 8768 - DNA, 203 bp, Homo sapiens
  source 1..203: mol_type = other DNA
ggcgcgccagtccttgccctgtgacttagcacagggagcgcgccaccccccggtatctggcagtgttgccggtagtggttggacagatgaggacgagagggacttggtggaaaccaaggctgccgccatcgaggccattggggcggccttgcacctcccttcaccggaggctgctcaggccgctctagcgactcggaccgatg

SEQ ID NO: 8769 - DNA, 203 bp, Homo sapiens
  source 1..203: mol_type = other DNA
ggcgcgccagtcctacccggacggtcaccaactgtttgacgagcgaggtccgatagaggtatctactcctatatgtgaagtgattggggacatcaggcttcagtgtgaccaaattgaggaaactccaacatcttactcttacatctggtcaggggcgcccttgggtactgggagaagtgtcccccaaccgactcggaccgatg

SEQ ID NO: 8770 - DNA, 203 bp, Homo sapiens
  source 1..203: mol_type = other DNA
ggcgcgccagtcctccatgacgcgccctatagggacccatctgacttgtgacactaccaaagtttatgttactgaccctgatcgggccgctgagcgggccgagaaggttacaatctggaggggtgataggaagtatgacaagcattatgaggctgtcgttgaggctgtcctgaaaaaggcagccgcgacgactcggaccgatg

SEQ ID NO: 8771 - DNA, 203 bp, Homo sapiens
  source 1..203: mol_type = other DNA
ggcgcgccagtcctcgaagtctcatggctggacctattcccaggctatagctaaagttaggcgccgagcagccgctggatacggcagcaaggtgaccgcctccacattggccactggttggcctcacgtggaggagatgctggacaaaatagccaggggacaggaagttcctttcacttttgtgaccacgactcggaccgatg

SEQ ID NO: 8772 - DNA, 203 bp, Homo sapiens
  source 1..203: mol_type = other DNA
ggcgcgccagtcctagcgagaggttttcttctccaaaactacccgtaagcccccaagattcatagttttcccacctttggacttcaggatagctgaaaagatgattctgggtgaccccggcatcgttgcaaagtcaattctgggtgacgcttatctgttccagtacacgcccaatcagagggtcaaagcgactcggaccgatg

SEQ ID NO: 8773 - DNA, 203 bp, Homo sapiens
  source 1..203: mol_type = other DNA
ggcgcgccagtcctctatggtttccccagatggggttcccttggggtaccgccagtgtaggtcgtcgggcgtgttaacaactagctcggcgaacagcatcacttgttacattaaggtcagcgcggcctgcaggcgggtggggattaaggcaccatcattctttatagctggagatgattgcttgatcacgactcggaccgatg

SEQ ID NO: 8774 - DNA, 203 bp, Homo sapiens
  source 1..203: mol_type = other DNA
ggcgcgccagtcctccccccccccggcactgggtgcaagccccagaaaccgacgcctactgaagtagacgtaatggccccgcgccgaaccggcgaccggccaaaaggtggtggatgggtgatgacagggttggtaggtcgtaaatcccggtcatcctggtagccactataggtgggtcttaaggggagcgactcggaccgatg

SEQ ID NO: 8775 - DNA, 203 bp, Homo sapiens
  source 1..203: mol_type = other DNA
ggcgcgccagtcctgctacggtccctcttgcgcatatggaggaaaagcgcacggtccacaggtgttggtcctaccggtgtaataaggacccggcgctaggcacgccgttaaaccgagcccgttactcccctgggcaaacgacgcccacgtacggtccacgtcgcccttcaatgtctctcttgaccaatcgactcggaccgatg

SEQ ID NO: 8776 - DNA, 203 bp, Homo sapiens
  source 1..203: mol_type = other DNA
ggcgcgccagtcctgccttactcctctcttggtgtgcgtggcggccctcctcctgctggagcagcgtattgtcatggtcttcctcctggtcactatggcgggcatgtcgcaacgcgcgcccgcctcagtgttggggtcacggcctttcgaggccgggttgacttggcagtcttgttcttgcaggtcgacgactcggaccgatg

SEQ ID NO: 8777 - DNA, 203 bp, Homo sapiens
  source 1..203: mol_type = other DNA
ggcgcgccagtcctacgggtcccgcgtgccgacgggggagagggtttgggaacgtgggaacgtcacacttttgtgtgactgccccaacggtccttgggtgtgggtcccggccctttgccaggcaatcggatggggcgaccctatcactcattggagccacggacaaaatcagtggcccctttcttgtccgactcggaccgatg

SEQ ID NO: 8778 - DNA, 203 bp, Homo sapiens
  source 1..203: mol_type = other DNA
ggcgcgccagtcctcccaatttgtctacggcgccgtttcagtgacctgcgtgtggggttctgtgtcttggtttgcttccactgggggtcgcgactccaaggttgatgtgtggagtttggttccagttggctctgccagctgcaccatagccgcactgggatcttcggatcgcgacacagtggttgagccgactcggaccgatg

SEQ ID NO: 8779 - DNA, 203 bp, Homo sapiens
  source 1..203: mol_type = other DNA
ggcgcgccagtccttctccgagtggggaattccctgcgccacttgtatcctggacaggcggcctgcctcgtgtggcacctgtgtgagggactgctggcccgagaccgggtcggtacgtttcccattccacaggtgtggcgcgggaccgaggctgaccagagaccttgaggctgtgcccttcgtcaatacgactcggaccgatg

SEQ ID NO: 8780 - DNA, 203 bp, Homo sapiens
  source 1..203: mol_type = other DNA
ggcgcgccagtcctctgatgggttcatacatgttcagggccacttgcaggaggtggatgcgggcaacttcattccgcccccacgctggttgctcttggactttgtatttgtcctgttatacctgatgaagctggcagaggcacggttggtcccgctgatcctcctcctgctatggtggtgggtgaacccgactcggaccgatg

SEQ ID NO: 8781 - DNA, 203 bp, Homo sapiens
  source 1..203: mol_type = other DNA
ggcgcgccagtccttgtggaagctcgctcggggggctttcccgctggcattactgatggggatttccgccactcgcggccgcacctctgtgcttggcgccgaattctgctttgatgtcacctttgaagtggacacgtcagtcttgggttgggtggttgctagtgtggtggcttgggccatagcgctcccgactcggaccgatg

SEQ ID NO: 8782 - DNA, 203 bp, Homo sapiens
  source 1..203: mol_type = other DNA
ggcgcgccagtccttgatgttggtggttgtggccatggtcctcctcttcggccttttcgacgcgctcgattgggccttggaggagctccttgtgtcgcggccttcgttgcgtcgtttggcaagggtggtggagtgttgtgtgatggcgggcgagaaggccactaccgtccggcttgtgtccaagatgtcgactcggaccgatg

SEQ ID NO: 8783 - DNA, 203 bp, Homo sapiens
  source 1..203: mol_type = other DNA
ggcgcgccagtcctggaaaagcacacgcgtccctttggagtatggaaacatggggcacaaggtcctgattctcaacccgtcggttgccactgtgagggccatgggcccttacatggagaggctggcggggaaacatcctagcattttctgtggacacgacacaacagctttcacacggatcacggactcgactcggaccgatg

SEQ ID NO: 8784 - DNA, 203 bp, Homo sapiens
  source 1..203: mol_type = other DNA
ggcgcgccagtcctctactgcgactcccccgggctcgcctatgactcagcatccatccataattgagacaaagctggacgttggtgagatccccttttatgggcatggtatccccctcgagcgtatgaggactggtcgccaccttgtattctgccattccaaggcggagtgcgagagattggccggcccgactcggaccgatg

SEQ ID NO: 8785 - DNA, 203 bp, Homo sapiens
  source 1..203: mol_type = other DNA
ggcgcgccagtcctagttctccgcgcggggggttaatgccatcgcctattataggggtaaggacagttccatcatcaaagacggagacctggtggtttgtgcgacagacgcgctctctaccgggtacacaggaaacttcgattctgtcaccgactgtgggttggtggtggaggaggtcgttgaggtgacgactcggaccgatg

SEQ ID NO: 8786 - DNA, 203 bp, Homo sapiens
  source 1..203: mol_type = other DNA
ggcgcgccagtcctcccttgatcccaccattaccatttccttgcggactgtccctgcttcggctgaattgtcgatgcagcggcgcggacgcacggggagaggtcggtcgggccgctactactacgctggggtcggtaaggctcccgcgggggtggtgcggtctggtccggtctggtcggcagtggaagcgactcggaccgatg

SEQ ID NO: 8787 - DNA, 203 bp, Homo sapiens
  source 1..203: mol_type = other DNA
ggcgcgccagtcctgtggtgaccaggccacccctcaacccgtggtgcaggtccccccggtagaccatcggccggggggggagtctgcgccacgggatgccaagacagtgacagatgcggtggcagccatccaggtgaactgcgattggtctgtgatgaccctgtcgatcggggaagtcctcaccttggcgactcggaccgatg

SEQ ID NO: 8788 - DNA, 203 bp, Homo sapiens
  source 1..203: mol_type = other DNA
ggcgcgccagtcctctcaggctaagacagccgaggcctacgcagctacttccaggtggctcgctggctgctacacggggacgcgggccgtccccactgtatcaattgttgacaagctcttcgccgggggttgggccgccgtggtgggtcactgtcacagcgtcattgctgcggcggtggctgcctatgcgactcggaccgatg

SEQ ID NO: 8789 - DNA, 203 bp, Homo sapiens
  source 1..203: mol_type = other DNA
ggcgcgccagtcctccctggtcaacagggagcctaaggtggatgaggtccaggtggggtacgtctgggatctgtgggagtgggtgatgcgccaggtgcgcatggtgatgtctagactccgggccctctgccctgtggtgtcactccccttgtggcactgcggggaggggtggtccggtgaatggcttccgactcggaccgatg

SEQ ID NO: 8790 - DNA, 203 bp, Homo sapiens
  source 1..203: mol_type = other DNA
ggcgcgccagtcctacaccccgaaggtggtacccttcgggacgtcggggtgggctgaggtggtggtgacccctacccacgtggtgatcaggcgcacgtcctgttacaaactgcttcgccagcaaattctttcagcagctgtagctgagccctactacgttgatggcattccggtctcttgggaggctgcgactcggaccgatg

SEQ ID NO: 8791 - DNA, 203 bp, Homo sapiens
  source 1..203: mol_type = other DNA
ggcgcgccagtcctacgcgagagcgccggccatggtctagggtccgggccaaagtgttaccattgatggggagcgctacacccttccgcaccagttgcggatgcggaatgtggcgccctctgaggtttcatctgaggtcagcatcgagatcgggacggagactgaagactcagaactgactgaggccgcgactcggaccgatg

SEQ ID NO: 8792 - DNA, 203 bp, Homo sapiens
  source 1..203: mol_type = other DNA
ggcgcgccagtcctcggttacggagagcagctcagatgagaagaccctgtcggtgacctcctcgcaggaggacaccccgtcctcagactcatttgaagtcatccaagagtctgatactgctgaatcagaggaaagcgtcttcaacgtggctctttccgtactaaaagccttatttccacagagcgatgcgactcggaccgatg

SEQ ID NO: 8793 - DNA, 203 bp, Homo sapiens
  source 1..203: mol_type = other DNA
ggcgcgccagtccttggtgggcaatgaacttacctttgaatgtgacaagtgtgaggcacgccaagagacccttgcctccttctcctacatatggtccggggtcccacttactcgggccactccggccaaaccaccagtggtgaggccggtggggtccttgttggtggcagacaccaccaaggtctacgcgactcggaccgatg

SEQ ID NO: 8794 - DNA, 203 bp, Homo sapiens
  source 1..203: mol_type = other DNA
ggcgcgccagtccttcattgtgttcccccccctggacttccggatagctgaaaagctcattctgggagacccggggcgggttgcaaaggccggtgttgggggggcttacgccttccagtacacccccaaccagcgggttaaggagatgctaaagctgtgggaatcaaagaagaccccgtgcgccatctcgactcggaccgatg

SEQ ID NO: 8795 - DNA, 203 bp, Homo sapiens
  source 1..203: mol_type = other DNA
ggcgcgccagtcctttaaaactggatccaggttgttcccacctggatttcccacagggagtggtactctgttattacggtaactttgtacgccagttttatctcccttcccccatgtaacttagaagtttttcacaaagaccaatagccggtaatcagccagattactgaaggtcaagcacttctgttcgactcggaccgatg

SEQ ID NO: 8796 - DNA, 203 bp, Homo sapiens
  source 1..203: mol_type = other DNA
ggcgcgccagtccttagcctgcgtggctgcctgcacaccctatgggtgtgaagccaaacaatggacaaggtgtgaagagccccgtgtgctcgctttgagtcctccggcccctgaatgtggctaaccttaaccctgcagctagagcacgtaacccaatgtgtatctagtcgtaatgagcaattgcgggacgactcggaccgatg

SEQ ID NO: 8797 - DNA, 203 bp, Homo sapiens
  source 1..203: mol_type = other DNA
ggcgcgccagtcctgggttggtggtggaaactacctgatgcactcaaggacatgggtatttttggtgaaaacatgttttatcattacctgggtaggagtggatacacaatacatgtgcagtgtaatgctagtaaatttcaccagggtacactaattgttgctctgatacctgagcatcagattgcaagcgactcggaccgatg

SEQ ID NO: 8798 - DNA, 203 bp, Homo sapiens
  source 1..203: mol_type = other DNA
ggcgcgccagtccttttcacccactggacagggagtctccgtttcagcttcatgttttgtggtactgccaacactactgttaagcttttgttggcatacacaccacctggtatcgcagaacccaccacaagaaaggatgcaatgctaggcactcatgttatatgggatgtggggttgcagtctacaatcgactcggaccgatg

SEQ ID NO: 8799 - DNA, 203 bp, Homo sapiens
  source 1..203: mol_type = other DNA
ggcgcgccagtcctatcaatggtagtgccatggattagcgctagtcattatagaaacacatcaccaggtagatctacatctgggtacataacatgctggtatcagactagattagtcattccacctcagaccccaccaacagctagattgttatgttttgtatctgggtgcaaagacttttgcttgcgcgactcggaccgatg

SEQ ID NO: 8800 - DNA, 203 bp, Homo sapiens
  source 1..203: mol_type = other DNA
ggcgcgccagtcctcatggcacgagatactaacctacacctgcaaagtggtgcaatagcacagaaccctgttgagaattatatagatgaagttcttaatgaagttttagttgtcccaaatattaatagtagtaaccccacaacatcaaattctgccccagcattagatgctgcagaaacagggcacaccgactcggaccgatg

SEQ ID NO: 8801 - DNA, 203 bp, Homo sapiens
  source 1..203: mol_type = other DNA
ggcgcgccagtccttctacaagaaatggctcaaattagaaggaaatttgaattgttcacctatactaggtttgattctgaaataaccctagttccatgcatttccgcccttagtcaggacattggacacatcacaatgcaatacatgtatgttccaccaggtgcaccggtgcccaatagtagggacgacgactcggaccgatg

SEQ ID NO: 8802 - DNA, 203 bp, Homo sapiens
  source 1..203: mol_type = other DNA
ggcgcgccagtccttgtgaccagaccaattatcactacagctggccccagtgacatgtatgttcatgtaggtaaccttatttatagaaatcttcatcttttcaactctgagatgcatgaatctattttggtatcttattcatcagatttaatcatttaccgaacaaacactgtaggtgatgattacatcgactcggaccgatg

SEQ ID NO: 8803 - DNA, 203 bp, Homo sapiens
  source 1..203: mol_type = other DNA
ggcgcgccagtcctacatatacatgccataaacccagtaggaaatatcagcaagaaaattattaaatggatgttgagaataatatcagcaatggtcataataattagaaactcttctgacccccaaactatattagcaacactcacactgattgggtgttctggatcaccctggagatttttaaaggacgactcggaccgatg

SEQ ID NO: 8804 - DNA, 203 bp, Homo sapiens
  source 1..203: mol_type = other DNA
ggcgcgccagtccttgaccaacagagtgtagtaataatggatgacattatgcagaatccagccggggatgacatgacactgttctgccaaatggtttctagtgttacatttataccaccaatggctgatctaccagataaaggcaaggcttttgattctaggtttgtattatgcagcacaaatcattccgactcggaccgatg

SEQ ID NO: 8805 - DNA, 203 bp, Homo sapiens
  source 1..203: mol_type = other DNA
ggcgcgccagtcctatttgtgtgtggaaaagcagtttctttcaaagatcgtaactcttgcaacaaatacagccttgcgcaggtgtacaacataatgattgaagaagacagacggagaagacaagtggttgatgtcatgacagctatattccaagggccaattgatatgaaaaacccaccaccacctgccgactcggaccgatg

SEQ ID NO: 8806 - DNA, 203 bp, Homo sapiens
  source 1..203: mol_type = other DNA
ggcgcgccagtccttattactgacttgctccagtctgttagaacccctgaagttattaagtattgtgagggtaatagatggataattccagcagaatgcaagatagaaaaggagttgaacttggctaacacaatcataacaatcattgcaaatgttattggtatggcgagaataatatatgttatttacgactcggaccgatg

SEQ ID NO: 8807 - DNA, 203 bp, Homo sapiens
  source 1..203: mol_type = other DNA
ggcgcgccagtcctcaaaaccaaattgcagcctagtgttttctatgatgtattccctggttcaaaagaaccagctgtgttgtctgaaaaagatgcccggttacaagttgatttcaatgaagcactattttctaaatacaaagggaatacagattgctccattaatgaccacataagaattgcatcatccgactcggaccgatg

SEQ ID NO: 8808 - DNA, 203 bp, Homo sapiens
  source 1..203: mol_type = other DNA
ggcgcgccagtcctacattatgcagcacaactcattaccttagatattgacccaaaacctattacacttgaggacagtgtctttggcactgatggattagaggctcttgatttgaacactagcgcaggatttccatatattgcaatgggagttaaaaagagagatttaataaacaacaagaccaaggacgactcggaccgatg

SEQ ID NO: 8809 - DNA, 203 bp, Homo sapiens
  source 1..203: mol_type = other DNA
ggcgcgccagtcctttcaaagttccacttgaatcctggaattgttactggatcagcagttggatgtgatccagaggtgttttggtcaaaaataccagcaatgttggatgataaatgtattatggcttttgattatacaaattatgatggtagtatacaccctatttggtttgaagctcttaaacaggtcgactcggaccgatg

SEQ ID NO: 8810 - DNA, 203 bp, Homo sapiens
  source 1..203: mol_type = other DNA
ggcgcgccagtcctactggtagatctatcatttaatccaacattaatagatagactatgcaagtctaaacacatcttcaaaaatacatactatgaagtggagggaggtgtaccatctgggtgttcaggtactagtatttttaacactatgatcaataatattatcataaggaccttagtgttagatgccgactcggaccgatg

SEQ ID NO: 8811 - DNA, 203 bp, Homo sapiens
  source 1..203: mol_type = other DNA
ggcgcgccagtcctatacaagaatatagatctagataagcttaagataattgcctatggtgatgatgtcatattctcatacatacatgaactggacatggaggctatagcaatagagggtgttaaatatggtttgactataactcctgctgataaatctaacacatttgtaaaattagactatagcaacgactcggaccgatg

SEQ ID NO: 8812 - DNA, 203 bp, Homo sapiens
  source 1..203: mol_type = other DNA
ggcgcgccagtcctaaagaaaacctcctgtacattcaactacacaaaaactttgaagaacaggtactatgagcccagggacagctacttccagcaatatatgcttaagggtgagtatcagtactggtttgacctggatgcgactgaccgccactcagattacttcgcagaatttgttgtcttggtggtcgactcggaccgatg

SEQ ID NO: 8813 - DNA, 203 bp, Homo sapiens
  source 1..203: mol_type = other DNA
ggcgcgccagtcctttatgaaggagacccgatatctgcctacaaggaagtcatcggccacaacctttttgatcttaagagaacaagctttgagaagctggccaagttaaatcttagcatgtctgtactcggggcctggactagacacaccagtaaaagactactacaagactgtgtcaatataggtgtcgactcggaccgatg

SEQ ID NO: 8814 - DNA, 203 bp, Homo sapiens
  source 1..203: mol_type = other DNA
ggcgcgccagtcctcacctacggaaaccttgttacgacttttacttcctctagatagtcaagttcgaccgtcttctcagcgctccgccagggccgtgggccgaccccggcggggccgatccgagggcctcactaaaccatccaatcggtagtagcgacgggcggtgtgtacaaagggcagggacttaacgactcggaccgatg

SEQ ID NO: 8815 - DNA, 203 bp, Homo sapiens
  source 1..203: mol_type = other DNA
ggcgcgccagtcctaaccttgttacgacttttacttcctctagatagtcaagttcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcgactcggaccgatg

SEQ ID NO: 8816 - DNA, 203 bp, Homo sapiens
  source 1..203: mol_type = other DNA
ggcgcgccagtcctcgacttttacttcctctagatagtcaagttcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcttatgaccccgactcggaccgatg

SEQ ID NO: 8817 - DNA, 203 bp, Homo sapiens
  source 1..203: mol_type = other DNA
ggcgcgccagtcctttcctctagatagtcaagttcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcttatgacccgcacttactgcgactcggaccgatg

SEQ ID NO: 8818 - DNA, 203 bp, Homo sapiens
  source 1..203: mol_type = other DNA
ggcgcgccagtccttagtcaagttcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcttatgacccgcacttactgggaattcctccgactcggaccgatg

SEQ ID NO: 8819 - DNA, 203 bp, Homo sapiens
  source 1..203: mol_type = other DNA
ggcgcgccagtcctcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcttatgacccgcacttactgggaattcctcgttcatggggcgactcggaccgatg

SEQ ID NO: 8820 - DNA, 203 bp, Homo sapiens
  source 1..203: mol_type = other DNA
ggcgcgccagtcctcccggcggggccgatccgagggcctcactaaaccatccaatcggtagtagcgacgggcggtgtgtacaaagggcagggacttaatcaacgcaagcttatgacccgcacttactgggaattcctcgttcatggggaataattgcaatccccgatccccatcacgaatggggttcacgactcggaccgatg

SEQ ID NO: 8821 - DNA, 203 bp, Homo sapiens
  source 1..203: mol_type = other DNA
ggcgcgccagtcctggcctcactaaaccatccaatcggtagtagcgacgggcggtgtgtacaaagggcagggacttaatcaacgcaagcttatgacccgcacttactgggaattcctcgttcatggggaataattgcaatccccgatccccatcacgaatggggttcaacgggttacccgcgcctgcccgactcggaccgatg

SEQ ID NO: 8822 - DNA, 203 bp, Homo sapiens
  source 1..203: mol_type = other DNA
ggcgcgccagtcctaaccatccaatcggtagtagcgacgggcggtgtgtacaaagggcagggacttaatcaacgcaagcttatgacccgcacttactgggaattcctcgttcatggggaataattgcaatccccgatccccatcacgaatggggttcaacgggttacccgcgcctgccggcgtagggtcgactcggaccgatg

SEQ ID NO: 8823 - DNA, 203 bp, Homo sapiens
  source 1..203: mol_type = other DNA
ggcgcgccagtcctcgacgggcggtgtgtacaaagggcagggacttaatcaacgcaagcttatgacccgcacttactgggaattcctcgttcatggggaataattgcaatccccgatccccatcacgaatggggttcaacgggttacccgcgcctgccggcgtagggtaggcacacgctgagccagtccgactcggaccgatg

SEQ ID NO: 8824 - DNA, 203 bp, Homo sapiens
  source 1..203: mol_type = other DNA
ggcgcgccagtcctgggcagggacttaatcaacgcaagcttatgacccgcacttactgggaattcctcgttcatggggaataattgcaatccccgatccccatcacgaatggggttcaacgggttacccgcgcctgccggcgtagggtaggcacacgctgagccagtcagtgtagcgcgcgtgcagcccgactcggaccgatg

SEQ ID NO: 8825 - DNA, 203 bp, Homo sapiens
  source 1..203: mol_type = other DNA
ggcgcgccagtcctcaagcttatgacccgcacttactgggaattcctcgttcatggggaataattgcaatccccgatccccatcacgaatggggttcaacgggttacccgcgcctgccggcgtagggtaggcacacgctgagccagtcagtgtagcgcgcgtgcagccccggacatctaagggcatcacgactcggaccgatg

SEQ ID NO: 8826 - DNA, 203 bp, Homo sapiens
  source 1..203: mol_type = other DNA
ggcgcgccagtcctactgggaattcctcgttcatggggaataattgcaatccccgatccccatcacgaatggggttcaacgggttacccgcgcctgccggcgtagggtaggcacacgctgagccagtcagtgtagcgcgcgtgcagccccggacatctaagggcatcacagacctgttattgctcaatcgactcggaccgatg

SEQ ID NO: 8827 - DNA, 203 bp, Homo sapiens
  source 1..203: mol_type = other DNA
ggcgcgccagtccttacccgcgcctgccggcgtagggtaggcacacgctgagccagtcagtgtagcgcgcgtgcagccccggacatctaagggcatcacagacctgttattgctcaatctcgggtggctgaacgccacttgtccctctaagaagttgggggacgccgaccgctcgggggtcgcgtaaccgactcggaccgatg

SEQ ID NO: 8828 - DNA, 203 bp, Homo sapiens
  source 1..203: mol_type = other DNA
ggcgcgccagtcctgggtaggcacacgctgagccagtcagtgtagcgcgcgtgcagccccggacatctaagggcatcacagacctgttattgctcaatctcgggtggctgaacgccacttgtccctctaagaagttgggggacgccgaccgctcgggggtcgcgtaactagttagcatgccagagtctcgactcggaccgatg

SEQ ID NO: 8829 - DNA, 203 bp, Homo sapiens
  source 1..203: mol_type = other DNA
ggcgcgccagtcctacgctgagccagtcagtgtagcgcgcgtgcagccccggacatctaagggcatcacagacctgttattgctcaatctcgggtggctgaacgccacttgtccctctaagaagttgggggacgccgaccgctcgggggtcgcgtaactagttagcatgccagagtctcgttcgttatcgactcggaccgatg

SEQ ID NO: 8830 - DNA, 203 bp, Homo sapiens
  source 1..203: mol_type = other DNA
ggcgcgccagtcctagccccggacatctaagggcatcacagacctgttattgctcaatctcgggtggctgaacgccacttgtccctctaagaagttgggggacgccgaccgctcgggggtcgcgtaactagttagcatgccagagtctcgttcgttatcggaattaaccagacaaatcgctccaccaacgactcggaccgatg

SEQ ID NO: 8831 - DNA, 203 bp, Homo sapiens
  source 1..203: mol_type = other DNA
ggcgcgccagtcctatcacagacctgttattgctcaatctcgggtggctgaacgccacttgtccctctaagaagttgggggacgccgaccgctcgggggtcgcgtaactagttagcatgccagagtctcgttcgttatcggaattaaccagacaaatcgctccaccaactaagaacggccatgcaccacgactcggaccgatg

SEQ ID NO: 8832 - DNA, 203 bp, Homo sapiens
  source 1..203: mol_type = other DNA
ggcgcgccagtccttgttattgctcaatctcgggtggctgaacgccacttgtccctctaagaagttgggggacgccgaccgctcgggggtcgcgtaactagttagcatgccagagtctcgttcgttatcggaattaaccagacaaatcgctccaccaactaagaacggccatgcaccaccacccacggcgactcggaccgatg

SEQ ID NO: 8833 - DNA, 203 bp, Homo sapiens
  source 1..203: mol_type = other DNA
ggcgcgccagtcctcaatctcgggtggctgaacgccacttgtccctctaagaagttgggggacgccgaccgctcgggggtcgcgtaactagttagcatgccagagtctcgttcgttatcggaattaaccagacaaatcgctccaccaactaagaacggccatgcaccaccacccacggaatcgagaaacgactcggaccgatg

SEQ ID NO: 8834 - DNA, 203 bp, Homo sapiens
  source 1..203: mol_type = other DNA
ggcgcgccagtcctgtctcgttcgttatcggaattaaccagacaaatcgctccaccaactaagaacggccatgcaccaccacccacggaatcgagaaagagctatcaatctgtcaatcctgtccgtgtccgggccgggtgaggtttcccgtgttgagtcaaattaagccgcaggctccactcctggtgcgactcggaccgatg

SEQ ID NO: 8835 - DNA, 203 bp, Homo sapiens
  source 1..203: mol_type = other DNA
ggcgcgccagtccttaaccagacaaatcgctccaccaactaagaacggccatgcaccaccacccacggaatcgagaaagagctatcaatctgtcaatcctgtccgtgtccgggccgggtgaggtttcccgtgttgagtcaaattaagccgcaggctccactcctggtggtgcccttccgtcaattcctcgactcggaccgatg

SEQ ID NO: 8836 - DNA, 203 bp, Homo sapiens
  source 1..203: mol_type = other DNA
ggcgcgccagtcctacggccatgcaccaccacccacggaatcgagaaagagctatcaatctgtcaatcctgtccgtgtccgggccgggtgaggtttcccgtgttgagtcaaattaagccgcaggctccactcctggtggtgcccttccgtcaattcctttaagtttcagctttgcaaccatactcccccgactcggaccgatg

SEQ ID NO: 8837 - DNA, 203 bp, Homo sapiens
  source 1..203: mol_type = other DNA
ggcgcgccagtcctgaaagagctatcaatctgtcaatcctgtccgtgtccgggccgggtgaggtttcccgtgttgagtcaaattaagccgcaggctccactcctggtggtgcccttccgtcaattcctttaagtttcagctttgcaaccatactccccccggaacccaaagactttggtttcccggaacgactcggaccgatg

SEQ ID NO: 8838 - DNA, 203 bp, Homo sapiens
  source 1..203: mol_type = other DNA
ggcgcgccagtccttcaatctgtcaatcctgtccgtgtccgggccgggtgaggtttcccgtgttgagtcaaattaagccgcaggctccactcctggtggtgcccttccgtcaattcctttaagtttcagctttgcaaccatactccccccggaacccaaagactttggtttcccggaagctgcccggccgactcggaccgatg

SEQ ID NO: 8839 - DNA, 203 bp, Homo sapiens
  source 1..203: mol_type = other DNA
ggcgcgccagtcctaatcctgtccgtgtccgggccgggtgaggtttcccgtgttgagtcaaattaagccgcaggctccactcctggtggtgcccttccgtcaattcctttaagtttcagctttgcaaccatactccccccggaacccaaagactttggtttcccggaagctgcccggcgggtcatgggcgactcggaccgatg

SEQ ID NO: 8840 - DNA, 203 bp, Homo sapiens
  source 1..203: mol_type = other DNA
ggcgcgccagtcctgtgtccgggccgggtgaggtttcccgtgttgagtcaaattaagccgcaggctccactcctggtggtgcccttccgtcaattcctttaagtttcagctttgcaaccatactccccccggaacccaaagactttggtttcccggaagctgcccggcgggtcatgggaataacgccgcgactcggaccgatg

SEQ ID NO: 8841 - DNA, 203 bp, Homo sapiens
  source 1..203: mol_type = other DNA
ggcgcgccagtcctctccactcctggtggtgcccttccgtcaattcctttaagtttcagctttgcaaccatactccccccggaacccaaagactttggtttcccggaagctgcccggcgggtcatgggaataacgccgccgcatcgccggtcggcatcgtttatggtcggaactacgacggtatctgacgactcggaccgatg

SEQ ID NO: 8842 - DNA, 203 bp, Homo sapiens
  source 1..203: mol_type = other DNA
ggcgcgccagtcctttcagctttgcaaccatactccccccggaacccaaagactttggtttcccggaagctgcccggcgggtcatgggaataacgccgccgcatcgccggtcggcatcgtttatggtcggaactacgacggtatctgatcgtcttcgaacctccgactttcgttcttgattaatgaaacgactcggaccgatg

SEQ ID NO: 8843 - DNA, 203 bp, Homo sapiens
  source 1..203: mol_type = other DNA
ggcgcgccagtcctcaaccatactccccccggaacccaaagactttggtttcccggaagctgcccggcgggtcatgggaataacgccgccgcatcgccggtcggcatcgtttatggtcggaactacgacggtatctgatcgtcttcgaacctccgactttcgttcttgattaatgaaaacattcttggcgactcggaccgatg

SEQ ID NO: 8844 - DNA, 203 bp, Homo sapiens
  source 1..203: mol_type = other DNA
ggcgcgccagtcctttggtttcccggaagctgcccggcgggtcatgggaataacgccgccgcatcgccggtcggcatcgtttatggtcggaactacgacggtatctgatcgtcttcgaacctccgactttcgttcttgattaatgaaaacattcttggcaaatgctttcgctctggtccgtcttgcgccgactcggaccgatg

SEQ ID NO: 8845 - DNA, 203 bp, Homo sapiens
  source 1..203: mol_type = other DNA
ggcgcgccagtcctggaagctgcccggcgggtcatgggaataacgccgccgcatcgccggtcggcatcgtttatggtcggaactacgacggtatctgatcgtcttcgaacctccgactttcgttcttgattaatgaaaacattcttggcaaatgctttcgctctggtccgtcttgcgccggtccaagacgactcggaccgatg

SEQ ID NO: 8846 - DNA, 203 bp, Homo sapiens
  source 1..203: mol_type = other DNA
ggcgcgccagtcctcggcgggtcatgggaataacgccgccgcatcgccggtcggcatcgtttatggtcggaactacgacggtatctgatcgtcttcgaacctccgactttcgttcttgattaatgaaaacattcttggcaaatgctttcgctctggtccgtcttgcgccggtccaagaatttcacctccgactcggaccgatg

SEQ ID NO: 8847 - DNA, 203 bp, Homo sapiens
  source 1..203: mol_type = other DNA
ggcgcgccagtcctgccgccgcatcgccggtcggcatcgtttatggtcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatgccgactcggaccgatg

SEQ ID NO: 8848 - DNA, 203 bp, Homo sapiens
  source 1..203: mol_type = other DNA
ggcgcgccagtcctcgccggtcggcatcgtttatggtcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatgcccccggccgtcgactcggaccgatg

SEQ ID NO: 8849 - DNA, 203 bp, Homo sapiens
  source 1..203: mol_type = other DNA
ggcgcgccagtcctggtcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcacgactcggaccgatg

SEQ ID NO: 8850 - DNA, 203 bp, Homo sapiens
  source 1..203: mol_type = other DNA
ggcgcgccagtcctacgacggtatctgatcgtcttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcagttccgaaaacgactcggaccgatg

SEQ ID NO: 8851 - DNA, 203 bp, Homo sapiens
  source 1..203: mol_type = other DNA
ggcgcgccagtcctctgatcgtcttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcagttccgaaaaccaacaaaatcgactcggaccgatg

SEQ ID NO: 8852 - DNA, 203 bp, Homo sapiens
  source 1..203: mol_type = other DNA
ggcgcgccagtccttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcagttccgaaaaccaacaaaatagaaccgcggcgactcggaccgatg

SEQ ID NO: 8853 - DNA, 203 bp, Homo sapiens
  source 1..203: mol_type = other DNA
ggcgcgccagtcctgaaaacattcttggcaaatgctttcgctctggtccgtcttgcgccggtccaagaatttcacctctagcggcgcaatacgaatgcccccggccgtccctcttaatcatggcctcagttccgaaaaccaacaaaatagaaccgcggtcctattccattattcctagctgcggtatccgactcggaccgatg

SEQ ID NO: 8854 - DNA, 203 bp, Homo sapiens
  source 1..203: mol_type = other DNA
ggcgcgccagtcctttggcaaatgctttcgctctggtccgtcttgcgccggtccaagaatttcacctctagcggcgcaatacgaatgcccccggccgtccctcttaatcatggcctcagttccgaaaaccaacaaaatagaaccgcggtcctattccattattcctagctgcggtatccaggcggctccgactcggaccgatg

SEQ ID NO: 8855 - DNA, 203 bp, Homo sapiens
  source 1..203: mol_type = other DNA
ggcgcgccagtcctggtccgtcttgcgccggtccaagaatttcacctctagcggcgcaatacgaatgcccccggccgtccctcttaatcatggcctcagttccgaaaaccaacaaaatagaaccgcggtcctattccattattcctagctgcggtatccaggcggctcgggcctgctttgaacactctcgactcggaccgatg

SEQ ID NO: 8856 - DNA, 203 bp, Homo sapiens
  source 1..203: mol_type = other DNA
ggcgcgccagtcctgcgccggtccaagaatttcacctctagcggcgcaatacgaatgcccccggccgtccctcttaatcatggcctcagttccgaaaaccaacaaaatagaaccgcggtcctattccattattcctagctgcggtatccaggcggctcgggcctgctttgaacactctaattttttcacgactcggaccgatg

SEQ ID NO: 8857 - DNA, 203 bp, Homo sapiens
  source 1..203: mol_type = other DNA
ggcgcgccagtcctcgcaatacgaatgcccccggccgtccctcttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcgactcggaccgatg

SEQ ID NO: 8858 - DNA, 203 bp, Homo sapiens
  source 1..203: mol_type = other DNA
ggcgcgccagtcctccgtccctcttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcgaggggcgactcggaccgatg

SEQ ID NO: 8859 - DNA, 203 bp, Homo sapiens
  source 1..203: mol_type = other DNA
ggcgcgccagtccttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcgagggggcgccgagagcgactcggaccgatg

SEQ ID NO: 8860 - DNA, 203 bp, Homo sapiens
  source 1..203: mol_type = other DNA
ggcgcgccagtcctctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcgagggggcgccgagaggcaaggggcgcgactcggaccgatg

SEQ ID NO: 8861 - DNA, 203 bp, Homo sapiens
  source 1..203: mol_type = other DNA
ggcgcgccagtcctctagctgcggtatccaggcggctcgggcctgctttgaacactctaattttttcaaagtaaacgcttcgggccccgcgggacactcagctaagagcatcgagggggcgccgagaggcaaggggcggggacgggcggtggctcgcctcgcgggggaccgcccgcccgctcccaagacgactcggaccgatg

SEQ ID NO: 8862 - DNA, 203 bp, Homo sapiens
  source 1..203: mol_type = other DNA
ggcgcgccagtcctttcaaagtaaacgcttcgggccccgcgggacactcagctaagagcatcgagggggcgccgagaggcaaggggcggggacgggcggtggctcgcctcgcgggggaccgcccgcccgctcccaagatccaactacgagctttttaactgcagcaactttaatatacgctattggagcgactcggaccgatg

SEQ ID NO: 8863 - DNA, 203 bp, Homo sapiens
  source 1..203: mol_type = other DNA
ggcgcgccagtcctcactcagctaagagcatcgagggggcgccgagaggcaaggggcggggacgggcggtggctcgcctcgcgggggaccgcccgcccgctcccaagatccaactacgagctttttaactgcagcaactttaatatacgctattggagctggaattaccgcggctgctggcaccagaccgactcggaccgatg

SEQ ID NO: 8864 - DNA, 203 bp, Homo sapiens
  source 1..203: mol_type = other DNA
ggcgcgccagtcctagagcatcgagggggcgccgagaggcaaggggcggggacgggcggtggctcgcctcgcgggggaccgcccgcccgctcccaagatccaactacgagctttttaactgcagcaactttaatatacgctattggagctggaattaccgcggctgctggcaccagacttgccctccacgactcggaccgatg

SEQ ID NO: 8865 - DNA, 203 bp, Homo sapiens
  source 1..203: mol_type = other DNA
ggcgcgccagtcctgggggcgccgagaggcaaggggcggggacgggcggtggctcgcctcgcgggggaccgcccgcccgctcccaagatccaactacgagctttttaactgcagcaactttaatatacgctattggagctggaattaccgcggctgctggcaccagacttgccctccaatggatcctccgactcggaccgatg

SEQ ID NO: 8866 - DNA, 203 bp, Homo sapiens
  source 1..203: mol_type = other DNA
ggcgcgccagtcctagaggcaaggggcggggacgggcggtggctcgcctcgcgggggaccgcccgcccgctcccaagatccaactacgagctttttaactgcagcaactttaatatacgctattggagctggaattaccgcggctgctggcaccagacttgccctccaatggatcctcgttaaaggatcgactcggaccgatg

SEQ ID NO: 8867 - DNA, 203 bp, Homo sapiens
  source 1..203: mol_type = other DNA
ggcgcgccagtccttacgagctttttaactgcagcaactttaatatacgctattggagctggaattaccgcggctgctggcaccagacttgccctccaatggatcctcgttaaaggatttaaagtggactcattccaattacagggcctcgaaagagtcctgtattgttatttttcgtcactacctcccgactcggaccgatg

SEQ ID NO: 8868 - DNA, 203 bp, Homo sapiens
  source 1..203: mol_type = other DNA
ggcgcgccagtcctatacgctattggagctggaattaccgcggctgctggcaccagacttgccctccaatggatcctcgttaaaggatttaaagtggactcattccaattacagggcctcgaaagagtcctgtattgttatttttcgtcactacctccccgggtcgggagtgggtaatttgcgcgcctcgactcggaccgatg

SEQ ID NO: 8869 - DNA, 203 bp, Homo sapiens
  source 1..203: mol_type = other DNA
ggcgcgccagtcctggagctggaattaccgcggctgctggcaccagacttgccctccaatggatcctcgttaaaggatttaaagtggactcattccaattacagggcctcgaaagagtcctgtattgttatttttcgtcactacctccccgggtcgggagtgggtaatttgcgcgcctgctgccttcccgactcggaccgatg

SEQ ID NO: 8870 - DNA, 203 bp, Homo sapiens
  source 1..203: mol_type = other DNA
ggcgcgccagtcctagacttgccctccaatggatcctcgttaaaggatttaaagtggactcattccaattacagggcctcgaaagagtcctgtattgttatttttcgtcactacctccccgggtcgggagtgggtaatttgcgcgcctgctgccttccttggatgtggtagccgtttctcaggctccccgactcggaccgatg

SEQ ID NO: 8871 - DNA, 203 bp, Homo sapiens
  source 1..203: mol_type = other DNA
ggcgcgccagtccttccaatggatcctcgttaaaggatttaaagtggactcattccaattacagggcctcgaaagagtcctgtattgttatttttcgtcactacctccccgggtcgggagtgggtaatttgcgcgcctgctgccttccttggatgtggtagccgtttctcaggctccctctccggaatcgactcggaccgatg

SEQ ID NO: 8872 - DNA, 203 bp, Homo sapiens
  source 1..203: mol_type = other DNA
ggcgcgccagtcctggcctcgaaagagtcctgtattgttatttttcgtcactacctccccgggtcgggagtgggtaatttgcgcgcctgctgccttccttggatgtggtagccgtttctcaggctccctctccggaatcgaaccctgattccccgtcacccgtggtcaccatggtaggcacggcgactcgactcggaccgatg

SEQ ID NO: 8873 - DNA, 203 bp, Homo sapiens
  source 1..203: mol_type = other DNA
ggcgcgccagtccttcgtcactacctccccgggtcgggagtgggtaatttgcgcgcctgctgccttccttggatgtggtagccgtttctcaggctccctctccggaatcgaaccctgattccccgtcacccgtggtcaccatggtaggcacggcgactaccatcgaaagttgatagggcagacgttcgcgactcggaccgatg

SEQ ID NO: 8874 - DNA, 203 bp, Homo sapiens
  source 1..203: mol_type = other DNA
ggcgcgccagtcctgtggtagccgtttctcaggctccctctccggaatcgaaccctgattccccgtcacccgtggtcaccatggtaggcacggcgactaccatcgaaagttgatagggcagacgttcgaatgggtcgtcgccgccacggggggcgtgcgatcggcccgaggttatctagagtcaccaacgactcggaccgatg

SEQ ID NO: 8875 - DNA, 203 bp, Homo sapiens
  source 1..203: mol_type = other DNA
ggcgcgccagtcctgaatcgaaccctgattccccgtcacccgtggtcaccatggtaggcacggcgactaccatcgaaagttgatagggcagacgttcgaatgggtcgtcgccgccacggggggcgtgcgatcggcccgaggttatctagagtcaccaaagccgccggcgcccgccccccggccggggccgactcggaccgatg

SEQ ID NO: 8876 - DNA, 203 bp, Homo sapiens
  source 1..203: mol_type = other DNA
ggcgcgccagtcctctgattccccgtcacccgtggtcaccatggtaggcacggcgactaccatcgaaagttgatagggcagacgttcgaatgggtcgtcgccgccacggggggcgtgcgatcggcccgaggttatctagagtcaccaaagccgccggcgcccgccccccggccggggccggagaggggcgactcggaccgatg

SEQ ID NO: 8877 - DNA, 203 bp, Homo sapiens
  source 1..203: mol_type = other DNA
ggcgcgccagtcctgtcaccatggtaggcacggcgactaccatcgaaagttgatagggcagacgttcgaatgggtcgtcgccgccacggggggcgtgcgatcggcccgaggttatctagagtcaccaaagccgccggcgcccgccccccggccggggccggagaggggctgaccgggttggttttgatcgactcggaccgatg

SEQ ID NO: 8878 - DNA, 203 bp, Homo sapiens
  source 1..203: mol_type = other DNA
ggcgcgccagtcctcacggggggcgtgcgatcggcccgaggttatctagagtcaccaaagccgccggcgcccgccccccggccggggccggagaggggctgaccgggttggttttgatctgataaatgcacgcatcccccccgcgaagggggtcagcgcccgtcggcatgtattagctctagaattaccgactcggaccgatg

SEQ ID NO: 8879 - DNA, 203 bp, Homo sapiens
  source 1..203: mol_type = other DNA
ggcgcgccagtcctcccgaggttatctagagtcaccaaagccgccggcgcccgccccccggccggggccggagaggggctgaccgggttggttttgatctgataaatgcacgcatcccccccgcgaagggggtcagcgcccgtcggcatgtattagctctagaattaccacagttatccaagtaggagcgactcggaccgatg

SEQ ID NO: 8880 - DNA, 203 bp, Homo sapiens
  source 1..203: mol_type = other DNA
ggcgcgccagtcctggggctgaccgggttggttttgatctgataaatgcacgcatcccccccgcgaagggggtcagcgcccgtcggcatgtattagctctagaattaccacagttatccaagtaggagaggagcgagcgaccaaaggaaccataactgatttaatgagccattcgcagtttcactgtacgactcggaccgatg

SEQ ID NO: 8881 - DNA, 203 bp, Homo sapiens
  source 1..203: mol_type = other DNA
ggcgcgccagtccttcccccccgcgaagggggtcagcgcccgtcggcatgtattagctctagaattaccacagttatccaagtaggagaggagcgagcgaccaaaggaaccataactgatttaatgagccattcgcagtttcactgtaccggccgtgcgtactcagacatgcatggcttaatctttgacgactcggaccgatg

SEQ ID NO: 8882 - DNA, 203 bp, Homo sapiens
  source 1..203: mol_type = other DNA
ggcgcgccagtcctgggcggcccgccggcggggacaggcgggggaccggctatccgaggccaaccgaggctccgcggcgctgccgtatcgttccgcctgggcgggattctgacttagaggcgttcagtcataatcccacagatggtagcttcgccccattggctcctcagccaagcacatacaccaaacgactcggaccgatg

SEQ ID NO: 8883 - DNA, 203 bp, Homo sapiens
  source 1..203: mol_type = other DNA
ggcgcgccagtcctccggcggggacaggcgggggaccggctatccgaggccaaccgaggctccgcggcgctgccgtatcgttccgcctgggcgggattctgacttagaggcgttcagtcataatcccacagatggtagcttcgccccattggctcctcagccaagcacatacaccaaatgtctgaacccgactcggaccgatg

SEQ ID NO: 8884 - DNA, 203 bp, Homo sapiens
  source 1..203: mol_type = other DNA
ggcgcgccagtcctcaggcgggggaccggctatccgaggccaaccgaggctccgcggcgctgccgtatcgttccgcctgggcgggattctgacttagaggcgttcagtcataatcccacagatggtagcttcgccccattggctcctcagccaagcacatacaccaaatgtctgaacctgcggttcctcgactcggaccgatg

SEQ ID NO: 8885 - DNA, 203 bp, Homo sapiens
  source 1..203: mol_type = other DNA
ggcgcgccagtcctcgaggctccgcggcgctgccgtatcgttccgcctgggcgggattctgacttagaggcgttcagtcataatcccacagatggtagcttcgccccattggctcctcagccaagcacatacaccaaatgtctgaacctgcggttcctctcgtactgagcaggattaccatggcaacacgactcggaccgatg

SEQ ID NO: 8886 - DNA, 203 bp, Homo sapiens
  source 1..203: mol_type = other DNA
ggcgcgccagtcctcggcgctgccgtatcgttccgcctgggcgggattctgacttagaggcgttcagtcataatcccacagatggtagcttcgccccattggctcctcagccaagcacatacaccaaatgtctgaacctgcggttcctctcgtactgagcaggattaccatggcaacaacacatcatccgactcggaccgatg

SEQ ID NO: 8887 - DNA, 203 bp, Homo sapiens
  source 1..203: mol_type = other DNA
ggcgcgccagtcctgtatcgttccgcctgggcgggattctgacttagaggcgttcagtcataatcccacagatggtagcttcgccccattggctcctcagccaagcacatacaccaaatgtctgaacctgcggttcctctcgtactgagcaggattaccatggcaacaacacatcatcagtagggtaacgactcggaccgatg

SEQ ID NO: 8888 - DNA, 203 bp, Homo sapiens
  source 1..203: mol_type = other DNA
ggcgcgccagtcctgcctgggcgggattctgacttagaggcgttcagtcataatcccacagatggtagcttcgccccattggctcctcagccaagcacatacaccaaatgtctgaacctgcggttcctctcgtactgagcaggattaccatggcaacaacacatcatcagtagggtaaaactaacctgcgactcggaccgatg

SEQ ID NO: 8889 - DNA, 203 bp, Homo sapiens
  source 1..203: mol_type = other DNA
ggcgcgccagtcctgcacatacaccaaatgtctgaacctgcggttcctctcgtactgagcaggattaccatggcaacaacacatcatcagtagggtaaaactaacctgtctcacgacggtctaaacccagctcacgttccctattagtgggtgaacaatccaacgcttggtgaattctgcttcacaatcgactcggaccgatg

SEQ ID NO: 8890 - DNA, 203 bp, Homo sapiens
  source 1..203: mol_type = other DNA
ggcgcgccagtccttcctctcgtactgagcaggattaccatggcaacaacacatcatcagtagggtaaaactaacctgtctcacgacggtctaaacccagctcacgttccctattagtgggtgaacaatccaacgcttggtgaattctgcttcacaatgataggaagagccgacatcgaaggatcaaacgactcggaccgatg

SEQ ID NO: 8891 - DNA, 203 bp, Homo sapiens
  source 1..203: mol_type = other DNA
ggcgcgccagtcctgtaaaactaacctgtctcacgacggtctaaacccagctcacgttccctattagtgggtgaacaatccaacgcttggtgaattctgcttcacaatgataggaagagccgacatcgaaggatcaaaaagcgacgtcgctatgaacgcttggccgccacaagccagttatccctgtgcgactcggaccgatg

SEQ ID NO: 8892 - DNA, 203 bp, Homo sapiens
  source 1..203: mol_type = other DNA
ggcgcgccagtccttagtgggtgaacaatccaacgcttggtgaattctgcttcacaatgataggaagagccgacatcgaaggatcaaaaagcgacgtcgctatgaacgcttggccgccacaagccagttatccctgtggtaacttttctgacacctcctgcttaaaacccaaaaggtcagaaggatcgcgactcggaccgatg

SEQ ID NO: 8893 - DNA, 203 bp, Homo sapiens
  source 1..203: mol_type = other DNA
ggcgcgccagtcctgcttggtgaattctgcttcacaatgataggaagagccgacatcgaaggatcaaaaagcgacgtcgctatgaacgcttggccgccacaagccagttatccctgtggtaacttttctgacacctcctgcttaaaacccaaaaggtcagaaggatcgtgaggccccgctttcacggtcgactcggaccgatg

SEQ ID NO: 8894 - DNA, 203 bp, Homo sapiens
  source 1..203: mol_type = other DNA
ggcgcgccagtcctcaatgataggaagagccgacatcgaaggatcaaaaagcgacgtcgctatgaacgcttggccgccacaagccagttatccctgtggtaacttttctgacacctcctgcttaaaacccaaaaggtcagaaggatcgtgaggccccgctttcacggtctgtattcgtactgaaaatccgactcggaccgatg

SEQ ID NO: 8895 - DNA, 203 bp, Homo sapiens
  source 1..203: mol_type = other DNA
ggcgcgccagtcctcgtcgctatgaacgcttggccgccacaagccagttatccctgtggtaacttttctgacacctcctgcttaaaacccaaaaggtcagaaggatcgtgaggccccgctttcacggtctgtattcgtactgaaaatcaagatcaagcgagcttttgcccttctgctccacgggaggtcgactcggaccgatg

SEQ ID NO: 8896 - DNA, 203 bp, Homo sapiens
  source 1..203: mol_type = other DNA
ggcgcgccagtcctcagttatccctgtggtaacttttctgacacctcctgcttaaaacccaaaaggtcagaaggatcgtgaggccccgctttcacggtctgtattcgtactgaaaatcaagatcaagcgagcttttgcccttctgctccacgggaggtttctgtcctccctgagctcgccttaggacacgactcggaccgatg

SEQ ID NO: 8897 - DNA, 203 bp, Homo sapiens
  source 1..203: mol_type = other DNA
ggcgcgccagtcctctcctgcttaaaacccaaaaggtcagaaggatcgtgaggccccgctttcacggtctgtattcgtactgaaaatcaagatcaagcgagcttttgcccttctgctccacgggaggtttctgtcctccctgagctcgccttaggacacctgcgttaccgtttgacaggtgtaccgcccgactcggaccgatg

SEQ ID NO: 8898 - DNA, 203 bp, Homo sapiens
  source 1..203: mol_type = other DNA
ggcgcgccagtcctggtcagaaggatcgtgaggccccgctttcacggtctgtattcgtactgaaaatcaagatcaagcgagcttttgcccttctgctccacgggaggtttctgtcctccctgagctcgccttaggacacctgcgttaccgtttgacaggtgtaccgccccagtcaaactccccacctgcgactcggaccgatg

SEQ ID NO: 8899 - DNA, 203 bp, Homo sapiens
  source 1..203: mol_type = other DNA
ggcgcgccagtcctatcgtgaggccccgctttcacggtctgtattcgtactgaaaatcaagatcaagcgagcttttgcccttctgctccacgggaggtttctgtcctccctgagctcgccttaggacacctgcgttaccgtttgacaggtgtaccgccccagtcaaactccccacctggcactgtccccgactcggaccgatg

SEQ ID NO: 8900 - DNA, 203 bp, Homo sapiens
  source 1..203: mol_type = other DNA
ggcgcgccagtcctcccgctttcacggtctgtattcgtactgaaaatcaagatcaagcgagcttttgcccttctgctccacgggaggtttctgtcctccctgagctcgccttaggacacctgcgttaccgtttgacaggtgtaccgccccagtcaaactccccacctggcactgtccccggagcgggtcgactcggaccgatg

SEQ ID NO: 8901 - DNA, 203 bp, Homo sapiens
  source 1..203: mol_type = other DNA
ggcgcgccagtcctcggtctgtattcgtactgaaaatcaagatcaagcgagcttttgcccttctgctccacgggaggtttctgtcctccctgagctcgccttaggacacctgcgttaccgtttgacaggtgtaccgccccagtcaaactccccacctggcactgtccccggagcgggtcgcgcccggccgactcggaccgatg

SEQ ID NO: 8902 - DNA, 203 bp, Homo sapiens
  source 1..203: mol_type = other DNA
ggcgcgccagtcctcggggacaccgggggggcgccgggggcctcccacttattctacacctctcatgtctcttcaccgtgccagactagagtcaagctcaacagggtcttctttccccgctgattccgccaagcccgttcccttggctgtggtttcgctggatagtaggtagggacagtgggaatctccgactcggaccgatg

SEQ ID NO: 8903 - DNA, 203 bp, Homo sapiens
  source 1..203: mol_type = other DNA
ggcgcgccagtcctgggggggcgccgggggcctcccacttattctacacctctcatgtctcttcaccgtgccagactagagtcaagctcaacagggtcttctttccccgctgattccgccaagcccgttcccttggctgtggtttcgctggatagtaggtagggacagtgggaatctcgttcatccatcgactcggaccgatg

SEQ ID NO: 8904 - DNA, 203 bp, Homo sapiens
  source 1..203: mol_type = other DNA
ggcgcgccagtcctcgggggcctcccacttattctacacctctcatgtctcttcaccgtgccagactagagtcaagctcaacagggtcttctttccccgctgattccgccaagcccgttcccttggctgtggtttcgctggatagtaggtagggacagtgggaatctcgttcatccattcatgcgcgtcgactcggaccgatg

SEQ ID NO: 8905 - DNA, 203 bp, Homo sapiens
  source 1..203: mol_type = other DNA
ggcgcgccagtcctccacttattctacacctctcatgtctcttcaccgtgccagactagagtcaagctcaacagggtcttctttccccgctgattccgccaagcccgttcccttggctgtggtttcgctggatagtaggtagggacagtgggaatctcgttcatccattcatgcgcgtcactaattagcgactcggaccgatg

SEQ ID NO: 8906 - DNA, 203 bp, Homo sapiens
  source 1..203: mol_type = other DNA
ggcgcgccagtccttacacctctcatgtctcttcaccgtgccagactagagtcaagctcaacagggtcttctttccccgctgattccgccaagcccgttcccttggctgtggtttcgctggatagtaggtagggacagtgggaatctcgttcatccattcatgcgcgtcactaattagatgacgaggccgactcggaccgatg

SEQ ID NO: 8907 - DNA, 203 bp, Homo sapiens
  source 1..203: mol_type = other DNA
ggcgcgccagtcctatgtctcttcaccgtgccagactagagtcaagctcaacagggtcttctttccccgctgattccgccaagcccgttcccttggctgtggtttcgctggatagtaggtagggacagtgggaatctcgttcatccattcatgcgcgtcactaattagatgacgaggcatttggctaccgactcggaccgatg

SEQ ID NO: 8908 - DNA, 203 bp, Homo sapiens
  source 1..203: mol_type = other DNA
ggcgcgccagtcctaccgtgccagactagagtcaagctcaacagggtcttctttccccgctgattccgccaagcccgttcccttggctgtggtttcgctggatagtaggtagggacagtgggaatctcgttcatccattcatgcgcgtcactaattagatgacgaggcatttggctaccttaagagagcgactcggaccgatg

SEQ ID NO: 8909 - DNA, 203 bp, Homo sapiens
  source 1..203: mol_type = other DNA
ggcgcgccagtcctagctcaacagggtcttctttccccgctgattccgccaagcccgttcccttggctgtggtttcgctggatagtaggtagggacagtgggaatctcgttcatccattcatgcgcgtcactaattagatgacgaggcatttggctaccttaagagagtcatagttactcccgccgttcgactcggaccgatg

SEQ ID NO: 8910 - DNA, 203 bp, Homo sapiens
  source 1..203: mol_type = other DNA
ggcgcgccagtcctccccgctgattccgccaagcccgttcccttggctgtggtttcgctggatagtaggtagggacagtgggaatctcgttcatccattcatgcgcgtcactaattagatgacgaggcatttggctaccttaagagagtcatagttactcccgccgtttacccgcgcttcattgaattcgactcggaccgatg

SEQ ID NO: 8911 - DNA, 203 bp, Homo sapiens
  source 1..203: mol_type = other DNA
ggcgcgccagtcctccgttcccttggctgtggtttcgctggatagtaggtagggacagtgggaatctcgttcatccattcatgcgcgtcactaattagatgacgaggcatttggctaccttaagagagtcatagttactcccgccgtttacccgcgcttcattgaatttcttcactttgacattcagacgactcggaccgatg

SEQ ID NO: 8912 - DNA, 203 bp, Homo sapiens
  source 1..203: mol_type = other DNA
ggcgcgccagtcctggctgtggtttcgctggatagtaggtagggacagtgggaatctcgttcatccattcatgcgcgtcactaattagatgacgaggcatttggctaccttaagagagtcatagttactcccgccgtttacccgcgcttcattgaatttcttcactttgacattcagagcactgggcacgactcggaccgatg

SEQ ID NO: 8913 - DNA, 203 bp, Homo sapiens
  source 1..203: mol_type = other DNA
ggcgcgccagtccttcgctggatagtaggtagggacagtgggaatctcgttcatccattcatgcgcgtcactaattagatgacgaggcatttggctaccttaagagagtcatagttactcccgccgtttacccgcgcttcattgaatttcttcactttgacattcagagcactgggcagaaatcacatcgactcggaccgatg

SEQ ID NO: 8914 - DNA, 203 bp, Homo sapiens
  source 1..203: mol_type = other DNA
ggcgcgccagtcctgtaggtagggacagtgggaatctcgttcatccattcatgcgcgtcactaattagatgacgaggcatttggctaccttaagagagtcatagttactcccgccgtttacccgcgcttcattgaatttcttcactttgacattcagagcactgggcagaaatcacatcgcgtcaacacgactcggaccgatg

SEQ ID NO: 8915 - DNA, 203 bp, Homo sapiens
  source 1..203: mol_type = other DNA
ggcgcgccagtcctgcgtcactaattagatgacgaggcatttggctaccttaagagagtcatagttactcccgccgtttacccgcgcttcattgaatttcttcactttgacattcagagcactgggcagaaatcacatcgcgtcaacacccgccgcgggccttcgcgatgctttgttttaattaaacacgactcggaccgatg

SEQ ID NO: 8916 - DNA, 203 bp, Homo sapiens
  source 1..203: mol_type = other DNA
ggcgcgccagtcctctaccttaagagagtcatagttactcccgccgtttacccgcgcttcattgaatttcttcactttgacattcagagcactgggcagaaatcacatcgcgtcaacacccgccgcgggccttcgcgatgctttgttttaattaaacagtcggattcccctggtccgcaccagttctacgactcggaccgatg

SEQ ID NO: 8917 - DNA, 203 bp, Homo sapiens
  source 1..203: mol_type = other DNA
ggcgcgccagtcctagagtcatagttactcccgccgtttacccgcgcttcattgaatttcttcactttgacattcagagcactgggcagaaatcacatcgcgtcaacacccgccgcgggccttcgcgatgctttgttttaattaaacagtcggattcccctggtccgcaccagttctaagtcggctgccgactcggaccgatg

SEQ ID NO: 8918 - DNA, 203 bp, Homo sapiens
  source 1..203: mol_type = other DNA
ggcgcgccagtcctttactcccgccgtttacccgcgcttcattgaatttcttcactttgacattcagagcactgggcagaaatcacatcgcgtcaacacccgccgcgggccttcgcgatgctttgttttaattaaacagtcggattcccctggtccgcaccagttctaagtcggctgctaggcgccggcgactcggaccgatg

SEQ ID NO: 8919 - DNA, 203 bp, Homo sapiens
  source 1..203: mol_type = other DNA
ggcgcgccagtcctgcgcctcgtccagccgcggcgcgcgcccagccccgcttcgcgccccagcccgaccgacccagcccttagagccaatccttatcccgaagttacggatccggcttgccgacttcccttacctacattgttccaacatgccagaggctgttcaccttggagacctgctgcggatatcgactcggaccgatg

SEQ ID NO: 8920 - DNA, 203 bp, Homo sapiens
  source 1..203: mol_type = other DNA
ggcgcgccagtcctcagccgcggcgcgcgcccagccccgcttcgcgccccagcccgaccgacccagcccttagagccaatccttatcccgaagttacggatccggcttgccgacttcccttacctacattgttccaacatgccagaggctgttcaccttggagacctgctgcggatatgggtacggcccgactcggaccgatg

SEQ ID NO: 8921 - DNA, 203 bp, Homo sapiens
  source 1..203: mol_type = other DNA
ggcgcgccagtcctcgccccagcccgaccgacccagcccttagagccaatccttatcccgaagttacggatccggcttgccgacttcccttacctacattgttccaacatgccagaggctgttcaccttggagacctgctgcggatatgggtacggcccggcgcgagatttacaccctctcccccggacgactcggaccgatg

SEQ ID NO: 8922 - DNA, 203 bp, Homo sapiens
  source 1..203: mol_type = other DNA
ggcgcgccagtcctcgaccgacccagcccttagagccaatccttatcccgaagttacggatccggcttgccgacttcccttacctacattgttccaacatgccagaggctgttcaccttggagacctgctgcggatatgggtacggcccggcgcgagatttacaccctctcccccggattttcaagggcgactcggaccgatg

SEQ ID NO: 8923 - DNA, 203 bp, Homo sapiens
  source 1..203: mol_type = other DNA
ggcgcgccagtcctagcccttagagccaatccttatcccgaagttacggatccggcttgccgacttcccttacctacattgttccaacatgccagaggctgttcaccttggagacctgctgcggatatgggtacggcccggcgcgagatttacaccctctcccccggattttcaagggccagcgagagcgactcggaccgatg

SEQ ID NO: 8924 - DNA, 203 bp, Homo sapiens
  source 1..203: mol_type = other DNA
ggcgcgccagtcctttcccttacctacattgttccaacatgccagaggctgttcaccttggagacctgctgcggatatgggtacggcccggcgcgagatttacaccctctcccccggattttcaagggccagcgagagctcaccggacgccgccggaaccgcgacgctttccaaggcacgggcccctccgactcggaccgatg

SEQ ID NO: 8925 - DNA, 203 bp, Homo sapiens
  source 1..203: mol_type = other DNA
ggcgcgccagtcctcaacatgccagaggctgttcaccttggagacctgctgcggatatgggtacggcccggcgcgagatttacaccctctcccccggattttcaagggccagcgagagctcaccggacgccgccggaaccgcgacgctttccaaggcacgggcccctctctcggggcgaacccattcccgactcggaccgatg

SEQ ID NO: 8926 - DNA, 203 bp, Homo sapiens
  source 1..203: mol_type = other DNA
ggcgcgccagtcctaccttggagacctgctgcggatatgggtacggcccggcgcgagatttacaccctctcccccggattttcaagggccagcgagagctcaccggacgccgccggaaccgcgacgctttccaaggcacgggcccctctctcggggcgaacccattccagggcgccctgcccttcacacgactcggaccgatg

SEQ ID NO: 8927 - DNA, 203 bp, Homo sapiens
  source 1..203: mol_type = other DNA
ggcgcgccagtcctggcccggcgcgagatttacaccctctcccccggattttcaagggccagcgagagctcaccggacgccgccggaaccgcgacgctttccaaggcacgggcccctctctcggggcgaacccattccagggcgccctgcccttcacaaagaaaagagaactctccccggggctcccgcgactcggaccgatg

SEQ ID NO: 8928 - DNA, 203 bp, Homo sapiens
  source 1..203: mol_type = other DNA
ggcgcgccagtcctgagatttacaccctctcccccggattttcaagggccagcgagagctcaccggacgccgccggaaccgcgacgctttccaaggcacgggcccctctctcggggcgaacccattccagggcgccctgcccttcacaaagaaaagagaactctccccggggctcccgccggcttctccgactcggaccgatg

SEQ ID NO: 8929 - DNA, 203 bp, Homo sapiens
  source 1..203: mol_type = other DNA
ggcgcgccagtcctccctctcccccggattttcaagggccagcgagagctcaccggacgccgccggaaccgcgacgctttccaaggcacgggcccctctctcggggcgaacccattccagggcgccctgcccttcacaaagaaaagagaactctccccggggctcccgccggcttctccgggatcggtcgactcggaccgatg

SEQ ID NO: 8930 - DNA, 203 bp, Homo sapiens
  source 1..203: mol_type = other DNA
ggcgcgccagtcctagggccagcgagagctcaccggacgccgccggaaccgcgacgctttccaaggcacgggcccctctctcggggcgaacccattccagggcgccctgcccttcacaaagaaaagagaactctccccggggctcccgccggcttctccgggatcggtcgcgttaccgcactggacgccgactcggaccgatg

SEQ ID NO: 8931 - DNA, 203 bp, Homo sapiens
  source 1..203: mol_type = other DNA
ggcgcgccagtcctggacgccgccggaaccgcgacgctttccaaggcacgggcccctctctcggggcgaacccattccagggcgccctgcccttcacaaagaaaagagaactctccccggggctcccgccggcttctccgggatcggtcgcgttaccgcactggacgcctcgcggcgcccatctccgccgactcggaccgatg

SEQ ID NO: 8932 - DNA, 203 bp, Homo sapiens
  source 1..203: mol_type = other DNA
ggcgcgccagtcctggaaccgcgacgctttccaaggcacgggcccctctctcggggcgaacccattccagggcgccctgcccttcacaaagaaaagagaactctccccggggctcccgccggcttctccgggatcggtcgcgttaccgcactggacgcctcgcggcgcccatctccgccactccggatcgactcggaccgatg

SEQ ID NO: 8933 - DNA, 203 bp, Homo sapiens
  source 1..203: mol_type = other DNA
ggcgcgccagtcctcctctctcggggcgaacccattccagggcgccctgcccttcacaaagaaaagagaactctccccggggctcccgccggcttctccgggatcggtcgcgttaccgcactggacgcctcgcggcgcccatctccgccactccggattcggggatctgaacccgactccctttcgatcgactcggaccgatg

SEQ ID NO: 8934 - DNA, 203 bp, Homo sapiens
  source 1..203: mol_type = other DNA
ggcgcgccagtcctccctgcccttcacaaagaaaagagaactctccccggggctcccgccggcttctccgggatcggtcgcgttaccgcactggacgcctcgcggcgcccatctccgccactccggattcggggatctgaacccgactccctttcgatcggccgagggcaacggaggccatcgcccgtcgactcggaccgatg

SEQ ID NO: 8935 - DNA, 203 bp, Homo sapiens
  source 1..203: mol_type = other DNA
ggcgcgccagtcctccccggggctcccgccggcttctccgggatcggtcgcgttaccgcactggacgcctcgcggcgcccatctccgccactccggattcggggatctgaacccgactccctttcgatcggccgagggcaacggaggccatcgcccgtcccttcggaacggcgctcgcccatctctcacgactcggaccgatg

SEQ ID NO: 8936 - DNA, 203 bp, Homo sapiens
  source 1..203: mol_type = other DNA
ggcgcgccagtcctcccgccggcttctccgggatcggtcgcgttaccgcactggacgcctcgcggcgcccatctccgccactccggattcggggatctgaacccgactccctttcgatcggccgagggcaacggaggccatcgcccgtcccttcggaacggcgctcgcccatctctcaggaccgactgcgactcggaccgatg

SEQ ID NO: 8937 - DNA, 203 bp, Homo sapiens
  source 1..203: mol_type = other DNA
ggcgcgccagtccttctccgggatcggtcgcgttaccgcactggacgcctcgcggcgcccatctccgccactccggattcggggatctgaacccgactccctttcgatcggccgagggcaacggaggccatcgcccgtcccttcggaacggcgctcgcccatctctcaggaccgactgacccatgttccgactcggaccgatg

SEQ ID NO: 8938 - DNA, 203 bp, Homo sapiens
  source 1..203: mol_type = other DNA
ggcgcgccagtcctcggtcgcgttaccgcactggacgcctcgcggcgcccatctccgccactccggattcggggatctgaacccgactccctttcgatcggccgagggcaacggaggccatcgcccgtcccttcggaacggcgctcgcccatctctcaggaccgactgacccatgttcaactgctgttcgactcggaccgatg

SEQ ID NO: 8939 - DNA, 203 bp, Homo sapiens
  source 1..203: mol_type = other DNA
ggcgcgccagtcctcgatcggccgagggcaacggaggccatcgcccgtcccttcggaacggcgctcgcccatctctcaggaccgactgacccatgttcaactgctgttcacatggaacccttctccacttcggccttcaaagttctcgtttgaatatttgctactaccaccaagatctgcacctgcggcgactcggaccgatg

SEQ ID NO: 8940 - DNA, 203 bp, Homo sapiens
  source 1..203: mol_type = other DNA
ggcgcgccagtcctagggcaacggaggccatcgcccgtcccttcggaacggcgctcgcccatctctcaggaccgactgacccatgttcaactgctgttcacatggaacccttctccacttcggccttcaaagttctcgtttgaatatttgctactaccaccaagatctgcacctgcggcggctccacccgactcggaccgatg

SEQ ID NO: 8941 - DNA, 203 bp, Homo sapiens
  source 1..203: mol_type = other DNA
ggcgcgccagtcctccgtcccttcggaacggcgctcgcccatctctcaggaccgactgacccatgttcaactgctgttcacatggaacccttctccacttcggccttcaaagttctcgtttgaatatttgctactaccaccaagatctgcacctgcggcggctccacccgggcccgcgccctaggcttcgactcggaccgatg

SEQ ID NO: 8942 - DNA, 203 bp, Homo sapiens
  source 1..203: mol_type = other DNA
ggcgcgccagtcctggaacggcgctcgcccatctctcaggaccgactgacccatgttcaactgctgttcacatggaacccttctccacttcggccttcaaagttctcgtttgaatatttgctactaccaccaagatctgcacctgcggcggctccacccgggcccgcgccctaggcttcaaggctcaccgactcggaccgatg

SEQ ID NO: 8943 - DNA, 203 bp, Homo sapiens
  source 1..203: mol_type = other DNA
ggcgcgccagtcctactgacccatgttcaactgctgttcacatggaacccttctccacttcggccttcaaagttctcgtttgaatatttgctactaccaccaagatctgcacctgcggcggctccacccgggcccgcgccctaggcttcaaggctcaccgcagcggccctcctactcgtcgcggcgtacgactcggaccgatg

SEQ ID NO: 8944 - DNA, 203 bp, Homo sapiens
  source 1..203: mol_type = other DNA
ggcgcgccagtcctccacttcggccttcaaagttctcgtttgaatatttgctactaccaccaagatctgcacctgcggcggctccacccgggcccgcgccctaggcttcaaggctcaccgcagcggccctcctactcgtcgcggcgtagcgtccgcggggctccgggggcggggagcggggcgtgggccgactcggaccgatg

SEQ ID NO: 8945 - DNA, 203 bp, Homo sapiens
  source 1..203: mol_type = other DNA
ggcgcgccagtcctctcgtttgaatatttgctactaccaccaagatctgcacctgcggcggctccacccgggcccgcgccctaggcttcaaggctcaccgcagcggccctcctactcgtcgcggcgtagcgtccgcggggctccgggggcggggagcggggcgtgggcgggaggaggggaggaggcgtcgactcggaccgatg

SEQ ID NO: 8946 - DNA, 203 bp, Homo sapiens
  source 1..203: mol_type = other DNA
ggcgcgccagtcctcacccgggcccgcgccctaggcttcaaggctcaccgcagcggccctcctactcgtcgcggcgtagcgtccgcggggctccgggggcggggagcggggcgtgggcgggaggaggggaggaggcgtgggggggggggcgggggaaggaccccacacccccgccgccgccgccgccgcgactcggaccgatg

SEQ ID NO: 8947 - DNA, 203 bp, Homo sapiens
  source 1..203: mol_type = other DNA
ggcgcgccagtccttccgacgcacaccacacgcgcgcgcgcgcgcgccgcccccgccgctcccgtccactctcgactgccggcgacggccgggtatgggcccgacgctccagcgccatccattttcagggctagttgattcggcaggtgagttgttacacactccttagcggattccgacttccatggcgactcggaccgatg

SEQ ID NO: 8948 - DNA, 203 bp, Homo sapiens
  source 1..203: mol_type = other DNA
ggcgcgccagtcctcgccgcccccgccgctcccgtccactctcgactgccggcgacggccgggtatgggcccgacgctccagcgccatccattttcagggctagttgattcggcaggtgagttgttacacactccttagcggattccgacttccatggccaccgtcctgctgtctatatcaaccaacacgactcggaccgatg

SEQ ID NO: 8949 - DNA, 203 bp, Homo sapiens
  source 1..203: mol_type = other DNA
ggcgcgccagtccttccactctcgactgccggcgacggccgggtatgggcccgacgctccagcgccatccattttcagggctagttgattcggcaggtgagttgttacacactccttagcggattccgacttccatggccaccgtcctgctgtctatatcaaccaacaccttttctggggtctgatgacgactcggaccgatg

SEQ ID NO: 8950 - DNA, 203 bp, Homo sapiens
  source 1..203: mol_type = other DNA
ggcgcgccagtcctactgccggcgacggccgggtatgggcccgacgctccagcgccatccattttcagggctagttgattcggcaggtgagttgttacacactccttagcggattccgacttccatggccaccgtcctgctgtctatatcaaccaacaccttttctggggtctgatgagcgtcggcatcgactcggaccgatg

SEQ ID NO: 8951 - DNA, 203 bp, Homo sapiens
  source 1..203: mol_type = other DNA
ggcgcgccagtcctacggccgggtatgggcccgacgctccagcgccatccattttcagggctagttgattcggcaggtgagttgttacacactccttagcggattccgacttccatggccaccgtcctgctgtctatatcaaccaacaccttttctggggtctgatgagcgtcggcatcgggcgccttcgactcggaccgatg

SEQ ID NO: 8952 - DNA, 203 bp, Homo sapiens
  source 1..203: mol_type = other DNA
ggcgcgccagtcctccatccattttcagggctagttgattcggcaggtgagttgttacacactccttagcggattccgacttccatggccaccgtcctgctgtctatatcaaccaacaccttttctggggtctgatgagcgtcggcatcgggcgccttaacccggcgttcggttcatcccgcagcgcccgactcggaccgatg

SEQ ID NO: 8953 - DNA, 203 bp, Homo sapiens
  source 1..203: mol_type = other DNA
ggcgcgccagtccttcagggctagttgattcggcaggtgagttgttacacactccttagcggattccgacttccatggccaccgtcctgctgtctatatcaaccaacaccttttctggggtctgatgagcgtcggcatcgggcgccttaacccggcgttcggttcatcccgcagcgccagttctgcttcgactcggaccgatg

SEQ ID NO: 8954 - DNA, 203 bp, Homo sapiens
  source 1..203: mol_type = other DNA
ggcgcgccagtcctaggtgagttgttacacactccttagcggattccgacttccatggccaccgtcctgctgtctatatcaaccaacaccttttctggggtctgatgagcgtcggcatcgggcgccttaacccggcgttcggttcatcccgcagcgccagttctgcttaccaaaagtggcccactaggcgactcggaccgatg

SEQ ID NO: 8955 - DNA, 203 bp, Homo sapiens
  source 1..203: mol_type = other DNA
ggcgcgccagtccttccgacttccatggccaccgtcctgctgtctatatcaaccaacaccttttctggggtctgatgagcgtcggcatcgggcgccttaacccggcgttcggttcatcccgcagcgccagttctgcttaccaaaagtggcccactaggcactcgcattccacgcccggctccacgccacgactcggaccgatg

SEQ ID NO: 8956 - DNA, 203 bp, Homo sapiens
  source 1..203: mol_type = other DNA
ggcgcgccagtcctaacaccttttctggggtctgatgagcgtcggcatcgggcgccttaacccggcgttcggttcatcccgcagcgccagttctgcttaccaaaagtggcccactaggcactcgcattccacgcccggctccacgccagcgagccgggcttcttacccatttaaagtttgagaataggcgactcggaccgatg

SEQ ID NO: 8957 - DNA, 203 bp, Homo sapiens
  source 1..203: mol_type = other DNA
ggcgcgccagtcctctggggtctgatgagcgtcggcatcgggcgccttaacccggcgttcggttcatcccgcagcgccagttctgcttaccaaaagtggcccactaggcactcgcattccacgcccggctccacgccagcgagccgggcttcttacccatttaaagtttgagaataggttgagatcgtcgactcggaccgatg

SEQ ID NO: 8958 - DNA, 203 bp, Homo sapiens
  source 1..203: mol_type = other DNA
ggcgcgccagtcctatgagcgtcggcatcgggcgccttaacccggcgttcggttcatcccgcagcgccagttctgcttaccaaaagtggcccactaggcactcgcattccacgcccggctccacgccagcgagccgggcttcttacccatttaaagtttgagaataggttgagatcgtttcggccccacgactcggaccgatg

SEQ ID NO: 8959 - DNA, 203 bp, Homo sapiens
  source 1..203: mol_type = other DNA
ggcgcgccagtcctccttaacccggcgttcggttcatcccgcagcgccagttctgcttaccaaaagtggcccactaggcactcgcattccacgcccggctccacgccagcgagccgggcttcttacccatttaaagtttgagaataggttgagatcgtttcggccccaagacctctaatcattcgcttcgactcggaccgatg

SEQ ID NO: 8960 - DNA, 203 bp, Homo sapiens
  source 1..203: mol_type = other DNA
ggcgcgccagtcctcatcccgcagcgccagttctgcttaccaaaagtggcccactaggcactcgcattccacgcccggctccacgccagcgagccgggcttcttacccatttaaagtttgagaataggttgagatcgtttcggccccaagacctctaatcattcgctttaccggataaaactgcgtggcgactcggaccgatg

SEQ ID NO: 8961 - DNA, 203 bp, Homo sapiens
  source 1..203: mol_type = other DNA
ggcgcgccagtcctcattccacgcccggctccacgccagcgagccgggcttcttacccatttaaagtttgagaataggttgagatcgtttcggccccaagacctctaatcattcgctttaccggataaaactgcgtggcgggggtgcgtcgggtctgcgagagcgccagctatcctgagggaaacttccgactcggaccgatg

SEQ ID NO: 8962 - DNA, 203 bp, Homo sapiens
  source 1..203: mol_type = other DNA
ggcgcgccagtcctgccagcgagccgggcttcttacccatttaaagtttgagaataggttgagatcgtttcggccccaagacctctaatcattcgctttaccggataaaactgcgtggcgggggtgcgtcgggtctgcgagagcgccagctatcctgagggaaacttcggagggaaccagctactagacgactcggaccgatg

SEQ ID NO: 8963 - DNA, 203 bp, Homo sapiens
  source 1..203: mol_type = other DNA
ggcgcgccagtcctcgggcttcttacccatttaaagtttgagaataggttgagatcgtttcggccccaagacctctaatcattcgctttaccggataaaactgcgtggcgggggtgcgtcgggtctgcgagagcgccagctatcctgagggaaacttcggagggaaccagctactagatggttcgattcgactcggaccgatg

SEQ ID NO: 8964 - DNA, 203 bp, Homo sapiens
  source 1..203: mol_type = other DNA
ggcgcgccagtcctacccatttaaagtttgagaataggttgagatcgtttcggccccaagacctctaatcattcgctttaccggataaaactgcgtggcgggggtgcgtcgggtctgcgagagcgccagctatcctgagggaaacttcggagggaaccagctactagatggttcgattagtctttcgccgactcggaccgatg

SEQ ID NO: 8965 - DNA, 203 bp, Homo sapiens
  source 1..203: mol_type = other DNA
ggcgcgccagtcctagtttgagaataggttgagatcgtttcggccccaagacctctaatcattcgctttaccggataaaactgcgtggcgggggtgcgtcgggtctgcgagagcgccagctatcctgagggaaacttcggagggaaccagctactagatggttcgattagtctttcgcccctataccccgactcggaccgatg

SEQ ID NO: 8966 - DNA, 203 bp, Homo sapiens
  source 1..203: mol_type = other DNA
ggcgcgccagtccttaggttgagatcgtttcggccccaagacctctaatcattcgctttaccggataaaactgcgtggcgggggtgcgtcgggtctgcgagagcgccagctatcctgagggaaacttcggagggaaccagctactagatggttcgattagtctttcgcccctatacccaggtcggacgcgactcggaccgatg

SEQ ID NO: 8967 - DNA, 203 bp, Homo sapiens
  source 1..203: mol_type = other DNA
ggcgcgccagtccttcgtttcggccccaagacctctaatcattcgctttaccggataaaactgcgtggcgggggtgcgtcgggtctgcgagagcgccagctatcctgagggaaacttcggagggaaccagctactagatggttcgattagtctttcgcccctatacccaggtcggacgaccgatttgccgactcggaccgatg

SEQ ID NO: 8968 - DNA, 203 bp, Homo sapiens
  source 1..203: mol_type = other DNA
ggcgcgccagtcctctaatcattcgctttaccggataaaactgcgtggcgggggtgcgtcgggtctgcgagagcgccagctatcctgagggaaacttcggagggaaccagctactagatggttcgattagtctttcgcccctatacccaggtcggacgaccgatttgcacgtcaggaccgctagggaccgactcggaccgatg

SEQ ID NO: 8969 - DNA, 203 bp, Homo sapiens
  source 1..203: mol_type = other DNA
ggcgcgccagtcctgctttaccggataaaactgcgtggcgggggtgcgtcgggtctgcgagagcgccagctatcctgagggaaacttcggagggaaccagctactagatggttcgattagtctttcgcccctatacccaggtcggacgaccgatttgcacgtcaggaccgctacggacctccaccagacgactcggaccgatg

SEQ ID NO: 8970 - DNA, 203 bp, Homo sapiens
  source 1..203: mol_type = other DNA
ggcgcgccagtcctataaaactgcgtggcgggggtgcgtcgggtctgcgagagcgccagctatcctgagggaaacttcggagggaaccagctactagatggttcgattagtctttcgcccctatacccaggtcggacgaccgatttgcacgtcaggaccgctacggacctccaccagagtttcctctgcgactcggaccgatg

SEQ ID NO: 8971 - DNA, 203 bp, Homo sapiens
  source 1..203: mol_type = other DNA
ggcgcgccagtcctgtggcgggggtgcgtcgggtctgcgagagcgccagctatcctgagggaaacttcggagggaaccagctactagatggttcgattagtctttcgcccctatacccaggtcggacgaccgatttgcacgtcaggaccgctacggacctccaccagagtttcctctggcttcgccctcgactcggaccgatg

SEQ ID NO: 8972 - DNA, 203 bp, Homo sapiens
  source 1..203: mol_type = other DNA
ggcgcgccagtcctcttcggagggaaccagctactagatggttcgattagtctttcgcccctatacccaggtcggacgaccgatttgcacgtcaggaccgctacggacctccaccagagtttcctctggcttcgccctgcccaggcatagttcaccatctttcgggtcctaacacgtgcgctcgtgctcgactcggaccgatg

SEQ ID NO: 8973 - DNA, 203 bp, Homo sapiens
  source 1..203: mol_type = other DNA
ggcgcgccagtccttagatggttcgattagtctttcgcccctatacccaggtcggacgaccgatttgcacgtcaggaccgctacggacctccaccagagtttcctctggcttcgccctgcccaggcatagttcaccatctttcgggtcctaacacgtgcgctcgtgctccacctccccggcgcggcggcgactcggaccgatg

SEQ ID NO: 8974 - DNA, 203 bp, Homo sapiens
  source 1..203: mol_type = other DNA
ggcgcgccagtccttcgcccctatacccaggtcggacgaccgatttgcacgtcaggaccgctacggacctccaccagagtttcctctggcttcgccctgcccaggcatagttcaccatctttcgggtcctaacacgtgcgctcgtgctccacctccccggcgcggcgggcgagacgggccggtggtgccgactcggaccgatg

SEQ ID NO: 8975 - DNA, 203 bp, Homo sapiens
  source 1..203: mol_type = other DNA
ggcgcgccagtcctgacgaccgatttgcacgtcaggaccgctacggacctccaccagagtttcctctggcttcgccctgcccaggcatagttcaccatctttcgggtcctaacacgtgcgctcgtgctccacctccccggcgcggcgggcgagacgggccggtggtgcgccctcggcggactggagagcgactcggaccgatg

SEQ ID NO: 8976 - DNA, 203 bp, Homo sapiens
  source 1..203: mol_type = other DNA
ggcgcgccagtcctttgcacgtcaggaccgctacggacctccaccagagtttcctctggcttcgccctgcccaggcatagttcaccatctttcgggtcctaacacgtgcgctcgtgctccacctccccggcgcggcgggcgagacgggccggtggtgcgccctcggcggactggagaggcctcgggatcgactcggaccgatg

SEQ ID NO: 8977 - DNA, 203 bp, Homo sapiens
  source 1..203: mol_type = other DNA
ggcgcgccagtcctgcatagttcaccatctttcgggtcctaacacgtgcgctcgtgctccacctccccggcgcggcgggcgagacgggccggtggtgcgccctcggcggactggagaggcctcgggatcccacctcggccggcgagcgcgccggccttcaccttcattgcgccacggcggctttcgtgcgactcggaccgatg

SEQ ID NO: 8978 - DNA, 203 bp, Homo sapiens
  source 1..203: mol_type = other DNA
ggcgcgccagtcctgtgcgccctcggcggactggagaggcctcgggatcccacctcggccggcgagcgcgccggccttcaccttcattgcgccacggcggctttcgtgcgagcccccgactcgcgcacgtgttagactccttggtccgtgtttcaagacgggtcgggtgggtagccgacgtcgccgcccgactcggaccgatg

SEQ ID NO: 8979 - DNA, 203 bp, Homo sapiens
  source 1..203: mol_type = other DNA
ggcgcgccagtcctagaggcctcgggatcccacctcggccggcgagcgcgccggccttcaccttcattgcgccacggcggctttcgtgcgagcccccgactcgcgcacgtgttagactccttggtccgtgtttcaagacgggtcgggtgggtagccgacgtcgccgccgaccccgtgcgctcgctccgcgactcggaccgatg

SEQ ID NO: 8980 - DNA, 203 bp, Homo sapiens
  source 1..203: mol_type = other DNA
ggcgcgccagtccttcggccggcgagcgcgccggccttcaccttcattgcgccacggcggctttcgtgcgagcccccgactcgcgcacgtgttagactccttggtccgtgtttcaagacgggtcgggtgggtagccgacgtcgccgccgaccccgtgcgctcgctccgccgtccccctcttcgggggacgactcggaccgatg

SEQ ID NO: 8981 - DNA, 203 bp, Homo sapiens
  source 1..203: mol_type = other DNA
ggcgcgccagtcctcattgcgccacggcggctttcgtgcgagcccccgactcgcgcacgtgttagactccttggtccgtgtttcaagacgggtcgggtgggtagccgacgtcgccgccgaccccgtgcgctcgctccgccgtccccctcttcgggggacgcgcgcgtggccccgagagaacctccccccgactcggaccgatg

SEQ ID NO: 8982 - DNA, 203 bp, Homo sapiens
  source 1..203: mol_type = other DNA
ggcgcgccagtcctgcggggaggaggggtgggagagcggtcgcgccgtgggaggggtggcccggcccccccacgaggagacgcccgcgcgcccccgcgggggagacccccctcgcgggggattccccgcgggggtgggcgccgggaggggggagagcgcggcgacgggtctcgctccctcggccccggcgactcggaccgatg

SEQ ID NO: 8983 - DNA, 203 bp, Homo sapiens
  source 1..203: mol_type = other DNA
ggcgcgccagtcctcgcgggggagacccccctcgcgggggattccccgcgggggtgggcgccgggaggggggagagcgcggcgacgggtctcgctccctcggccccgggattcggcgagtgctgctgccgggggggctgtaacactcggggggggtttcggtcccgccgccgccgccgccgccgccaccgactcggaccgatg

SEQ ID NO: 8984 - DNA, 203 bp, Homo sapiens
  source 1..203: mol_type = other DNA
ggcgcgccagtcctagcgcggcgacgggtctcgctccctcggccccgggattcggcgagtgctgctgccgggggggctgtaacactcggggggggtttcggtcccgccgccgccgccgccgccgccaccgccgccgccgccgccgccccgacccgcgcgccctcccgagggaggacgcggggccggggcgactcggaccgatg

SEQ ID NO: 8985 - DNA, 203 bp, Homo sapiens
  source 1..203: mol_type = other DNA
ggcgcgccagtcctcgccgccgccgccccgacccgcgcgccctcccgagggaggacgcggggccggggggcggagacgggggaggaggaggacggacggacggacggacggggccccccgagccaccttccccgccgggccttcccagccgtcccggagccggtcgcggcgcaccgccgcggtggaaacgactcggaccgatg

SEQ ID NO: 8986 - DNA, 203 bp, Homo sapiens
  source 1..203: mol_type = other DNA
ggcgcgccagtcctggggaagggagggcgggtggaggggtcgggaggaacggggggcgggaaagatccgccgggccgccgacacggccggacccgccgccgggttgaatcctccgggcggactgcgcggaccccacccgtttacctcttaacggtttcacgccctcttgaactctctcttcaaagttccgactcggaccgatg

SEQ ID NO: 8987 - DNA, 203 bp, Homo sapiens
  source 1..203: mol_type = other DNA
ggcgcgccagtcctggcgggaaagatccgccgggccgccgacacggccggacccgccgccgggttgaatcctccgggcggactgcgcggaccccacccgtttacctcttaacggtttcacgccctcttgaactctctcttcaaagttcttttcaactttcccttacggtacttgttgactatcggtctcgactcggaccgatg

SEQ ID NO: 8988 - DNA, 203 bp, Homo sapiens
  source 1..203: mol_type = other DNA
ggcgcgccagtcctgccgccgggttgaatcctccgggcggactgcgcggaccccacccgtttacctcttaacggtttcacgccctcttgaactctctcttcaaagttcttttcaactttcccttacggtacttgttgactatcggtctcgtgccggtatttagccttagatggagtttaccacccgctcgactcggaccgatg

SEQ ID NO: 8989 - DNA, 203 bp, Homo sapiens
  source 1..203: mol_type = other DNA
ggcgcgccagtccttgaatcctccgggcggactgcgcggaccccacccgtttacctcttaacggtttcacgccctcttgaactctctcttcaaagttcttttcaactttcccttacggtacttgttgactatcggtctcgtgccggtatttagccttagatggagtttaccacccgctttgggctgcacgactcggaccgatg

SEQ ID NO: 8990 - DNA, 203 bp, Homo sapiens
  source 1..203: mol_type = other DNA
ggcgcgccagtcctcgcggaccccacccgtttacctcttaacggtttcacgccctcttgaactctctcttcaaagttcttttcaactttcccttacggtacttgttgactatcggtctcgtgccggtatttagccttagatggagtttaccacccgctttgggctgcattcccaagcaacccgactcccgactcggaccgatg

SEQ ID NO: 8991 - DNA, 203 bp, Homo sapiens
  source 1..203: mol_type = other DNA
ggcgcgccagtcctctcttaacggtttcacgccctcttgaactctctcttcaaagttcttttcaactttcccttacggtacttgttgactatcggtctcgtgccggtatttagccttagatggagtttaccacccgctttgggctgcattcccaagcaacccgactccgggaagacccgggcccggcgcgactcggaccgatg

SEQ ID NO: 8992 - DNA, 203 bp, Homo sapiens
  source 1..203: mol_type = other DNA
ggcgcgccagtccttttcacgccctcttgaactctctcttcaaagttcttttcaactttcccttacggtacttgttgactatcggtctcgtgccggtatttagccttagatggagtttaccacccgctttgggctgcattcccaagcaacccgactccgggaagacccgggccccgcgcgccgggggccgactcggaccgatg

SEQ ID NO: 8993 - DNA, 203 bp, Homo sapiens
  source 1..203: mol_type = other DNA
ggcgcgccagtccttcttgaactctctcttcaaagttcttttcaactttcccttacggtacttgttgactatcggtctcgtgccggtatttagccttagatggagtttaccacccgctttgggctgcattcccaagcaacccgactccgggaagacccgggccccgcgcgccgggggccgctaccggccgactcggaccgatg

SEQ ID NO: 8994 - DNA, 203 bp, Homo sapiens
  source 1..203: mol_type = other DNA
ggcgcgccagtcctttgactatcggtctcgtgccggtatttagccttagatggagtttaccacccgctttgggctgcattcccaagcaacccgactccgggaagacccgggccccgcgcgccgggggccgctaccggcctcacaccgtccacgggctgggcctcgatcagaaggacttgggccccccacgactcggaccgatg

SEQ ID NO: 8995 - DNA, 203 bp, Homo sapiens
  source 1..203: mol_type = other DNA
ggcgcgccagtcctgtctcgtgccggtatttagccttagatggagtttaccacccgctttgggctgcattcccaagcaacccgactccgggaagacccgggccccgcgcgccgggggccgctaccggcctcacaccgtccacgggctgggcctcgatcagaaggacttgggccccccacgagcggcgccgactcggaccgatg

SEQ ID NO: 8996 - DNA, 203 bp, Homo sapiens
  source 1..203: mol_type = other DNA
ggcgcgccagtcctcgctttgggctgcattcccaagcaacccgactccgggaagacccgggccccgcgcgccgggggccgctaccggcctcacaccgtccacgggctgggcctcgatcagaaggacttgggccccccacgagcggcgccggggagcgggtcttccgtacgccacatgtcccgcgcccccgactcggaccgatg

SEQ ID NO: 8997 - DNA, 203 bp, Homo sapiens
  source 1..203: mol_type = other DNA
ggcgcgccagtccttgcattcccaagcaacccgactccgggaagacccgggccccgcgcgccgggggccgctaccggcctcacaccgtccacgggctgggcctcgatcagaaggacttgggccccccacgagcggcgccggggagcgggtcttccgtacgccacatgtcccgcgccccgccgcggggccgactcggaccgatg

SEQ ID NO: 8998 - DNA, 203 bp, Homo sapiens
  source 1..203: mol_type = other DNA
ggcgcgccagtcctgggccgctaccggcctcacaccgtccacgggctgggcctcgatcagaaggacttgggccccccacgagcggcgccggggagcgggtcttccgtacgccacatgtcccgcgccccgccgcggggcggggattcggcgctgggctcttccctgttcactcgccgttactgagggaacgactcggaccgatg

SEQ ID NO: 8999 - DNA, 203 bp, Homo sapiens
  source 1..203: mol_type = other DNA
ggcgcgccagtcctccgtccacgggctgggcctcgatcagaaggacttgggccccccacgagcggcgccggggagcgggtcttccgtacgccacatgtcccgcgccccgccgcggggcggggattcggcgctgggctcttccctgttcactcgccgttactgagggaatcctggttagtttcttctcccgactcggaccgatg

SEQ ID NO: 9000 - DNA, 203 bp, Homo sapiens
  source 1..203: mol_type = other DNA
ggcgcgccagtcctacttgggccccccacgagcggcgccggggagcgggtcttccgtacgccacatgtcccgcgccccgccgcggggcggggattcggcgctgggctcttccctgttcactcgccgttactgagggaatcctggttagtttcttctcctccgctgactaatatgcttaaattcagcggcgactcggaccgatg

SEQ ID NO: 9001 - DNA, 203 bp, Homo sapiens
  source 1..203: mol_type = other DNA
ggcgcgccagtcctcccacgagcggcgccggggagcgggtcttccgtacgccacatgtcccgcgccccgccgcggggcggggattcggcgctgggctcttccctgttcactcgccgttactgagggaatcctggttagtttcttctcctccgctgactaatatgcttaaattcagcgggtcgccacgtcgactcggaccgatg

SEQ ID NO: 9002 - DNA, 203 bp, Homo sapiens
  source 1..203: mol_type = other DNA
ggcgcgccagtcctgcttccgtagaggccagctggttgctacgcagcaacaggaaacattccgcgctaccgagtactttctactcccgaccaggcattgctctctctggagaccctcggcggtggttgctgtattttgacttggagtaaggatgacttttcgggccacagatagtgaatttgacctgacgactcggaccgatg

SEQ ID NO: 9003 - DNA, 203 bp, Homo sapiens
  source 1..203: mol_type = other DNA
ggcgcgccagtcctgattacagtgccaaccttactcccaaagtttgccacgaaatatctcgcttctgttattttcgcatggttctggtatattgacttttgaaacaaaagacatcattctgtttatagcattctgtttttagtagtgggatttccatctacaaaatatagtaattctcgatcgctgaacgactcggaccgatg

SEQ ID NO: 9004 - DNA, 203 bp, Homo sapiens
  source 1..203: mol_type = other DNA
ggcgcgccagtcctatgtcctacaactgctgctgtggaaacttctcctcccattcctgtgagggctacctgtgctactcaggctactcccgtggtggctcctcgtaccccagcaacctggtctacagcactgaacctttgatctcccagcacctgccagctgggttcctctctctgcaagggctttcacgactcggaccgatg

SEQ ID NO: 9005 - DNA, 203 bp, Homo sapiens
  source 1..203: mol_type = other DNA
ggcgcgccagtcctagcgtgccccgggcccggcggaggaggcggctgcagttggagtggagtcttgggagcgctgctggcagcgacttctcagcgaagcaagtgtctgagactgagagtccctaacagcggcagcggcggccacggcggcggctggggccgaggtgtgttctactccctcttctgggacgactcggaccgatg

SEQ ID NO: 9006 - DNA, 203 bp, Homo sapiens
  source 1..203: mol_type = other DNA
ggcgcgccagtcctgcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccgcgactcggaccgatg

SEQ ID NO: 9007 - DNA, 203 bp, Homo sapiens
  source 1..203: mol_type = other DNA
ggcgcgccagtcctggaatacctaggcctccagactactccccctaactcatatttagattcctgaagcttctgcacatgtagttcctagagctgctgcttattaaaatgtcaacatcttcatcttctagctgggacaacctcttagagtctctctctctcagcacagtatggaattggatacaagcacgactcggaccgatg

SEQ ID NO: 9008 - DNA, 203 bp, Homo sapiens
  source 1..203: mol_type = other DNA
ggcgcgccagtcctgcgggattccaaggcctcatcgagtgcgggtatctggctgtggattcgccgccgtcctgctggacgcctggaggctcgaaccccgccgcccccctaccccaggctttactcccaccccggcttccgcccactgtgctgcccttcctcggacctgggctgtcgggagagctggagcgactcggaccgatg

SEQ ID NO: 9009 - DNA, 203 bp, Homo sapiens
  source 1..203: mol_type = other DNA
ggcgcgccagtcctggctaccatggtaacaggttccagggtaacagaggagggagctgggtcctgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 9010 - DNA, 203 bp, Homo sapiens
  source 1..203: mol_type = other DNA
ggcgcgccagtcctacgtgtgtatgtgtgtgtgtgtgtattgggtttctctctcccttgtaagaacacagccagcccgccctctcctgctgttgctgcagctctgacttgctttttcctgcctccttcctctcctctctcttcttgcttagcttcttgccttctgatactactcccaagatggaggctcgactcggaccgatg

SEQ ID NO: 9011 - DNA, 203 bp, Homo sapiens
  source 1..203: mol_type = other DNA
ggcgcgccagtcctagatgtccccggccggcgagagcgggcgccggggttcgctctgagtcgcgtggcaggccgcgctgcgtccaccgctgccgagttcagagccgcgcaccgcccgccgccgcaggtcgggttcccagcgctactcccaagacaccgctcagccatgaagatgcatttctgtatccccgactcggaccgatg

SEQ ID NO: 9012 - DNA, 203 bp, Homo sapiens
  source 1..203: mol_type = other DNA
ggcgcgccagtcctcgaggctgcaccagcgcctggcaccatgaggacgcctgggcctctgcccgtgctgctgctgctcctggcgggagcccccgccgcgcggcccactcccccgacctgctactcccgcatgcgggccctgagccaggagatcacccgcgacttcaacctcctgcaggtctcggagcccgactcggaccgatg

SEQ ID NO: 9013 - DNA, 203 bp, Homo sapiens
  source 1..203: mol_type = other DNA
ggcgcgccagtcctcctctcttccagggctgccgtccacactctcccggtcagagtcctgggaccacatggggacgctgccatggcttcttgccttcttcattctgggtctccaggcttgggatactcccaccatcgtctcccgcaaggagtggggggcaagaccgctcgcctgcagggccctgctgacgactcggaccgatg

SEQ ID NO: 9014 - DNA, 203 bp, Homo sapiens
  source 1..203: mol_type = other DNA
ggcgcgccagtccttaattttgccctaggtctggccaggaggcctcacatccagagacctgcccccgctcttgcagtgccagggccatggggctccggagccaccacctcagcctgggccttctgcttctgtttctactccctgcagagtgcctgggagctgagggccggctggctctcaagctgttccgactcggaccgatg

SEQ ID NO: 9015 - DNA, 203 bp, Homo sapiens
  source 1..203: mol_type = other DNA
ggcgcgccagtcctcccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggattaaagcaaggagagccaatccgactcggaccgatg

SEQ ID NO: 9016 - DNA, 203 bp, Homo sapiens
  source 1..203: mol_type = other DNA
ggcgcgccagtccttcttttggtgcagaaggtgacgggaaacaggccgcagacctgaacttccaaccgtatgtaggcgagaagccggtgccgatactcccactatcccacaatgtcccactgggccccagagtggaagagggcggaggctaatccaagagaccttggggccagctgggatgtcaggggcgactcggaccgatg

SEQ ID NO: 9017 - DNA, 203 bp, Homo sapiens
  source 1..203: mol_type = other DNA
ggcgcgccagtcctgaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctcccgactcggaccgatg

SEQ ID NO: 9018 - DNA, 203 bp, Homo sapiens
  source 1..203: mol_type = other DNA
ggcgcgccagtcctagtaggagtggagagcgtgcgtgagtgagtgtgtgtgtgtgtgtgtgtgtgtgtgcatgcgtgtgtgaagaatgcacactatctcctgttggtaagtgtgtgcttactccctgaccagatgctgcggtgcacggggcagccaccatctctgcatgcatgtctgtgatgtcttcccgactcggaccgatg

SEQ ID NO: 9019 - DNA, 203 bp, Homo sapiens
  source 1..203: mol_type = other DNA
ggcgcgccagtcctgctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaacccgactcggaccgatg

SEQ ID NO: 9020 - DNA, 203 bp, Homo sapiens
  source 1..203: mol_type = other DNA
ggcgcgccagtcctgtgcaaataaggtttctgtggtgagacaccagataaactcaacttcctctttcaacaacaaatgtgtcagttatcagcaggatccatgccgccagagtaaagctttctaccctttactccctgcaaagaaacaagagtgcttatcccagctaagctccagggaaccataaatcccgactcggaccgatg

SEQ ID NO: 9021 - DNA, 203 bp, Homo sapiens
  source 1..203: mol_type = other DNA
ggcgcgccagtcctagtttgcttggagctcctggggcctaacaaaaagaaacctgccatgctgctcttcctcctctctgcactggtcctgctcacacagcccctgggctacctggaagcagaaatgaagacctactcccacagaacaatgcccagtgcttgcaccctggtcatgtgtagctcagtggacgactcggaccgatg

SEQ ID NO: 9022 - DNA, 203 bp, Homo sapiens
  source 1..203: mol_type = other DNA
ggcgcgccagtcctgcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcagctggtccttactccctgcccgactcggaccgatg

SEQ ID NO: 9023 - DNA, 203 bp, Homo sapiens
  source 1..203: mol_type = other DNA
ggcgcgccagtcctgacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgcgactcggaccgatg

SEQ ID NO: 9024 - DNA, 203 bp, Homo sapiens
  source 1..203: mol_type = other DNA
ggcgcgccagtcctagcttcttctagaagcaggccctgaacaggacgtgggtaagagatccgctgtcccttgagacttggcctactcccggcactccgcggacagccccagcctgcggacagccccagcctgcgtcacttgtccgcatgccagctccacccgggcggacccacacatggttcctacttcgactcggaccgatg

SEQ ID NO: 9025 - DNA, 203 bp, Homo sapiens
  source 1..203: mol_type = other DNA
ggcgcgccagtcctggcccgcagtcctactcccgccgagacccgccgctccggtcctgccccgaactgcccacggccggcagcgcttccaggccctgaaaaaaactctcttcctgtgtctggccagaggtatagagagagacaggttcaactctaaggcctgaaaaggaacaaggcccaccggaagcacgactcggaccgatg

SEQ ID NO: 9026 - DNA, 203 bp, Homo sapiens
  source 1..203: mol_type = other DNA
ggcgcgccagtcctggccgcaggtttgactcccgtgcggtgcggcccagcagccacaaagctcccgctgccattgctccttgtactcccgccgtcactgccgctgtccaacccctcccccggggcttgcgcggcggctcccacacccctcggcccgtgtacgcgctctgcacctgcctgcccgaaaaccgactcggaccgatg

SEQ ID NO: 9027 - DNA, 203 bp, Homo sapiens
  source 1..203: mol_type = other DNA
ggcgcgccagtcctattggactcctagatccgcgagggcgcggcgcagccgagcagcggctctttcagcattggcaaccccaggggccaatatttcccacttagccacagctccagcatcctctctgtgggctgttcaccaactgtacaaccaccatttcactgtggacattactccctcttacagatcgactcggaccgatg

SEQ ID NO: 9028 - DNA, 203 bp, Homo sapiens
  source 1..203: mol_type = other DNA
ggcgcgccagtcctctttccgacactctttgggaagagaatctctaatgacggcaacagtggagaacctaacgttccagaaggacactttgggaaatgctgttgacaaaaacacatccagattggagctccgttcttactcccttgcagggcgccacggctcgacagagccactcgtcctcgcctggtcgactcggaccgatg

SEQ ID NO: 9029 - DNA, 203 bp, Homo sapiens
  source 1..203: mol_type = other DNA
ggcgcgccagtcctcccgaggagccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcacgactcggaccgatg

SEQ ID NO: 9030 - DNA, 203 bp, Homo sapiens
  source 1..203: mol_type = other DNA
ggcgcgccagtcctaagtgttgcgcaggcgcatccgatcgactcggtaggtggggatctcttggagacggcgacccaggcatctggggagccacagaagtcgtactcccttaaaccctgctttgctccccctgtggatgtaaccccttagctggcattttgcatctcaattggcttgtgatggaggcgcgactcggaccgatg

SEQ ID NO: 9031 - DNA, 203 bp, Homo sapiens
  source 1..203: mol_type = other DNA
ggcgcgccagtcctgagcagagccctttcacacacctcaggaacacctttcggctgcccgctccccagacacacctgcagccctgcccagccggctttgctcacccactgcttgtaaatgccccagatatgagccagcccaggccccgctacgtggtagacagagccgcatactcccttaccctcttccgactcggaccgatg

SEQ ID NO: 9032 - DNA, 203 bp, Homo sapiens
  source 1..203: mol_type = other DNA
ggcgcgccagtcctccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccacgactcggaccgatg

SEQ ID NO: 9033 - DNA, 203 bp, Homo sapiens
  source 1..203: mol_type = other DNA
ggcgcgccagtccttttttcacccgcgctctccccccttactccctcagcctcccacccgggatggagccatgtgcggcgtggagtccccgcggtgggagagagaatgtaatggacatcggtctgaccaacgagaagcccaacccggaactctcttactccggctccttccagccagcccccggcaaccgactcggaccgatg

SEQ ID NO: 9034 - DNA, 203 bp, Homo sapiens
  source 1..203: mol_type = other DNA
ggcgcgccagtcctaatctctacgttcaaagtctaactttgacagacaaccttacttccagcgaagtctactcccctccctccggagggaagaatgggctgcggttaagcgtttgccctggtgtcagggccaactgcttcgaagcgccagactttcggagactgtgggtggggagcattaagcgggaacgactcggaccgatg

SEQ ID NO: 9035 - DNA, 203 bp, Homo sapiens
  source 1..203: mol_type = other DNA
ggcgcgccagtcctagcggggagagacaagaaaggggtcaagttagctcagctgggcccagcctctcctctgtctctcctcggtctcagctctgggcgagcagcggcctgtctgaagagcatgcagcccccttactccccgcctggcctcgccatccctgcccccccagcctgacccccggccccagccgactcggaccgatg

SEQ ID NO: 9036 - DNA, 203 bp, Homo sapiens
  source 1..203: mol_type = other DNA
ggcgcgccagtcctcagggcgacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggcgactcggaccgatg

SEQ ID NO: 9037 - DNA, 203 bp, Homo sapiens
  source 1..203: mol_type = other DNA
ggcgcgccagtcctttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcacccgactcggaccgatg

SEQ ID NO: 9038 - DNA, 203 bp, Homo sapiens
  source 1..203: mol_type = other DNA
ggcgcgccagtcctgttttgactgaaaatgccgtcggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgttcacctgcttccacgactcggaccgatg

SEQ ID NO: 9039 - DNA, 203 bp, Homo sapiens
  source 1..203: mol_type = other DNA
ggcgcgccagtcctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagccgactcggaccgatg

SEQ ID NO: 9040 - DNA, 203 bp, Homo sapiens
  source 1..203: mol_type = other DNA
ggcgcgccagtcctgcagcgcaaggttggataagacgccgccgctcacgcccgctatcaggttctcataccggacgtggcggaataccgtgctccacgccgacgacccggacgccgactggccctggcccgtcataggctcggggcccgtcgacaccacggcgcccagggccgcggaggtgggacgcgcgactcggaccgatg

SEQ ID NO: 9041 - DNA, 203 bp, Homo sapiens
  source 1..203: mol_type = other DNA
ggcgcgccagtcctggggaggggccgggcggggggctggcggcagcggcggatggactcgcgggtatcggagctgttcggcggctgctgccggcccggagggggcccggccgtgggcggaaccctcaaggctaggggggccggcagcagcagcggctgcggggggccaaagggaaagaagaagaacggcgactcggaccgatg

SEQ ID NO: 9042 - DNA, 203 bp, Homo sapiens
  source 1..203: mol_type = other DNA
ggcgcgccagtcctatggcctcgctggacctgccgtaccgctgcccccgctgcggggagcacaagcgcttccggagcctgtcgtcgctgcgcgcgcacctggagtacagccacacctacgagacgctctacatcctctccaagaccaacagcatctgcgacggcgccgccgccgccgcggccgccgcccgactcggaccgatg

SEQ ID NO: 9043 - DNA, 203 bp, Homo sapiens
  source 1..203: mol_type = other DNA
ggcgcgccagtccttaggcggatgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 9044 - DNA, 203 bp, Homo sapiens
  source 1..203: mol_type = other DNA
ggcgcgccagtcctcgcgggcgttcgggggcggggcctgttccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgacgactcggaccgatg

SEQ ID NO: 9045 - DNA, 203 bp, Homo sapiens
  source 1..203: mol_type = other DNA
ggcgcgccagtcctacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacgactcggaccgatg

SEQ ID NO: 9046 - DNA, 203 bp, Homo sapiens
  source 1..203: mol_type = other DNA
ggcgcgccagtcctctctctcggcgtttccgctgtcagggccctgcggtgtgactcgcgggctcagctggttggtccggccgtagcacctccgcgccgtcgccatgtcgcggtttttcaccaccggttcggacagcgagtccgagtcgtccttgtccggggaggagctcgtcaccaaacctgtcggagcgactcggaccgatg

SEQ ID NO: 9047 - DNA, 203 bp, Homo sapiens
  source 1..203: mol_type = other DNA
ggcgcgccagtcctgtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggtcgactcggaccgatg

SEQ ID NO: 9048 - DNA, 203 bp, Homo sapiens
  source 1..203: mol_type = other DNA
ggcgcgccagtcctgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattcgactcggaccgatg

SEQ ID NO: 9049 - DNA, 203 bp, Homo sapiens
  source 1..203: mol_type = other DNA
ggcgcgccagtcctagacttcctccttcacttgcctggacgctgcgccacatcccaccggcccttacactgtggtgtccagcagcatccggcttcatggggggacttgaaccctgcagcaggctcctgctcctgcctctcctgctggctgtaagtgattgcagttgctctacggtgagcccgggcgtgcgactcggaccgatg

SEQ ID NO: 9050 - DNA, 203 bp, Homo sapiens
  source 1..203: mol_type = other DNA
ggcgcgccagtcctcagcaccaaagcggccgttctcggattccggagcgttctggagccccgagagacgccccggggttctagaagctccccggcggcgcccagtcccggcttcattcgggcgtccctccgaaacccactcgggtgcacgggtcgtcggcgagccgcgaccgggtcctggcgcgcacccgactcggaccgatg

SEQ ID NO: 9051 - DNA, 203 bp, Homo sapiens
  source 1..203: mol_type = other DNA
ggcgcgccagtcctgggagctggagcctcaacagcctccagcgagcccgggacccgccgacagcccgagaaaccagccgaaggacgcggggcggggtcgccgccgccgccacggggtgctccctccctcccgcccaagtccggccacctggtcttcccctcggccccggccgtctcagactcatcaaacgactcggaccgatg

SEQ ID NO: 9052 - DNA, 203 bp, Homo sapiens
  source 1..203: mol_type = other DNA
ggcgcgccagtccttccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttcgactcggaccgatg

SEQ ID NO: 9053 - DNA, 203 bp, Homo sapiens
  source 1..203: mol_type = other DNA
ggcgcgccagtcctatgggcctgctggccagtgctggtttgttgctgttgctggtcatcggccaccccagaagcctaggactgaagtgtggaattcgcatggtcaacatgaaaagtaaggaacctgccgtgggatctagattcttctctagaattagtagttggagaaattcaacagtgactggacatcgactcggaccgatg

SEQ ID NO: 9054 - DNA, 203 bp, Homo sapiens
  source 1..203: mol_type = other DNA
ggcgcgccagtcctcgggtgagtcccacttcccgacagcctggctcggccagcgactgggcggggagaccaaggatggaagtgggcttaccggccattaccctctttctcaccagcgccagcagccctgtggtggcgacgacgatggaccaggagccagtgggcggtgtggaacgaggagaagccgtccgactcggaccgatg

SEQ ID NO: 9055 - DNA, 203 bp, Homo sapiens
  source 1..203: mol_type = other DNA
ggcgcgccagtcctatgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgcgactcggaccgatg

SEQ ID NO: 9056 - DNA, 203 bp, Homo sapiens
  source 1..203: mol_type = other DNA
ggcgcgccagtcctgggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggcgactcggaccgatg

SEQ ID NO: 9057 - DNA, 203 bp, Homo sapiens
  source 1..203: mol_type = other DNA
ggcgcgccagtcctgagccctgctgccctccagccgggctcctccagccgggctcctccaccggcccttgcaggggcgcagagagctcggcgcccgcccttccgctcgcctttttcgtcagccggctggaggagcatgggtccgggaggtctctgggctgaggcggcgacagctcctctagttccacccgactcggaccgatg

SEQ ID NO: 9058 - DNA, 203 bp, Homo sapiens
  source 1..203: mol_type = other DNA
ggcgcgccagtcctgggtagaagcggcagagaccgcatattccggaggggctggctccaggccacgcgagccggagctggagacatttccagagccttgaggatggcaccggccctcgcacgctcaactcctgctcctcctcttcgcaatgagtaaacgacgcagattaaagcaaggagagccaatcacgactcggaccgatg

SEQ ID NO: 9059 - DNA, 203 bp, Homo sapiens
  source 1..203: mol_type = other DNA
ggcgcgccagtcctttccctaggtcttttcggaggcggagtttagtatccaagtccgcgggtgtgagcgcgcgcgtgtgtccgcgcgcctcgcccggcgcccccgccagtcctgccggaagatggtcaacgaccggtggaagaccatgggcggcgctgcccaacttgaggaccggccgcgcgacaagccgactcggaccgatg

SEQ ID NO: 9060 - DNA, 203 bp, Homo sapiens
  source 1..203: mol_type = other DNA
ggcgcgccagtcctccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctcgactcggaccgatg

SEQ ID NO: 9061 - DNA, 203 bp, Homo sapiens
  source 1..203: mol_type = other DNA
ggcgcgccagtcctggtgcgcatgcgcccggagagctgaagggcgcgcggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgcgactcggaccgatg

SEQ ID NO: 9062 - DNA, 203 bp, Homo sapiens
  source 1..203: mol_type = other DNA
ggcgcgccagtcctcgccaatcggtgcagactccggttctccccaaccccgggcctgggcagctgggcactggggcgccgttccccacccggcgcggacttcggaaccggccctgggactgactggctctaccactcgagcgcgtctccgctggacccggaaccccggtcggtccattccccgcgaagcgactcggaccgatg

SEQ ID NO: 9063 - DNA, 203 bp, Homo sapiens
  source 1..203: mol_type = other DNA
ggcgcgccagtcctatttccaggaacttcctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcgactcggaccgatg

SEQ ID NO: 9064 - DNA, 203 bp, Homo sapiens
  source 1..203: mol_type = other DNA
ggcgcgccagtccttctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactcgactcggaccgatg

SEQ ID NO: 9065 - DNA, 203 bp, Homo sapiens
  source 1..203: mol_type = other DNA
ggcgcgccagtcctccacgttacggatcggcttactccgcggagttggcctcatttctgcagtcggcgctccctgtagtttctcctctcgaacgccaggtggagcaaccggccggataccgccacagccctggcaggcggcgctgtgatgcctgagctgatcctgtatgttgcaatcactctatccgtcgactcggaccgatg

SEQ ID NO: 9066 - DNA, 203 bp, Homo sapiens
  source 1..203: mol_type = other DNA
ggcgcgccagtcctgagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcagttttatcgactcggaccgatg

SEQ ID NO: 9067 - DNA, 203 bp, Homo sapiens
  source 1..203: mol_type = other DNA
ggcgcgccagtcctcccgggacagccctcggagaaactgcatcatcctcactaatgatccacttcctcctcagggaataaaggctcagggaccggcagttctactctagagcccaccagcctctcagagcctccggtgactggcctgtgtctccccctggatggacatgtggacggcgctgctcatcccgactcggaccgatg

SEQ ID NO: 9068 - DNA, 203 bp, Homo sapiens
  source 1..203: mol_type = other DNA
ggcgcgccagtcctatttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcacgactcggaccgatg

SEQ ID NO: 9069 - DNA, 203 bp, Homo sapiens
  source 1..203: mol_type = other DNA
ggcgcgccagtcctggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaacgactcggaccgatg

SEQ ID NO: 9070 - DNA, 203 bp, Homo sapiens
  source 1..203: mol_type = other DNA
ggcgcgccagtcctggagcctgccgctccccgcgctcgtagcgcgggcctggggactggggatcccgccgccgggccgcagcatggggcgcttccgcgggggcctgcggtgcatcaagtacctgctgcttggcttcaacctgctcttctggctggctggatcggccgtcattgcttttggactatggtcgactcggaccgatg

SEQ ID NO: 9071 - DNA, 203 bp, Homo sapiens
  source 1..203: mol_type = other DNA
ggcgcgccagtcctaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcacgactcggaccgatg

SEQ ID NO: 9072 - DNA, 203 bp, Homo sapiens
  source 1..203: mol_type = other DNA
ggcgcgccagtcctagccaaggcttactgaggctggtggagggagccactgctgggctcaccatggaccgccggatgtggggggcccacgtcttctgcgtgttgagcccgttaccgaccgtattgggccacatgcacccagaatgtgacttcatcacccagctgagagaggatgagagtgcctgtctacgactcggaccgatg

SEQ ID NO: 9073 - DNA, 203 bp, Homo sapiens
  source 1..203: mol_type = other DNA
ggcgcgccagtcctcgactccgctggtcagcgccaagtgacttacgcccccgaccctgagccgggaccgctaggcgaggaggatcagatctccgctcgagaatctgaaggtgccctggtcctggaggagttccgtcccagcccgcggtctcccgggccgccctcctgaccggccggctcccggttcggcgactcggaccgatg

SEQ ID NO: 9074 - DNA, 203 bp, Homo sapiens
  source 1..203: mol_type = other DNA
ggcgcgccagtcctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagatcatccgggaagcccacgggaccctcaggcgggcaggcgactcggaccgatg

SEQ ID NO: 9075 - DNA, 203 bp, Homo sapiens
  source 1..203: mol_type = other DNA
ggcgcgccagtcctgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagcgactcggaccgatg

SEQ ID NO: 9076 - DNA, 203 bp, Homo sapiens
  source 1..203: mol_type = other DNA
ggcgcgccagtcctacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagcccgactcggaccgatg

SEQ ID NO: 9077 - DNA, 203 bp, Homo sapiens
  source 1..203: mol_type = other DNA
ggcgcgccagtcctgccgcagctgctgcacccacccccaccctgcccggccctttctgcaccgtcatctcctgccccgccgaggcttgacccccccgacaatgggcaacgcgcaggagcggccgtcagagactatcgaccgcgagcggaaacgcctggtcgagacgctgcaggcggactcgggactgccgactcggaccgatg

SEQ ID NO: 9078 - DNA, 203 bp, Homo sapiens
  source 1..203: mol_type = other DNA
ggcgcgccagtcctgtccgttggccagatcaactcgccgcgtgggccggccgttccctgagagtctgagcgctcgccgcacccccttccgagcttctattggccgtagcagacgtccgtctgccgctatctccgccccaatacggaagcggcctagtcctccggctccgacagctgggtgtccaggcccgactcggaccgatg

SEQ ID NO: 9079 - DNA, 203 bp, Homo sapiens
  source 1..203: mol_type = other DNA
ggcgcgccagtcctatggctcgtactaaacagacagctcggaaatccaccggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgcgactcggaccgatg

SEQ ID NO: 9080 - DNA, 203 bp, Homo sapiens
  source 1..203: mol_type = other DNA
ggcgcgccagtcctatgtcctcccgcagcccccggcccccgccccgccgtagccgccgccgcctgccgcgcccctcctgctgctgctgctgctgccgccgttcgcacctcaacgaggacaccggccgcttcgtgctgctggcggcgctcatcggcctctacctggtggcgggtgccacagtcttctcgcgactcggaccgatg

SEQ ID NO: 9081 - DNA, 203 bp, Homo sapiens
  source 1..203: mol_type = other DNA
ggcgcgccagtcctccgggaaacctgccattcttcgctgctgatcgcgggattctttttggatagggttgacgttcgtggatagactcatatctgtgaccagtgtccgccaccgcggatggcaagagacctgatgggaccggccctgccgcccggcttcaaggcccgcggaacagcggaggacgaagacgactcggaccgatg

SEQ ID NO: 9082 - DNA, 203 bp, Homo sapiens
  source 1..203: mol_type = other DNA
ggcgcgccagtcctggatttgatccccatcctggtgcagctccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatcgactcggaccgatg

SEQ ID NO: 9083 - DNA, 203 bp, Homo sapiens
  source 1..203: mol_type = other DNA
ggcgcgccagtcctctctgaaggcatggcgcgtacgaagcagactgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctacgactcggaccgatg

SEQ ID NO: 9084 - DNA, 203 bp, Homo sapiens
  source 1..203: mol_type = other DNA
ggcgcgccagtcctctccggctgcttgtagcactggtctcactgtccccgccgtcagccaccggttccttatccgtctcattccccattgtggcttggctgagccggtcgccaggcctcgctgtcctcctttgccttcctctctcctcagcggccgtactttgcgccgtacctcacctggcctgcaggcgactcggaccgatg

SEQ ID NO: 9085 - DNA, 203 bp, Homo sapiens
  source 1..203: mol_type = other DNA
ggcgcgccagtccttttcgccagtccgtccggccgttccgcattaggtccgggataactaggtggagtaggtgtgcggcccgccgccggacagcccgctcgctgtttctttaagcccccgcctgcgtcttcacggccctctcccgttctgctggaaagctgacgtggggcaatccgttcagaccctcccgactcggaccgatg

SEQ ID NO: 9086 - DNA, 203 bp, Homo sapiens
  source 1..203: mol_type = other DNA
ggcgcgccagtcctaatctcgactttcgcatttgagattccagacaggactcggctctccctctttcatacccaggggaaactgagtccctcacccccttcaagaccccaggccgctcctcgctcccgcccctcgaggcccttcgccggctctgcctcctcccccttcccgaccccaccggccataagcgactcggaccgatg

SEQ ID NO: 9087 - DNA, 203 bp, Homo sapiens
  source 1..203: mol_type = other DNA
ggcgcgccagtcctacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaacgactcggaccgatg

SEQ ID NO: 9088 - DNA, 203 bp, Homo sapiens
  source 1..203: mol_type = other DNA
ggcgcgccagtcctgggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtccgactcggaccgatg

SEQ ID NO: 9089 - DNA, 203 bp, Homo sapiens
  source 1..203: mol_type = other DNA
ggcgcgccagtcctcttcatctctccatctctgcgctgctgccggctgcgccatccagcacccagactccagcaccggccgaggacccccactccggctgcagggaccctgtcccagcgagaccgcaggcatgtcatccgaaaagtcaggactcccagactcagtccctcacacttctccgccgccctcgactcggaccgatg

SEQ ID NO: 9090 - DNA, 203 bp, Homo sapiens
  source 1..203: mol_type = other DNA
ggcgcgccagtcctactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgcgactcggaccgatg

SEQ ID NO: 9091 - DNA, 203 bp, Homo sapiens
  source 1..203: mol_type = other DNA
ggcgcgccagtcctagctgcgccggtgactgaggggccgggcagtggagaagtggtggcggcgggcggcgggcggcaaaggagcagccatgagggccgggcccagtcaccgaccgtgctgaggagtcatggaagagtttttaaaccagtgtgagccactgccccatgttgtgttgatgccaatctgcccgactcggaccgatg

SEQ ID NO: 9092 - DNA, 203 bp, Homo sapiens
  source 1..203: mol_type = other DNA
ggcgcgccagtccttgcgcggcgcatgcgtggcccggggtctcggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgcgactcggaccgatg

SEQ ID NO: 9093 - DNA, 203 bp, Homo sapiens
  source 1..203: mol_type = other DNA
ggcgcgccagtcctgcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgcccgactcggaccgatg

SEQ ID NO: 9094 - DNA, 203 bp, Homo sapiens
  source 1..203: mol_type = other DNA
ggcgcgccagtccttcctggtctccatgtcatctgccagaaaggccacctgcgccagcacctcctgagaccggccttcaaagacacgacgcatgccgctctgccgtccggagcacttaatgcctagagccagcagggtcccagtggccgcgtcactgcctctgagccacgcggtcattccaactcaaccgactcggaccgatg

SEQ ID NO: 9095 - DNA, 203 bp, Homo sapiens
  source 1..203: mol_type = other DNA
ggcgcgccagtccttccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgcgactcggaccgatg

SEQ ID NO: 9096 - DNA, 203 bp, Homo sapiens
  source 1..203: mol_type = other DNA
ggcgcgccagtcctgccccgggaccgaggggcagccaacccaatgaaaccaccgcgtgttcgcgcctggtagagatttctcgaagacaccagtgggcccgttccgagccctctggaccgcccgtgtggaaccaaacctgcgcgcgtggccgggccgtgggacaacgaggccgcggagacgaaggcgcacgactcggaccgatg

SEQ ID NO: 9097 - DNA, 203 bp, Homo sapiens
  source 1..203: mol_type = other DNA
ggcgcgccagtcctagtcccggggagcgcaccggaagttctcgcctggcccaggcgcggggtccaagatggtggcgctaggagccgcgacccagtgatagcggccgtggaggggcccccgaccgagcgggaggttgggggtagcctggagattctgaagacaggaataagatgaaggaatggaaatcacgactcggaccgatg

SEQ ID NO: 9098 - DNA, 203 bp, Homo sapiens
  source 1..203: mol_type = other DNA
ggcgcgccagtccttcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggcccgactcggaccgatg

SEQ ID NO: 9099 - DNA, 203 bp, Homo sapiens
  source 1..203: mol_type = other DNA
ggcgcgccagtcctgcagtacacgggaggcttttaattccattgtggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccgcgactcggaccgatg

SEQ ID NO: 9100 - DNA, 203 bp, Homo sapiens
  source 1..203: mol_type = other DNA
ggcgcgccagtcctacgactgcgtgggtgagtcgtctataaaaactcatctctgcgcgtctcttcgccacattcgcttcctgctttcggtgtgtctgttgtgtcttgttgcgggcaccgcagtcgccgtgaagatggcgtctaccagccgtttggatgctcttccaagagtcacatgtccaaaccatccgactcggaccgatg

SEQ ID NO: 9101 - DNA, 203 bp, Homo sapiens
  source 1..203: mol_type = other DNA
ggcgcgccagtcctctgggctgatccggggctcggccaagctgaggcggcggcgcccggccgtgcgcccagcttgcaggcgcctggctctcacgatgatgaagaagaagaagtttaagtttaaggtggacttcgagctcgaggagctctcctcagtgcccttcgtcaatggggtcctcttctgcaagacgactcggaccgatg

SEQ ID NO: 9102 - DNA, 203 bp, Homo sapiens
  source 1..203: mol_type = other DNA
ggcgcgccagtcctcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacacccgactcggaccgatg

SEQ ID NO: 9103 - DNA, 203 bp, Homo sapiens
  source 1..203: mol_type = other DNA
ggcgcgccagtcctgtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggccgccgcccaccgcccgccgcccgactcggaccgatg

SEQ ID NO: 9104 - DNA, 203 bp, Homo sapiens
  source 1..203: mol_type = other DNA
ggcgcgccagtcctctgcctcccccccgctcccgctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccacccgactcggaccgatg

SEQ ID NO: 9105 - DNA, 203 bp, Homo sapiens
  source 1..203: mol_type = other DNA
ggcgcgccagtcctgcacacacgggcgcgcacacacacgcgcgtacacactgggtctccaggcagcggccgtcgccgcatccccggcagcagctccaggcaaagtgacagaggacagtgctgctgtgagtttgacgaagtggacatcacctgcagtcagtccagagctgcccagtcttgaatataatccgactcggaccgatg

SEQ ID NO: 9106 - DNA, 203 bp, Homo sapiens
  source 1..203: mol_type = other DNA
ggcgcgccagtcctccacgtgtccccggtcaccggccctgcccccgggccctgtgcttataacctgggatgggcacccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 9107 - DNA, 203 bp, Homo sapiens
  source 1..203: mol_type = other DNA
ggcgcgccagtcctttgaaaatctactctatcagctgctgtggttgccaccattctcaggaccctcgccatgaaagcccttatgctgctcaccctgtctgttctgctctgctgggtctcagctgacattcgctgtcactcctgctacaaggtccctgtgctgggctgtgtggaccggcagtcctgccgcgactcggaccgatg

SEQ ID NO: 9108 - DNA, 203 bp, Homo sapiens
  source 1..203: mol_type = other DNA
ggcgcgccagtcctttcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgcccgtccttcggcgactcggaccgatg

SEQ ID NO: 9109 - DNA, 203 bp, Homo sapiens
  source 1..203: mol_type = other DNA
ggcgcgccagtcctgaagtcgggggtgggtccctccggacgccgaagtgggctcgggatgcggggctgggaccctcccgattccggggcggattccggacgccgggaccggccattactggtgccgggttgggcttctccagatgccggggctgggtccttcccaaggttgagacaaaaggatgccaccgactcggaccgatg

SEQ ID NO: 9110 - DNA, 203 bp, Homo sapiens
  source 1..203: mol_type = other DNA
ggcgcgccagtcctggaggggcggggtgagaaggctgcgcgcgggtaaaggggccgcctcgagcggggtccgagcgttcagcggacgcgcgcggcctcgatctctggactcgtcacctgcccctccccctcccgccgccgtcacccaggaaaccggccgcaatcgccggccgacctgaagctggtttccgactcggaccgatg

SEQ ID NO: 9111 - DNA, 203 bp, Homo sapiens
  source 1..203: mol_type = other DNA
ggcgcgccagtcctctctctccctctgtctccctccctctctctctcccgccgcgcccgcctcccgcccgccctcgctccctccactcctctcccctcccctccccggcactgcagcaccagccgtctgcagctccggccgccacttgcgcctctccagcctccgcaggcccaaccgccgccagcacccgactcggaccgatg

SEQ ID NO: 9112 - DNA, 203 bp, Homo sapiens
  source 1..203: mol_type = other DNA
ggcgcgccagtcctagacagcctgcccccaccggccctcttgtgtggctacagctgggtgctgggaaggggcctcctactggaggggccgggtgggctggggtccccagtctccccgttgtccttttcctagaggagatcgccaagcacaaggggcccccggtgttcactcaggaggagagatacaagcgactcggaccgatg

SEQ ID NO: 9113 - DNA, 203 bp, Homo sapiens
  source 1..203: mol_type = other DNA
ggcgcgccagtcctgagccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgactcggaccgatg

SEQ ID NO: 9114 - DNA, 203 bp, Homo sapiens
  source 1..203: mol_type = other DNA
ggcgcgccagtcctgaaaacttcctggagaaggatggattttaccctgtaaaagaagaaagacatggatgcataagaagagggttgaagagggggaggcctcagacttctcgctggcctgggattcctccgtgacagcagcaggaggcctagaaggagagccagagtgcgatcagaaaaccagccgtgcgactcggaccgatg

SEQ ID NO: 9115 - DNA, 203 bp, Homo sapiens
  source 1..203: mol_type = other DNA
ggcgcgccagtcctaggctccaccttttgtgtttcccgcacagtcaatcaaaataggaaaaaaaaatcccgggaccgctccggccgtgtccgccgccgcttcccgcatcctctcccgccgccgccgccttcgctcctcaccatgtgtaaggcggcggggagccccgcctgaggtgccctaaacacactcgactcggaccgatg

SEQ ID NO: 9116 - DNA, 203 bp, Homo sapiens
  source 1..203: mol_type = other DNA
ggcgcgccagtcctacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagagccaaccgactcggaccgatg

SEQ ID NO: 9117 - DNA, 203 bp, Homo sapiens
  source 1..203: mol_type = other DNA
ggcgcgccagtcctggaagccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttcccgactcggaccgatg

SEQ ID NO: 9118 - DNA, 203 bp, Homo sapiens
  source 1..203: mol_type = other DNA
ggcgcgccagtcctagacttctctcaactcaacaaaaacccacctcccattgccatgtattgctgtgctctccgctcctgcagcgtccccaccggccctgccaccaccttctgctcatttgataaaagctgccgctgtggagtctgcctacccagcacctgcccacatgagatcagcctccttcagcccgactcggaccgatg

SEQ ID NO: 9119 - DNA, 203 bp, Homo sapiens
  source 1..203: mol_type = other DNA
ggcgcgccagtccttgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggcgactcggaccgatg

SEQ ID NO: 9120 - DNA, 203 bp, Homo sapiens
  source 1..203: mol_type = other DNA
ggcgcgccagtcctgcaggtgtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcgactcggaccgatg

SEQ ID NO: 9121 - DNA, 203 bp, Homo sapiens
  source 1..203: mol_type = other DNA
ggcgcgccagtcctgggcacgatgcggcaacccgccgttcggttggtgcgcctgggtcgggtgccgtacgccgagctactggggctgcaggaccgctggctgcggcggctgcaggccgagccaggcattgaggccccgtcggggactgaggcgggcgcgctcctgctctgcgagcccgcggggcccgtcgactcggaccgatg

SEQ ID NO: 9122 - DNA, 203 bp, Homo sapiens
  source 1..203: mol_type = other DNA
ggcgcgccagtcctagaagccgcagcccaggcggcggtccctcccgctgtcgccgcccgggtgtagcgcatcacccggagcccaccggccgcaggtgcctcctccggccccagggggccccgggagccctgaagggcgaagcggcagggacgcctctcttgggcgaagaggcggcctcaccgccccggcgactcggaccgatg

SEQ ID NO: 9123 - DNA, 203 bp, Homo sapiens
  source 1..203: mol_type = other DNA
ggcgcgccagtcctgtgagggttgaatgtaagatggcgcccagggagctgtgaggagaaaaccctgtcggtcttggagcgacgacggcagaaccagggtccctggcggtgcggcggggccggcgggtgcagcggaggcggcggcggcggcggcagtgacgtcgccgggaaccctaaggactctgcaatcgactcggaccgatg

SEQ ID NO: 9124 - DNA, 203 bp, Homo sapiens
  source 1..203: mol_type = other DNA
ggcgcgccagtcctgggtccccggaggcccccgggctctgcccctccagctagagaggcagccgaaccctagcggcctggaaggggccgggaaaccgcggccagctggcaaggagtggcccccgggggcggggcgccggcgggtgtgtgagtagcccgcccggcccgggtccgagttccagccccgcgcgactcggaccgatg

SEQ ID NO: 9125 - DNA, 203 bp, Homo sapiens
  source 1..203: mol_type = other DNA
ggcgcgccagtcctaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaaggtgaatgttggagacacagtcgcgcgactcggaccgatg

SEQ ID NO: 9126 - DNA, 203 bp, Homo sapiens
  source 1..203: mol_type = other DNA
ggcgcgccagtccttgccgggagagtgaggccgcgggggctgggaagggaccggtgtatgggggacagcaggcgaaggtcactcgggaaccagcccagctctgaggctgcgggcaggtcggaaagggagcaggacggcgacccccgtggcctccagagctctgtgtacgagagccggcgggtcacagacgactcggaccgatg

SEQ ID NO: 9127 - DNA, 203 bp, Homo sapiens
  source 1..203: mol_type = other DNA
ggcgcgccagtcctactccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtcgactcggaccgatg

SEQ ID NO: 9128 - DNA, 203 bp, Homo sapiens
  source 1..203: mol_type = other DNA
ggcgcgccagtcctagagacgcggcaagggggcggggccaaaggccctaagctcggcgttccagagagtggggagggggcaagtgtcagtcaggacgggagtccggcgggttacagcggaggcctaggtggcagacagggggcccgggccgctgcgtgttgtccacccaagatggagttcctcctgggcgactcggaccgatg

SEQ ID NO: 9129 - DNA, 203 bp, Homo sapiens
  source 1..203: mol_type = other DNA
ggcgcgccagtccttccacgtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatccgactcggaccgatg

SEQ ID NO: 9130 - DNA, 203 bp, Homo sapiens
  source 1..203: mol_type = other DNA
ggcgcgccagtcctgcctcgcagccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtcgactcggaccgatg

SEQ ID NO: 9131 - DNA, 203 bp, Homo sapiens
  source 1..203: mol_type = other DNA
ggcgcgccagtcctaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaacccgactcggaccgatg

SEQ ID NO: 9132 - DNA, 203 bp, Homo sapiens
  source 1..203: mol_type = other DNA
ggcgcgccagtcctgacttccggcacgaaggggcggggctgggctcgtggctgagccagcagctgcagcagctacgggagtggccgggtggccggcgggtgccagccgccatggaggccgtgccccgcatgcccatgatctggctggacctgaaggaggccggtgactttcacttccagccagctgtgcgactcggaccgatg

SEQ ID NO: 9133 - DNA, 203 bp, Homo sapiens
  source 1..203: mol_type = other DNA
ggcgcgccagtcctgagagcggcgcctgatgacgaccgggagggcggggcccgtctggggcgccggcgggtgcgtttgaatctggtccgagcgcgggaaacggcgggtccccgagcccagggttacaaaataaatgccatttgaacagtgccatctgtcatggaaaaacgtgagacgtttgtacaagccgactcggaccgatg

SEQ ID NO: 9134 - DNA, 203 bp, Homo sapiens
  source 1..203: mol_type = other DNA
ggcgcgccagtcctgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcacccgactcggaccgatg

SEQ ID NO: 9135 - DNA, 203 bp, Homo sapiens
  source 1..203: mol_type = other DNA
ggcgcgccagtcctgggtggactccgagccggcctgtcaggcaagagccgggcaggtgcggtggcggaagtgcagggacggaggccgaagcggagcggtctagggagccgcggccgcgggtcacccggcgggtagcagttgctgagtgtcagctagacagcagcgactagggctcgggcgccggcgagcgactcggaccgatg

(The sequence listing continues in the following parts.)

What is claimed is:

1. A method of inhibiting translation of a protein-coding nucleic acid sequence present on recombinant circular RNA molecule comprising a protein-coding nucleic acid sequence and an internal ribosome entry site (IRES) sequence region operably linked to the protein-coding nucleic acid sequence, wherein the IRES sequence region comprises:
(i) at least one RNA secondary structure element;
(ii) a sequence that is complementary to an 18S ribosomal RNA (rRNA); and wherein the IRES sequence region has a minimum free energy (MFE) of less than −18.9 kJ/mol and a melting temperature of at least 35.0° C., which method comprises contacting the recombinant circular RNA molecule with a first oligonucleotide molecule, whereby said first oligonucleotide molecule hybridizes to the at least one RNA secondary structure element and/or the nucleic acid sequence complementary to an 18S rRNA present in the IRES sequence region of the recombinant circular RNA molecule and inhibits translation of the protein-coding nucleic acid sequence.

2. The method of claim 1, wherein the first oligonucleotide hybridizes to the at least one RNA secondary structure element and to the nucleic acid sequence that is complementary to 18S rRNA.

3. The method of claim 1, wherein a first portion of the first oligonucleotide molecule hybridizes to the at least one RNA secondary structure element and a second portion of the first oligonucleotide molecule hybridizes to the nucleic acid sequence that is complementary to an 18S rRNA.

4. The method of claim 1, wherein the first oligonucleotide molecule hybridizes to the at least one RNA secondary structure element and a second oligonucleotide molecule hybridizes to the nucleic acid sequence that is complementary to an 18S rRNA.

5. The method of claim 1, wherein the protein-coding nucleic acid sequence is operably linked to the IRES sequence region in a non-native configuration.

6. The method of claim 1, wherein the RNA secondary structure element is formed from the nucleotides at about position 40 to about position 60 of the IRES, wherein the first nucleic acid at the 5' end of the IRES sequence region is considered to be position 1.

7. The method of claim 1, wherein the at least one RNA secondary structure element is a stem-loop.

8. The method of claim 1, wherein the at least one RNA secondary structure element is located 5' to the sequence that is complementary to an 18s RNA.

9. The method of claim 1, wherein the at least one RNA secondary structure element is located 3' to the sequence that is complementary to an 18s RNA.

10. The method of claim 1, wherein the at least one RNA secondary structure element is formed from the nucleotides at about position 40 to about position 60 of the IRES, relative to the 5' end thereof.

11. The method of claim 1, wherein the IRES sequence region has a G-C content of at least 25%.

12. The method of claim 1, wherein the IRES sequence region is between 200-800 nucleotides in length, between 150-200 nucleotides, between 160-180 nucleotides, or between 200-210 nucleotides in length.

13. The method of claim 1, wherein the IRES sequence region is derived from a human IRES.

14. The method of claim 1, further comprising a spacer between the IRES sequence region and a start codon of the protein-coding nucleic acid sequence region.

15. The method of claim 14, wherein the length of the spacer is selected to increase translation of the protein-coding nucleic acid sequence region of the recombinant circular RNA molecule relative to translation of a recombinant circular RNA molecule having either no spacer or a spacer that differs from the selected spacer.

16. The method of claim 1, wherein the protein-coding nucleic acid sequence region lacks a stop codon.

\* \* \* \* \*